United States Patent 6,812,339 (POLYMORPHISMS IN KNOWN GENES ASSOCIATED WITH HUMAN DISEASE, METHODS OF DETECTION AND USES THEREOF) - sequence listing, part 22

SEQ ID NO: 12656 - DNA, 253345 bp, Human
attgatagccctgaattgcaaaggttgagggatatgtgaatccattgtttgcctttgcaaataataggcagagtttcttaatgtggactagagttgctaatcttagattatccatttgagtcatgatttcctactatacaaagcaggagttgttatggggtagaagaatttttatcccaggaatgacaaagataagttgaagcactacagtaaaaaattagagttagacatggacacgtagaagggaacaacagactctacagactctaggacctacttgaggctgaagggtgggaggaggtggaagattgaaaaactacctatcaggtactgtgcttattacctggatgatgacataatctgtacatctaacccccatgacacacaatttacctatataacaaacctccaaatgtacccctgaacctaaaataaaagtttagaaaaaatgagaattagttcttggattcacaagatataaagagaagccagccattgaataccttgtttgaaagtaggttgacttcatgttttgtagcaggtctgaataatccatttgtctaattcactgtgctctataatacctattttcaaagatagtttcccaagttctgagaagtccttacatattagctgactttatactaaaatttgggtttaaaaaaatttttttttagagacgtggtctcactctgtcatacaggttaaagtgcagtggtggtgtgataatagtttactgcagcctcgaaatcctgggctcaacaaccctcccacctcagcatcctaagtagctgggactacgagtgtgtgccaccatgcctggcttaaatttttttatttttatttttatttttatttttttttggagacgtgggatttcactatgttgcacagcatggtcttgaactcctggcttcaagcaatcctcccaccttggcctcccaaatccctaggaggcacaagcatgagccattgtgctctgccctaaaatttgttttaaattaaagtttttctggtaagaatgtaatagcgtattttgacaaagggtgagaaaggcttcttctggaagcaactaatgctaattgataaaattgatatataaatgggttgtggtttccagctctcttctgggagagaaataaaagggaatctaataaagaacaatgttggtttttctctggctgctttactaacaagaaacaccatgaaacatttctctcatttctaaacatttctataaaaaagataacttatagagaacaaaatcacaatcgaccagttatttcccaaacaaattttccatttttacaatacaaagggaaagctacaagtattagctgatttagaatatttctcatctaggatgagatgtcccagatggcagagtagagagagttttggatataattgaaactctatagaattggtggcaaatgtgcacatatacacacacacacacgttcctatccaattaagcagccaaaaagtcagcaatcccattgcttctttagtttaattaaagtcactgattttccaaacccaacatttagagatcacatcagatgctactcataatgtaaggaagcatgtattatggagaggttatcctgggtgaaaggtacagcaacaactgaatagtcaaccgaaacttctatcaatgggccaagctttgggagcatcaatatataaaagtttagaattccattttgtatcctcttctcccccaaaaagaaagagcactggaaattattccttgtgtggtgtttaatagtggtagatcattttgattaaggaattaaatggattgaggtgcatgagagcaagaaagaggaggggcaagaggggggattataggataaggtgtactgctactttaaaattatgtatgcatgatcccatccaggtccctcccactgcttgaggtaccagcggaaagcttgggcagctcagttccaagagggccaccaagcagaccacgctctgagcttcaggtaaccaagtgtttgctctgcagaatactttacctgggcacccaagtcttccttccagcattcctgctgctacagcctatttgctgagtaaccaggggttacagcagcgttgccaggcaacgagggacagcggtcctgttgaagagccatttgtcacactgaggggactggttgaaatgcaataaagaaatggtaactcagcttatttatcaatacaattacttgcacagtattagggatccatgtgtaacctacaaattcatagtcatatgaggaaacacagaaacattttgctaaatattaaagcataggacagacagatggtgttgggtttctaatcagctttactctgagcttaaagttgctgcacatgctgggataaggggaaaggcccaaagtcctttgccagctttattttgggcatctgtaagttagctctgggttacaatgtacagtgcatgtgtaaagaaaatctacaagattcttttccctgttaagtagagctggtaatgccattgctaattccctggggtgaagtaacaacacaaaattattgtatgtgtaatatattattaataattatatatatataaaacacacacatatattatataaatatttatgtataactggttataaatattactggttgtcctgtggacttataaagtgcttgatttgcccaatgcaatcaagagatttaccaaaaggatgagtattttactctgagcactgtgcttcaaaatgttttttgagaagttcagtagtgttgcttctaggagctcaaagtcctcaggcctgggatgagcttcagttttaaaggtgcagcagctttcccttgacgccctacgtttttgattcccagataccagcagctactcatgtcttcgccattgctaagaacgtcgttggtattaccttactctgagaacgtgtctgcagtttccagaaaatggagtatcgcaacatcacttaaagtaccctgcttcaaagtattgctggcaagtggcgtgggcctgattatttatttagaaatgctttatcaggaggagaatgcttttttgtaaacatgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctacaagttttatttttggaaatcacaagagctgcttttcttctcctccttctccaaagctgatggcatcatttaccttagctgtatggctgaaacctgagcaacaaggtgtaatgtaagtagtagtgtaggtataagctttcataggtccccaaaaccagtagtagtgaagatcatttcagcctgaattccaaaccggaagtgaaggctatatagaattcatggtattgaagactaactcttccagttgtttccccaattaaaatttttttctcttctatggatgaaatggaccatgaaaaaaaatgtgaaaatagtttatcaaaggcaaatgtgtttatgcaggaatcatttattttctatagcttagcgcgacctttggtcttagccttcaaagcctaaagaagactcagagtgagttttaaggcatggaaacttgtaattaatacaaataattaatattttcaaaatcttgaactgggtttatataatcaacatttccttactagggtataacattttcattaggcagatagttctcccagtccttgggactgttttcttcatcctcgtttccccaagaagagctgtttgtttgactcatggaagatgttcagtaatataaattgaatatataaataaccctccatctctaaaaacatatagcttttagttctttatcttgtggtattttcattttccaattagttaggaaatatgtaggtaagtgtgagagattctcaaaagctttcatgctgttcatcccagagaaatgccttcaatgagtctgggtcttattactgccattttttgttatttaatcaccagtttttcattctgtaatcttttctcaagctgatatctaatgagtttcttctaaatatttattgccaacctggagattttaatatataggacagttttgaggaatttttgcttatcttttttcttcctagagggcttttggccctttctcttgtgacattttctgtgtgtgacagcgttggctggatatctaaaaacttgtgaaacaaaccagaaaaggattacaatctcataagcaaataggacttaaatgtttttggtgtttagtttcaatttgccaagtgaaagttggcatgtcttcattttgttttaaatttggattaatcacaaaattaatcacaaaccattcccatttctacatctctcctcaaagaaaaccttgttttcttactgtttgaaattctagtaaattcaagctactcagtttatataattaacatctgaagagtcttaaaacattgtcttttgacaaatagggctaagataaaatatccttctgagcttgtagggacatatctgtaccaaattcatcttctattgacatcattttgtataaataagacagagaagtatttacagggttggaagaacatggttaatggttttgagagttccttgtatcaaggtcgtttccattttcaaaattaaaatacctttgggaattgggggaatttcggggtgtttgcactagataagtaaaacaaacaaaacatggattatccaattattgtttattcaggagcagaataaatccagttcctaaatattttgctacctgccttcctctcacatttattatctaccaaagctagtatgtttacaagcaaacaaaatagcaaggaagataatcaataacatattaagaaatgcattttcagtaagcttgggaaaataagtctgcatttggtaaatacattcttgagtaatggtcgaattctcacttgtagatttaaacagaagaaaaatgaataggggcaaactcttttcaggttaagacctgatgggtagggataaaaacaaattcacttcagtaaattagaaatattcaactactgaagggttaaaaatataatttgcagtagaatttatataaaacttttatttctacttatataaaacctttatgtcatctaaatctatttgcctaaattaaaaatatacttgcactcataactttataccaaatatacatacaaaatatagtaaaattgtgacagtaaatgagggactattagtgttttacaatcttattcttacctcccaactcaggaaaaaaatagatgcaagtgatagatgcaagtgagaagaaattatgtgtgaaaaacatgccctttaaggaaagctttaaaccatctttagcagtaattcttgattggctcaattttatacatttgcctctctgatacttcctaccaaatttgatcacaaactcatcattttttgagagactactgtatcctaggtgtttgtgtgtgtatcctcagaatactcatgatctaaatgatctaatggagtgtacagatggatgagtgttattacctaggcagcacagtgtgttaagtgagcacaaagtgagacccctcaaccgaccctgagcaggaagaagggtgccaggaccaagcataatcattcagataccaaagctaagtaggaggtaaccaggtgaagaagagacctcaaggtctgaaaggtgtgtcactctaataagggtagagataacttaaaataatttgataactgccctgacacaagacctggaagttttctgaaaactcttctagtttttcaaaatcttatttcactgtgttctagaaggctgaaggacctttcacctcagatatttaacatgatctcagtacctcagttggactgtacggtcatggagaggtagccagtcatcttacagacactggctttggctttgtgccagttgatgatggggtgagtagagactatagctgtccattcttcatttcaccatgggaattaaatagagtgattctgacttcagggctaccaatttagagccttccatggacactaaatttgctttacattaaaaaaaaatttttgcactgatgacttaatactcaagcggcctgtagtgtgttgtaccacttcctctaaaagaaatagcaggagaactaatgagccaataacctaaatgttagttttgcagaatgattcaaccactttagtttccatcatgaatctctaatgaagggtgctgaggctctggggaatatattgtaaataagaattctattttttattgaaataaaggggcttcttcattggaataaagctttcattgaatataatgacattcaggcacttattcatagtacaccattttgagcaaagtttgaggtcattttaacaccactgtaactgcacaataccttagcatgtctttttggttggatgctgaccttttctctcttttccggttgcttcctaaggtgtgttatagaaaagacggtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgagtaaaataaaaaatatttaacatttggttaaacacaaggatttgtcttcctttctctcttttaaatggcatctactcacaaaatctgcagcagtatcttttagatttcaggtgtgtataaatgacaactaaagaagaaaaatatttaaatgacctaatgatgtatctcttgatatactagcatttcctcccccaaaattgctgtaaaagctctcacagaaacttaaagacaatgctatctgtaattgtaatatcctcagaaaatttttgttttcttgggttcgtatattctattttgtttaaaaatgtgtaagggctcatttgatgtctggtactaattttactagtcatggatgtattaataccccagcttgatttttacatctgtctttctcagcagctgatgatgtgaataaaatttgtctgttgcattaaaatggtgaccttagaactaatgaactttacacttgaggcactcaaaaggtgttatattattattttagttgtcaaccacagtttgtatgagccttagaagctgctaaaggctgagagagctgtgacatgtctggtatttacagtctccagaagagaggcacagttcatccttttgttttttcagggcactggaatggcccaatacagttaaagccacacctgcctttcaaaccaggtgtattagtccattcttccactactataaaaaataccggagactgggtaatttattataaagaaaagaggttcaattggctcatggttctgtgggctatacaggaagcatgattctggcatctgctcagcttctggggagaccttagaaaacttacaatcacggcagcagacaaaggctgagcaagcacttcatgtggccagaatagggaggaaaagaaagaaagggaggtacttcacacttttaaaccaccagatctcatgagaattctatcaggagactagcactaggtggatggtgttaaagtactgatgagaaaacgtctacatgttccaataacctcccatcaggccccaccaccaaagctggggattacaattggacatgaggtttgggtggggacacagagccaaatcatgtaacttggggtgctgggtaccacagtttccagtatgagctctcatatgagcatccatccagtggctcatgtgaacctcatttgaactagaggacatttacatccttgttcattttataaaaattatctttgatttctcacttttttttttttttttaatcttgaagcagataatgagtgtgcgtcctcagagggtcttgataattgttcattgttttggctttcagatactaagatatgagtttagcaaatgtgattggcaggggtcagagttttcatacacaactagggttgaaatgatacacaaaggggacgtcatgtctgacgtcaagccttgtgcataggacatgatggtttctgattctcaatgcttattctccatgtgttcagtagttaacagataggagaccaatttgtcctagtcttgaagtttccattgtcttgaagtctccattctgcccactgaccagtcctacagaattgggttttaatattaaaaacgtagaaatagaaacttttaaagacagtgccatctttgcagaagatgccaaatagatatgtttgttgcatatttttgtatcaacaatgacaaaaaaaattatctttacttgcctttattttgtgttatctgtgaaactgtgccatgttttggcaggcagtagtacattaaaagcttcacaaagaaagtttaaaatctaaatgcagagcggtaaccatgactgaattactcccttggggataaaatgctcttagagtgcctactgaaatcagcattatcatttcaatacatgtcaaatatgagtcatttactagtttaggcaaaatttcttcatgaatctttaaatctttctcttctttcaagaaaaggttaaagtacttatgatttaatgagactgctttatttcataactgtttgactatcaagagaaaacttgtccttttcgatttgtacactcttttatttatttttttgcataagttttaaactattctgcattttatattaaaactacagaactaggcagtcacaaaatgttagaaaaccattcagatctgtcatttaatcatctagcacttattaaatatttgaggggtatgcagcattatgggaatctggatttattcaaatgaaaattaaagagcaattatttactctaaaatggagctctatataaggttcctttatattggacaacagtctgaatatgtttaaggtattatgaaatttataaaaatccatattatagatttttttttgagacagagtttctcccttgttgcccaggctggagtgcaatggcatgatcttggctcactgcaacctccgtctcctgagttcaagagattatcctgcctcagcctcccaagtagctgagattacaggtgcctacaaccacactggctaattttttgtatttttagtagagaaggagtttcaccattgttggccaggctggtctcgaattcctgacctcaggtgatccacctgccttggcctcccaaagtgatggtattacaggcatgagccagagtgcccagcctagattttgaaaaaggaatgtactgattactcaaaagttgttataagaaataatggaggccaggcgcagtggttcatgcctgtaatcccagcattttgggaggtagaagtgaacggatagctcgaaccaggagttcgaggccagcctgggcaacatggcaaaacctcatctctacgaaaaaacaccctaaaaaaattagccaggtgtgatggtgcgtgtctgtagacccagctactcaggaggttggggctaaagtgaaaagatcacctaagcctggaagtcaaggcttcagtgacccatgatcatgccactgcattccagcctgggtgaaagagcaagatcctgtctgaaaaaaaaaaaaaaaaaaaagtgacaggaaggacaggagattaggagttgggaaatctgatttaggttatgctactctgtagtcttaagaataaaatttataggaatccatatgatagttgtttaataaggaatgtactaattgcttaaacgttgttataagaagtaatggaagctgggcacagtggctcacacctataccctgcccgccttgacgtctcaaactgagtcatttgactcagttttcctatttacataagaagattgaactagatgaacaaaatgagggccttttgaattcttcataaacaagtaagtggagtgtggagtgtagcacaagtcattaaagtatggcaagctgttgagttgtgtagggttatttaggtagtaagtgacagagccagccccattaaccaatgatcagtcttgtgctttttttctcttctcccatgctgcttggcatttacataaaaacatttttttgctagattttctggacaaaatatagagaaatgtagattgttactattccattgtataactgcaagaacatttccagaaaaaatattttagtataaaatgtaacttactgttgcatgattatataatgcatctaaactccatttaatttggggattagggacttttatcatgctgggcataggacagaacaaatgattaataatcttgtttagtcaagtttcaaactacaaacctgcactttatgtatatgtggattttcacccatcttccaaatggccacaaattgatgaatttatatagtgtgtgtgtttctgtgcatgtgaaaaaataaaacatacaactctattcgtggaatggcccagaaaccagaattttagttcgttgcttatagtgattttttactggttagcttatacctggtggcataaaattaattagcagatctcaacttatgctttatctcagacagttcacttgtatcagctttccatcagtaaaatcagaattctaatttaccaaaatcagaaaaaaaattattttaaataattaaatatctgggggaaaagatgtcaggaaatccagacataccaaaattggaaatcgaatttcctaaacaaacaaatagacaatatgctcaatattgctatggtaatgaatctcacagcttttattccaaaactagcattttaaagtgtcaatctgttggaaaatgattagtgtttaaattaatattcatttatggacttgaatctgacaggattgccaattgaaattttactttggggtttaatatattggctatttcaaattatatcaagctaaaattcattgtgtcattttttatactaaaactagaaaaaatcaattcatagtttttattatcatatagggaacactgatcatattagcaaaatttttaaagcttagttttcatattaaatcagcacatgctgtagttataagatttcctttggttactcttataaaagttttgaaatatgtaaaaaaatttactttagcatttcgttatggattggtaggtaaaacaatatggaaataagtatatgtgtttagtggcatttcatttaaaagtaaaactttagggttttctttgacaatatattttgccttaagcagttccacacattttatagcccaaatagtgtcaaagaatcatcagtatagtcatccttctagtaattatgcagaattgcagtaaaacaattactacgatttgaagctgatgaaatactacagctgtggaaccaagaaatgatttagcattgggcttgttcacattttctatgctattttcagggctccttgatacattgacaattcaagagccatagatgactctagctacaatagtgtgaaaaagagcagttctaatatgatacaatgaagaaaaaaatgcatgggtaaataaagttttaggaatcaatatatgaaggataggagtttcataatcacagttcatgaagtatgctcttttgatttatgtattcaatctaagaaagaaaaactattgatagttctggaggaaaacaaaatgcaatttaaccaacatttgttagaatagataaaccaagtctctcaattaatctctgaactgtatgcccatgtgcacactttataaaggtgtttccatgttcctattgattgagggaacataaaacatccatgtcaccttatggaagcctcctcattcagttcagtaagctttatggcatagaattgtcataggaataccatcccagccccactcccattctaagagaatctcaacccatattatttctttaatatatcattgcatttagctctgactctgtgtgtgtgtgtatgtgtgtgtaagtatgcatgcatatgtgtgctaaatgtttctttgtgcaaagccttctctttatatctagccagctgggttaacagctcaagttagttgaatagttttgggttattcaaaataaattaagatcaatagaatataatgaagtttttcagaacaatcagttacaaattatcatagctgctattaatcattgatttatgtgcactatattaaacatgttacatatttgcagttatacaatgaaatagtgacatgcttgtaacatgtttaatatagtgttaataatagctctgtgccactgacttatattatctccatgacagagattttaaaaaattagccttaggaaatttaaactacctgcctacatttatagtctcaagtttctctgaccttaaactaaaagtaataacttgccatgaacatgggtcactgagcagatctaaataatagtttttaaaattctccaaaccaaaaaaaaaaggcacagaatcccaaaagaactgaaaacatatatttataatgtaaatataattttgtatatttatacatatttgtaatataaatattttcaatgcttcagatatttacatgatttatacaaataattaaagtcaatatattttttaactatacccctcattgatacaagcaatttaaatgtacaacagaatgtaattttgtataaagttctgcgcaatattttcatgttttatggcagttgcgatagactacaatggcttaaagaaagaatatttcccttaagccagcctgatcacctgacccatgccttatagaatcaacccttattacaataaaatacaaagaaggaagcacttcctactttattatggaagaggtaaaaccatccaagtaaaaaagtaattattctctgtacgttttttgcatgtgattttaaaatgcaatatttaagcagaaggcaaggctttaattcttgaccttttagtaaaaaattgtgcaaccctgggaaaactatgtaactcctcaaaatgttaggatacccattacaaattggaaacaaacaaacttggcctatttagcttacaccataaatttgaacatataaagaaaatattgtctactaaaacactttatagcctataacttcctgctatgaaggagcttacagtctcttcagaggataagcaatcaaataattacacaaataaaggcaaaattataattgtggtaagtgctacatgatcacatgaagaatgatttggtcaaaccactgaagtcaagaaaagcttccttgagtaaatgttattgaatatgtgtattagttttctaggcctgtactaaaaaattatcacaaactggtggcttaacacaacagttaattcattgttgaagagttctggaggctagaaagctgaaatcaagttgttagaagggccatgctctttctgaaacctctagaatccttccttgtctcttccagcatctggtgtttgcacagacaccagagtatgtgattgtgctacctcctggggtttgtctgcccacagcaaggccgggaacccagaaaagaaaagaggagtgcccagtgtagccaccacccactgcatgagaaacagagctggcagcaatccttgatgctccttagcttgtagctacatcactccagcctctgtctgcattatcatatggtcctctcctctgatcgtgtgtgtcttctcttcttataaggacatcagttgtactggattaggattcttcctaattcggtaggactcatcttaacaattacatccaaaaagacactacccaaataaggtcagagtcacaggcacatagggttagggcttcagtatgacttttgatgggacacagttcaactgatagtaagatttattcaaaagaatgcataggatccaactgggcaaagagaattgataagaacattccataaatgcatagcaaatagtgtaaatgcccttgtataaaaagaaatatgttacatagactaaaaaaccaaagtggttagagtgtcgctggcaaagtgggacatggtgtgaaatgaggacagaacagtaggaagaggctatgtgttaaagagaatcactggatatgttaagattttttttttaaatggaactctattgaactgttttatgtgaaggacaggagatgagggatgaggataaggaaggaaaacgtatgatatgcacagattattttttcctaaagatcactttggctgcagtgagggagaatggtttgcttgaagacaagtgtgaagggttgttatggtattttcatggaccaagtcagatgtaagtgttacttacttacagcatgaagacaatagtgaatatgcaaatgaatggtcagctttgagaggagtttaagaattaaattaaagggcttgttgatgaaggaatatgtaatatgagggaaagggagttgatgaatcccagctttctggcttatgtaattgcaggtacagtgatttctttttctcaaatagaaatactggaagagaatcagattttggatgtggagcacatatgaattagattccagtttagggtaataattctcaactatagaaattattagcattattgagaaactttaaaaaatattctgatgtccatatccctttatgtcttcattggtctaggtggggcgcaggcattatttctttctttcttccttccctgatggatttaaaaaggtgtaacaaaagaaaatatcagtctaccattgatgagcatttaggttggttccatatctttgctattgtgaacagtgctgcaacgaatatacatgtgcatgcgtctttatgatagaatgactcagattcctttgggtatatacgcaggaatggaattgctgggtataatggtagttctgttttttttggtctttgaggaattgtcacactgttttctgtaatggttgaagtaatttacactcccaacatcagcctattaagcattcctttttctctgcaacctcactagcactgttgtttcttgactttttaataacagacattctgactgatgtgagatggtatctttcattgtggttttgattgacattgctctgatgatcagcgatcatatgcttgttggccacatgtatgtcttcttttgaaaagggtctatttatgtcctttgcccactttttaatagggttgtttttttcttgtagatttgttgaagtttgttatagaggccagctatcagacctttgccagatgtatagtttgcaaaacttttctctcactctataggttatctgttcactctgttgatagttcgttttgctgtgcagaagctctttaatttaatttgatcccatttgtcattgcttttggcatctctgtcgtgaaatctttgcctgttcctatttcctatgtccagaatgctattgcctagattgtctttcaggcttttagttttgggttttacgtttaagtctttattccaacttgagttgatttttatatatggtataaggaaggggtccagtttcaatcttctgcatatggctagccagttatcccaacatttattgaatagggagtcctttccccattgcttgtttttgtcagctttctcaaagatcagatggtggtaggtgtgatggccttatttctgggctctctattctttttcttcggtctatgtgtctgtttttgtaccagattcatgctgttttgcttactgtagccctgtagtatagtttgcagtcaagtaatgcaatgcctccacctttgttatttttgtgtaggattctctgtctatttgggctcatttttggttttatatgaatttaaaaattttttttctagttattccaagaatgtcgttgtttgtttgatagaaatagcactgaatctgtaaattgctttgggcaatatggccattttaacgatattggtccttcctattcatgagcatggaatgtcacacaaaccaatgatatctgtttgtgtcatctctgatttatttgagcagtgctttgcagttctcattgtacagatctttcccctccctggttaactgtattcctggtattttattctttttgtggcgattgtttcacctgcttctaatcaaatctatttagtagctgttattaaactgtgtagccattagtatacagtagtactccattacccttggctttgctttctgttgtttgtcacccacagtcaaccacagtctgaaaatatcaaatggaaaatttcagaagtaaacaattcataagttttaaattgggtgctgttctgtgtagtgtgatgacatgtgaggtggtcaccatacctcctgcctgggaggtgaagcatccctttgtccagcagcttctccatattgtctatgctcctagcccttcagtcacatagtagctctcttagtaatcagatcagctgttgctgtatcacagttgtaacttgtgttcaaggaaactgtatttcacttcttaatggccccaaagtgcaataatagtaatgctggcaatttggctatgccaagaagccataaagtccctcttttaagtgaaaaggtaaacactctcaacttaacaaatgaaagagaaaagatcatatgctgaaattactaagaacttcagtgtaagaatgtatcttctgtccatgaaattctgaacaatgtattgttataattattctattttgatagttattgttaatctcttactgggcctaatttataaaaattaaactttatcttgggtatgtatgtataggaaaaaacatagcatatattgggttcagtaatatccacggtttcaggcattcactgggagtcttgcaacatatcctcaatggataaagggggactactgtatgcgcaatatatgtatacgcttaaaaagagttttgtttagctagtgtgtgtaagaagattatcacaagtcacactgtagtgtttgccttttgccagtctgaatgttatcatcagtctaatattttatagcaaagatttaagttcattgaaaacttccctatggaaacacttccaatcaagacctacagcaagccatgaataaattaacatttaaacatgaaaactgatatttgaagaagaattagcaattaataatttctgctagaaaatggtggtttctcagccaatagctataaattgtataatatatgtaaaaggaaatatatacaaatatcatatgggacatatatcacatatactactaaaattgaaaattgctataaatagaagactatgttccaatgtccactgatttttttttttttaacaatctctagtcttgaaaatgccactatggtaattctgtcaaatttgtaatggttgggatttgatggtagtgcttttgaaacctgtattatctaatggaattgtcatttatattatatcattttcacctaaaagccaaatacaataagacttaaattatttttgctttttttgtggatagtcatttttgtgcccaaagggctaactgatgccttcagttatacatgaacaattcgcactaacgtcaggaagaacagtgtgcatataacctagggcagaatttggtctatggaatgtatcactcagtagtggaatggagattatgactttatttaaacatggacttgagtagttttatttttccttactgtttcccttggcatttctttctctaaagtgcaacattcaaaagtattctatgcagctgtagtgtcctggatgcataataagggcatatgttcaaggcaagtttaaatatccacataagccaaagacagagtaattaacattaaaaaaattaagacaacttttccaagaatgaaaagctttaatagattagctaattttagaattatttaacaacaactgtgaaaaattattagtatttacaaatatgtatatataaatatatgtaatgtcttatgttagacagcaatttcattctgctctctaatgattacatgacatacttctgaaaaaagtcaaacagtgtgttctagaaggacaaagaaataattggttcagttttgcttatacttagtgttcaattgttatcaacctggggtgggaggaagggaaagaaagagggaaggacagaagagagcaagaaaagaaggaaggaggagaggaaggagagatggaagtcatgtgacatagctagggatttggggcaaaattcaagacccatgttttccttgatggaaagccaaggaacctgagaaggagagtcagcccatgccaatttcactgtggtagaggtgaccaagaaagtttacattatggatgtatagtaggtaattttaggttgtttttgtctgggatataaacccattgtgttattccagttatttggccaaaatgttccatgcaaccattttggagtgctagcactttagggaatttataaaaaggggtggtgttcagtgtctgggttgaatacaaggtaggtagaaaaggacaatcaaaggaattagctgcaaatgagatgaaatctatgggaacatatattgagaaaactagtgaccattataatttaatcctctgaaatacctgcaacaatctgagaacaaggtaggtggcaagatgcatttataaatattaaagaaacacaagaccccatacactttgaaaactggggagtaccgaacttggagaggtctagtataggtagtgcttgttggtttgcatatttttaaaaccactttattgaggtctgattgacatagaaaagtctgtccatgttgcatgtatgcaacttaatgagtctaaagataaatatatgcccatgaaagtatcaccataatctgtggcataaacatatccacctatttgtttatttttaattaaactttttcctgagataattgtaggttcacaggcacttgtgagaaataatacagaagtcccatgtaccctttactcatttgttctcatcagtaacatcttttataactatggtacaatattacgaccaggatatggacattaatataaccaatattattcacatttcccatttttcatatattcctatgtgtatatgtttagatccatatgattttattaaaattttatccaccacagccgagttgcagaaaagttccatccctacaaggacacctcaagctgcctttttataaccatgcccactgtctcccttcccctactgctgccacaggtgtccctaacttctggcaaccactcacttgtactctatttctaaaatttggtcttttcaaaatgttgtatacatgacatcacacaatatgtactcttttgggattgtttctttcttttttactcaacataattccgtggggattcattcaagttgttaagggcattgatagtccaccttattgcagcatagcattccacggtatgtgggtaccatggtttgtttaacccttcacccattgaaggacatctaggttaattctagttttgggttgtatcaaacacagttaaagcattcgtgtggatgtttttgttaacatacatattcgtttctctggaataaatgctcaagagtgcaatagcgtatggcagttgcatgtgtgtgttttaagaaactcatttccagagtggctgttccattttagaatcccaccagtgatgtatgagtgctccagattgtgcacatcctttgtagcatttaaaataaaggctacatttattttactatttaaaataacattttagccattctgatagataatatatcactgtggttttattttgcatttctttaatgactaatggtgttcagcatattttcatgtgcttatttaccattcatatgtccaattcggtgatgtctccccatgtcttctgcccattttctaatttgattgcttatttgtagcttgctgtttttattctttttacagggttttgctgagattgattaggtccaatttatcaatctttcctcttatgtattgtgttttccatgtcaagtctatgaagtcttgcctaaccctaaatcctgagtattttttctaaaagattttttttattttatattgttaaatttaagtatgtgtttcaggccaggcatggtggctcatgcctgtaatccccacacgtcaggatgctgaggtgggtgaattgcttgagcccaggacttcgagaccagcctgggcaccttgtctttacgaaaaattggctgggcatggtgctgtgtgtctgtagttccacctatgggggaggctgaggtgggagaatcagttgagctctggagtttgagaccagcctgggcaccttttctttacaaaacattggctgggcatggtgctgtgtgtctgtagttccacctatgggggaggctgaggtgggagaatcagttgagctctggagtttgagaccagcctgggcaacttggtgaaacctcgtctctactaaaaatacaaaaacaattagccaggcatagtggagtgcacctgtagtcccaactgctcaggagctgaggaaggaagatcacctgacctcaggaagttgaggctgctgtgagcagagatcatgccactgcactccagcctgggcaacagagtgagaccctgtcttaaaaaaaaaaaaaaaaaaaaagcctatgtttcactttgagttaatatttttttaaggtgtgagatttggttttgagcagtggatgtccaaatagcccttagttgaaaaggctatatccttccttcactgaattgctttggcacatttgtcaaaaattagtagaagatatttatgttgatttatttcagaattctatgtatatccttccaccaataccacatgttcttgagtactgtgagctataatatctagtagagcgactccttctactttatcctgctatttcaattacaaaaaataataaaccttttagggcctatgattttccatataaatttcacaataagcttgttgatgttttcaaaatatcttgtttagattttgataggaattgcattatatctatagatggatttggagtgatttgaaatcttttactatattgagtcctctaatatataaacatggtgtaagtatcaccatttaggtcctcttttattggcattttgtaatttttagcacatacattgtattagtctgttctcaccctgctataaagatactaccagagactgggtaatttataaagaaaagaggtttaattgactcggtttcacatggctggggaggcctcaggaaacttacaatcatggtggaaggtgaagggaaagcaaggaccttcctcacgtggcgtcaggagagagaagagtgaggtgtgaaggggaaagatccccttattaagccatcagatctcgtgagaactcactcactatcatgagaacagcatgtgggaaactgcccccatgatctaatcacctcccgccaggtgcctccctagacacgtggggattatggggattatacagttcaagatgatatttgggtggagacacagccaaactatatcatacatcctgcacctgttttgttgagcttacccataaagtgtttcattttctttttggtgattgtaattggttttgtgttttaaattttggcttctgcatgattattgttggtatatagcaatgttatgaattttctagggtgatcttgtatttcaaaactttgctgaactcacatttatagtagttctggaaattctttatttgttggaattttctacatagacaatcatgacatctgaatttggagcagtttttttaatctttccaatatgtagtttttatttctttttccttactgcagtgactagaatttttagtagtatgttgaataagaaaggtaagagcagagattcttgctcttcttgttcctaatctgaggaagaaaaagagttcaactttcaccattaagtatgatgttagctgtagattgtttgggtaagtgttctttatcaagttaatgaagttcctctctattcctaatttcttggagttttgagtattaaatattgtcacaaggcattttctgattcaattgatatgattatatgatttttcttctttagtctattaatgtggttgattacactgattgattttcaattgttgaaccaaccttacatacctgaaataaatcctacttggtcatagtatacaattatagtatatgtagtatacaattccttttatatagtgctgaattgatttgctcttctttctctagtttcttgaggtagaaacttaatgttttaagatccttcctcttttctcatataagtattagatttagcttagtgttgtaatttaatgtgtaatttaatttagtatttaatttagtttagtgcaataaatttccccttccacgctgctttagcagcatctgacatattttattatgttgtatgtttgactcttgaacaaaatgagggcttggggtattgactcccgatggagttaaaaatttgcatttaacttttgaccaccccaaaatgtaactactaatagcctactgttgaatggaagccttaccaataagataaatggtccattaacacatattttgcatgttatatgttttacgtgctgtattcttataattaaatagagaaagaaaacattgttaagataattataaggaagataaatatatatttactattcattaagtgggagtggatcattatataagtcttcatgctcattattttcacattgagtaggctgaggaggaggagaaagaagggttggccttgttgtctcaggtggcaaaggcagaagaaaatttgtatataagtgaatctgtgtagttcaaacctgtgttgttcaaaggtcagctatattttcatgtgcattcagttctatgtttttgaaatttcctttgaggttttcaaaattttcttttacaactttctttttgactcatgggttatatagagatgtattgtttagtttcaaataaattggagattttaaatattataattctgttattgatttcaaatttgaatcattttcaatcagagaacacattcagtgtgaattcagttctttaacatttgttcaggattttttaacaggccagaatgtagtctatcttggtgaaagtttcacaagtatttgaaattaatgtgtatagtttgttttgtgtttacacacgcacacaaacacagatgcatacacatataaatcttctgttatctttttatttctatttaaagaacttcttttagtcattatttaagagtaggtgtgaagaaaaccaattctcttataaatagaactaagtacatctactttgtatacttttcttgagtgattctatattgtaatgatgtcctttttactagttctatcaattgctgagagtttgctgttgacgtccctgatttaattgtgggcttatctatttctcctttcagctgtatcagtcttgcttcatgcatgttaaagttctgttgttaggtgcatacatgtttaggatcattaggtctttctagtggagatatcattttatcattatgtaatgtccctcttaacctctagatatttggtttgttctgaaatctatgctatttgatagttactagttattccttttttcttttgattaatgtttgcagatatatttttctgattactaatttcaactgacctgtgttgatgtccatgaagtgaatgttgtacagatagcatattttttggatacttttttaaaaattaagtttatattctaatacactctgctaatctctgtcatttatttgtatatttagaccatttacatctgagattcttactgatatgctagccttatgtgtgcaattttattttttctatttcttgtctgttgtgggtctctgcatttctcttttctgaccttgctgtaggttacgtgaacacattttaggattctatcttggtgttttaacagcattttgggtatatcttttttgtatagtgtttttagtggctctaggtattaaagtatatgtaagtcacttatctactgacatggacatattactacttccattaaagtgtacttttatttccacttaggtcctttactcattctaccttttcagtataattgtcttaagtgtttcccctacatacagtgagcatcacattacactgagttgtaatttttgcttcaaccgtgaaatattatctagcaaactaataagagggaaagtctaacttatttccccctaattttattcattctgatattcttattttctttataagttctgaagcttttattatcattttgtttctatttaaagaacttcctttagtcatcctttaagaatgggtttgatgaaaacaaatactcttatttttcactcatctgagagtgtcttgatttttccttcattccgaaaggatatttttgctggatataaaatttatgattgacagttaattgctttcattacttgataaatgttgtgccactccttctggcttctaatttttcagatgagaaatctgttgtcatttgaactggtatttacttataagttttacatcattcctctggctgctttcaaggttttctctttgcttgttttgtatttagcagtttaatagtgaaagccctagcatgagtttccttggttttatcctattgtatgagatttgctcagcttcttgcatgtgtttgttaatgtcttttgccatattttcagtattttcagacattctttcttgaatacattttcactgccattctctcctcttattctaggattccagttatacaaatgttaactcttttgtttttaactcactggttcttgaagctctcttcaagtttttttttttccttttaatctctcttttcttatttgttcaaattaggtaaattcttttgatttccttcaggttcaggaatcctgtcatcttcctgttacccttgaacccatatagcaagtttgagtttgtttcaatggttgtatgtttcagttatttagtttccgtttggatcttttatatatatatatatataacttctatttctatgctggggtttctctcattttttttcttgcttgaaagaattcacaattgcttgttgatgcatttttattgtatctggtttaaaatccttgcctgataattccaacatatgattcatatcactgatggcatctgttgatcttcttctttcattcaagttgttattttgatggttcttagtatgacaagtgatttttattatatcctggatgttttgggtatcgtagtatgagactctggatccaaattcatcttcttttttattcagaagctgtccttacattgaggtgtgcacagaggccaggtgggtgtgtatgttcattcatcaccccgttgtcactgccaacatcatccagcagaagtggagcactgactcacactgcagcagatgggtagggtgaaacttcagcttccctgttgaccccttcccagtgaaagcgggccgcctattgctgctgccttgttgcccctcatggtgacatattcctaactccccactgagccacggaagggaaaaattcattgcttgttcacactactttgttgctgcagggtaggggtggaagctgagcttcctgctggtctctgtgacaccaggggaggtggggaatggagtgtcaagtaaccctcctcctatcaccttattctgcctcattgatgccaggtgtgagagaaggttctgcttctctccagaactctcccagttcttgtgaactgggtccaattcacaagaaagggaaaaaggatgtagagtattgattggccctaacacctagcacacagtctcactaataccactgggagtaggggctcagctcccctctaggccctgctcacttagtgagggtggggtgggaacagaatggagactaaccctgacacacaccacctcatgtggtcttgtgctgtgaagagagtggagaggttcattccctccttggtcccactgacaccagaggttggagtaaagtaaagtgctgatgagccctgactctcgtgtccttgtttagtcttgttaatattgggtggatgttgagcttcagctcctgactggggccctgccagagccggggggaatgtaatgtgctgactagtcctgccttgcaccacttcactaagtcttgctgctaccaggtaggggtggtggagatggtttagctacttgctgggctgaggtgacactaacttagtaaagagttggagcatggctgactcctttcagacaggggatgaaagatcagccctctgctcactctgccaatactatttagaaaagagaatcagagtggcacaacttccactgagcagaggacagaaaataagctccttatttggtctcatcaaaaccacccctacctacagttagacagctgcctgtttcaacaagtggagaatggaagatcagctctctgtttggtttattggaaccaccaggcaaggggaattggaacactgactgcttctgccagtgggaatagaaggttagctgcctcttggccctgtcaacaccactgtgaaagggaatcaaaaactactgcttacttctgttgggtgagagggtggggtgaaagattagctccctgatgagctcggctgctggaactatgaatgtgtgtgagtgtgtgtggggagagagtgtgtgtgtgtttgtgtgtatgggtgtgcttgtgtgtgtgtgtttggtttttccattggagtttggctaaagtatgacaggtactttttgctaaaaaggttttctcttgtaggccaacattttcctgatcttctgtctaggaaaataagcctttccttggagcttattttgtctttgcctgttggtggttctacgttagatgtttctggatattaaaacaacaacgaaaactagggaatttgccatgttgttcctcaagtcctcagattcctaattttttttcttctacctacttcgcaaagtcatcttacacttatttgttttgttatgttcagggctttttaattatagaaagagaactgggaggaataaggctgctccatctctgtcaggatcagaagtcatgtagtgttataaaaaggactttgtctaccattttaaaatagctgttggctgtaagctccttattgtatttaaagtatattggctaaaattgtgggaggtaaggaaaactctttgtaaagtgaactgacatggtgaaaagagagagaagatatgcttgtcaaatattgcgaagtctattcagatcaagctagacatggtctgtattagtcagggttctccagaagaaaagaaccaataggaggtgcatgtctgtgtgtgtatgaaaaggaatgtattagggagaatttgctcacatcattataaaggcaatgtcccacgacaggctgtcagcaagctatagaatgatagaagccactagtatgtctcccaaggaaggtgatactatgtctcagtccaagtcccaaagcttcaaaaccagggaagctgacagtgcatcccatagtctaaggctgaaagcctgagaacccccagatcccccagagaccactgctgcaagtttcagggtccaaaggctaaagaacctagagtctgatgtctaaaggcaggaggaagaaagggcattctgcagtggaagagaaagagagaggcagctcacaaagcaagaaaagcctgcaagctgaatatcccccttcttctgtctgctttactgtagacacacctgcagctgattggatggtacccacctacattgagggtaggtctttctctcagtccactggcttatatgtcaatctcctctggaaacaccgcaatagatacatcaagaaacagtgctttaccagccgtctaggtatccctcaatccagtcaaattaatattaaccatcacatggcctattcacaatttaaaaatgtagcataaattgcagcagtggtcaagtgtattggcaagttgtaaagtgcctataagaaacctatacacgagcatttgcagattcccttaacacttttcagcaaatattttgttacaattgaaattaaaaggcagtttgaaattgttcctctactaaatatcacactggatatgaataaaataactagatagactaacaaggtacatactttattgcctgtgattattgcaactaccactcctggtggagagccattcttctcaggtgtgcaagtggaagattaattctcaatcaggaatatagatttgatacaaggaaagcatttcacttggcattagtgtgtcaacatttcagctaatttgcctaaccacaaatacttcagggggaagagaaattgctagtgctttatattaaacattggatggagctggcggagataatacaatttgtactttttttacatagtttcaacgaattttggcagatatgtctttttgaggcaactttagatgttgaaaagctgcttgtggatattcaagacttgtctttttttcatgttacaatgaccatcaccatagtttgtatctgattttttttgtgtgaattgaggaatgtggagtcataatgcaaaagtcattgccataattctttgcagatcttatgactggaaattcttgtgtatgtagtttgatattcatttgtaacacatgtaactggttcgtgtaatgattaaaataataagtaatgcttgatcatggttaaaataaataccaaggataaattcttctattaattagtgtaagcttatcctaattaacatctttaattatgggctgttgttaatttttgtcgcaacctattagatatactgtcctaaatcattaacactagtgtaactgagcataaactctaggtgactcacggctacagtggaagcgcccatggaaaatatatatttctaagtacacagtttagataatttcaagcagaatcagaaaattcttgatgaattctaaatttagtataaacagaaatgtattaggtttggttattgagccaagcttcaaacattgaatatcagaattgtgtccatttgcaatgagtaagcatttgattcaagatttttttttgtactcagactcatttttgtatatctttctgtttaagtcatattgtatttactgcgattacagattttttacatatttcttaaactggttctatgttatgccattatataacaggtgataaggaatgtactgtcactgccccttgacaatgaaaaggggacatctctactagtgtatgtgtatgtagctgtggaggagttgaaacagtgtaagtgaaatgcctagaaattgtcctgagttttgattttgtttgtgcttacatttttattagtatatgtactttcttgaatagataattgatttggggcaatatttctcaatcttggcactactgacattttggactggataattattggttgtgcctggctttcctgtgcattgtaggatgttcagaagaatctctggtctctacccactagatgccagtagcaaacctgccacctctctgcctacttccgtcctgtcttgcaatagtcaaaaatgtctgcagacattgccaagtgtcccctaaggggcatgagccttggtggagagaaacttctttacagtctcatccttggcgatgtcatttccttataatttgcgtagttaaacatttttgttttgaggagcataagttgtgataccatacctgtacagaagaggcttggatttaaggttaaccacatttaactgagagaattttatcaaagcatgaaataagaaaaataggggcaaaaaatgaaattctaaaatggcttatgcaatttctaagggtagctaataagaattctgaattggtgacattgtttttaaaaaaagtaaagcattaaaagaatttcaaagataaaatatattttttggagtgtgaacactgtaattaaggagacccaataatgttaagttacttaaaggatgtatttttacttaaagtaggatacaagttggagaaattaacattcggttgattgttaaatattttgattcaaagaaagaacatagaattgtcagcctcaaaaaatatgcttaagatagaaaaataattttggttgcatgaaaagaaaaagattttagtaaattgttgacttgaaaaggggaactatttgacagaagtctcaacagtgttttggagtggcatagtgattggggggtgacatcagatgattagagttaaaaacgactggaccggctgggcgcggtggctcacgcctgtaatcccagcactttgggaggccgaggcggctggatcacaaggtcaggagagcgagaccatcctggctaacacggtgaaaacccgtctctactaaaaatacaaaaaattagccgggcgtggtggcgggcgcctgtagtcccagctacttgggaggctgaggcaggagaatggcgtgaacccgggaggcggagcttgcagtgagcggagatcgcgccactgcactccagcctgggcgacagagcgagactctgtctcaaaaaaaaaaaaaaaagactggaccagttattaggccttaagttgatgtaaactatatgacaaattgacaatttagagacattgtggggacatttctatgaaacgtctgtttattattcattcctgtgatgattttgaaagggcaaataaaatcataatcacatattgtataatgctttttgtctttcaaatacatatacattaaaaatgacttatataaagcaaaatgtacctttttgtgcacaattctattggtttttgtggatgtatactgttgcataaccaccatccaaccaatacacagaagagttctataacttcagaatattcctttgtgctactcttttatagtcattcccatcttcccacccccaccctctattgacccgtaaactgttttctgaataaatatctgggaaaaggattgctgcgccacatggtaggtgtatgtttaaagtttctcagaagttgacagactttttccacggtggctgtaccattttgccttctcaccagcaaaatgtcagattacagttgttttgcatcctggccagcacttggtatggccacttcatttatttatttagctcttcttctgataggtgtttagtggtatctcattatggttttaatttacacttctctaatgattgatgattttccccggtgactgatgatgattgaggatcttttcaggtgcttatttgcctcccatgtgtgtatcctctttagtgaaatgtttgttcaaatcttcccatttcaaaaaatgttggcccttttcttattatgaaatttctatggctctttatgtcttgtgcatagaagtcctctgtcaaacagatgtctgttttgcaaatattttcctgatttgtagcttgtcttctcaatattttaacagtgtcatttatagatcagaagtttccaattcttcaggtctggctcccctccataatctgtttgctttgattcacttttcagcatcctcatgtagttgctttttgtgtttggtctgagattttacttgtgattggcagggagagataggctgaacgtgactgagtggagtatagcatgagaagacttgcataatattttttttaattttcagtgttttgcaaacattatttttgatccattaataatgttaatgattgccattttatatacgagaaaataaaaaaatcaagagtcataagagtttaagttcataaataataaaaagccacatggaaataaccagtgatctaaatcacctggaacaactaaaaccttaaggtattatatcctagtttgtgtgttctgaccacaagcccctagaatgcaaattacttatgtaccttatttaattatgtttgctttacgtaattttagtactttaggaacttccttgattaaatttcaattcatacatttgctgaaaaataactaattttaaaactaagtaaggttattaagtaacttttttccatctggaggagaattgtttttgttccagattctttactgacacaatagtagcacactcgaataagtgcatagtatgcttcatggaagatcatgtgtaaaagccaggcttagtcaatgtttcttctgataatacatgtgaaaagttgaaaagaacctttatggtcattttcctagtaagcaagtcaattccttttgcttaaagcattttaacttcattaacgtaaaagacaatagatatctactatgtatacaacactttttaagagatcttgaggttacagaagatagtaaagccatggtgtctatccttaagaagctatacataataagaaagaaagaaatctcactgtgatattgagtatacatttttggaaagtaatttttgaataaaatcagatgttttaaaaaatcgtaaaaggttttgaatcaacattttcaaatatttagaaaataaatgagaaaaaagacagacccaaccaattccttccagtaattttgctctgatattaatgtaattcccttcagcttttatgtgcatattatatatgttattaaccatagtacatctttaaaacatatataattttgtctgctcacttttttttaaaaaaacagcattgtatcacagtttattttcatgtaccttcatagttcaaggtacaagggaagtaacagagattccctgagagaagacaatggatgttcctaagaaagacctagtgtgagagttcagggaactgctacactttggattttttttttttttttttttttttttgagacggagtcttgctctgtcatccaggctggagtgcagtggcacgatctcagctcactgcaagctctgcctcttggggtcatgccattctcctgcctcagcctcccgggactacaggcgcctgccaccatgcccggctaatttgttttgtatttttagtagagacagggtttcaccgtgttagtcaggatggtcgggatttcctgaccttgtgatccgcctgcctcagcttcccaaagtgctgggattacaggtgtgagccaccacacctggccaggattggttttttaaaataatgtagaatgttttgtatttgtccttgcatcatgtaaagatttatccttaaaagtgcaatttgtctttggactataaactctgcgagggacaggacagtacttacatagcatgttaaaaattcaagtatcaatctacccatttaggtctattggctctttactgagtccagggttttatttacatgtatcactgaatgaatggccttaagaaggtacagatgagactactgaggcatagagagatttaacagaggcaagcagagcatcacaagcagtttggaactcaacacatgtttcttgtttgaaaatatgcacagacaaaagagggatggatagaaagttggttcaatataggattaagacctggaacaaaagcacatgggcaccagcagaatctacttgagaggtcacagcgcccaaggggaaacaaccctaggcaagtcacttaacctcactcaccttagttctcttgttggtaaaatgcagagtttatgcaaactcaatacatgtcaagaaatatctgcaaggcattgtttaaaattgaccctctggatttttttcatgcatgcctggttattatttattaagatgtactaggggcaagtctcaaatggaagaaaaaataaaaggcacatctgcaaagtgaagaagtggggttaagcgcaatgcaacagaaactcttatactaatccaggaggactttacctgtcaatcaaatctatattcattttttttaaagattaataatggtttgttaactgagtaagctggcagatggtaaagtaatgtgatgagatcttggggcatctatgaccagttgatgactgactgaccaatttcaaaagatgctatgaaggatcataaagtttagttccatgtggattttgatgatagttgcatctatatttaaagccttctgtcactggaagcactcttggtgttgtcagactgtctattggactggatgagctgcaacttctcgcaattgaatgtcaataagaccaaagcaattttggttgattcatagcaccagcttaagcatattcacttgcacagattacatttgacagatagttaccttcagctgaactctgtggttagaggcttgggcgtattcttgacagtgagcttagagttgatgtctaatgtttatttcatatcctgtttttaccttccctaatattgcatgtgtaaatctatatttaaatatattcacagctgatgttcttgtcggtccacttgttatctctggacagaatgctgtaatgattcaatttaattattttaataaaaataacttgcacccctccagttttaatttcaataaatctgacgagtaatgattaattttaaggagtcttattgatgagcaattgcaacactataatgcaggaaaatgcccaagtggtgggagcatgcttacatctatagtaaacttaaaaccttcaaaatttggtgtgtgattatgaacaccgaggaaatatatccacatttatttaccaaattattattcctgtatcttttttaagttatttaggtccatcagttatcttcaaagtttaggtttgaaactatccatttcaagaatattagccttttaagatgattataatttaaataacatattctaaaatgttttaattgaacagtagaatgcatgtaacccaaaacattataaaatttaaaaagtcacggccatttttgaatatttagattgggaaaacacttaagatgtggttttatgttcaagaagaggtgcaattatggtatggattcattcatcattatggtattgtattgtcaacttttcagttatgttcaatttttaagatgctgggtgggaaatttaagggacatatagatctaataatctgagcctaaatctcctgctctatacaaataactctgcaaagctttggaatccctttatttgactaggtgaatggcagttttgtttgcatcagcctaaacctagcttggaaatcatgattttaaagcaaacacgttttcctcacacatttccatatttcctagaatctatcgttttaagatatcaaacaattcaaattatgtagttatacatttcacacaggacaaaaactcatgctgaagtaggtaaaatatttttcaaaattattttctctacatttactggcatactttctctttcttactgtcttaaaactgacagtcagttttttttatttttctcttttactgacagctagtaaatgtactgacagttcagaagcaagatgtaaatgtaagtcactattattttgttcacctgatacctgagcattagtagaaatgcatggctatattttaaaataaaaactagattatttccaatggttctgaagggaagatgtatagaaaaactgtcctctgtaaataaaaatgtgtttgaggcaagattgcattacatttagaaatagcatactttcctcattaggatgtgattggtatttgtactgaagaaaatgggctaattatttaagtaagatgtatatttactttctgtttcattagctgtaaatctttatagcatataaatctcctttagaaattaatgggaagtatataagtgagggaaagaaagcaggttatgaagttaataaataccatgttaaaaattagtttctacttaaatataaagttcaagattaaaaattaaaaattgttttattttaattagaaaaatcttgcttagttaatttctctggaagaaatgctatataagcagttaaatgtggagaattatattctattgataaaagtatgttgggccagactgaaccaacaacatcatagaaggactgattccttacttcctttaaaaagtgatctgtcatttgtctacattataaataacagctgagttttaaaacacaaggagatttttaaaaagtggcagcatttatttatttactgcttagacagtattcacagtattttatttcatccttaagactctttttttgttttgctcccacattattgttacacatatgggaattggtaaagtgggaaaacttagcatttatagatttttatactgaagcatgcgatgataaagtagtcactttcatccaagaaccttttcctcttttcacttacactagctcttccagaaatggcccctttagtgcctttaatggttttattctccttctgtcactatttttaatattcttattcttatactgccatcatatataactttgtgaaaatttgtcatataaggttaaaattgatttgcctttaaatacagtagtttccattttctgttaactgtttgaagaacacctattgagaggcaaggaaagacctgcgggataagttacaaaaggcaagaattcctcacagaaaaagcagcaggagcttccttgtcaagagcttcagcaagtagtgtcagcagcttagaagttgctattggactgctgagtgttatgcagataaattgtggctctagcttgtcctccgatgtcattctttgatttttctctgttaacactgcatttgcatttgggtctcactgagaacaaggaccagtgcaaatgccttatggcatgtgtagaaagctgcttttatgttaaaagtgatatgttttcttgttcactgtgttcacaacaaaaattcatcttccgagtcttggaattcccttatgtatttgtaattttccttccaagtcataatattcatatacaaagagtggaaatttttctttaaaaaaacctaccaaacaacaaaaacagtaaagttagttggttactagcagcaacaactgaaaagcagcatcaccaaaacatatgtaattcatgggtttccagcaaaagaggaaatctggaaagagaagatccttaagtattgctttaaagtgagcactgaaggacagccgttaaaacaatcccaatttttagaaaaggtattattccctgacatttacttgttttattcccttctcaatctgaagacacattttggacagatgctcttgtcttacatgaacattcaattcatttgagaaaataatggttatacttaaactcgtgaagtgaaatgtatggaagtctgttgctttataactttaaatagccatgtaacttgttcatggcagaatatagtcaagtcctgggcaaggactttttttctcttctccaataatgctattcaaggggaagctagttattgtgtgacacatgcttgattctcaggaggtttggacaaaagagagggttagaaggtcaggagagcctgacgctattcaactagatatttgagtagaattcccacaccagaattttgcctcatacctaattcagacagtgtaataatgggggaagggcagagagagggagggcagatggaggtgtcctttcaggttaaatgttaaaataagggtcttcatttctgtctctggtggcacagagcattaaaaaccctgtgacacattttggaagtgttgctataaaatagattttaacgtttgaggatctataaagggtattattgagtacttaatagattctgtgtttgcctactgaaatcactacaccgccgatatatacctcattaatttgtaaagcagtttggcccaacttgagacaatgtactgtattaaagcaaagtctatatcccaaattttcatggccaataattacaaaacgttcagcatctgaagaaaattatctaaatgtgacaatattggtcttggatagtttaacttgcgtgaaatatttcacacagaaacatttgatctatattgaagagttgtttcttttttcatcagatcagctatatcacagtaaattgtggaaatagaaaatggaaactaaattgttgaaaatgcatctgatagtttgtttttattgccaaaatgtcattgtccttgaggtccatcactttgtagcttagtaaaaacagatttaggcattgcaagtgagaagtcattgactgttttccttgtaaccaatttatttatcaagttggtaagtttcagaagtatttccagtgttcagcctatttcttcacttttctattttccaaattatatcctattacttcaaagatgtataaagttcacacattctggattctttatctcttttattgttttctgcttcatacaaagtaattaaattatgttcttgaagtaattcctcctatcttacttaaaatcaccttcatgatctgtcaagagttttcaagttgttctgtgataaagttcttagagtttgagaagctaaatggtggagttggtgcttaagctcttcactgaaagctgcaagagtataaacgaagtcagaaattactattattattatttttttctcattgagacggagtctcactctgtcgcccaggctggattgcagtggcgtgatctcagctcacggcaagctccgcctcccgggttcgctccattatcctgcctcagcctcccgagtggctgggactacaggtgcccgtcaccacgccaggctaattttttgtatttttagtagagacggggtttcactgtgttagccaggatggtctcgatctcctgaccttgtgatctgcctacctcagcctcccaaagtcccaaagtgctgagattacaggcatgagacaccacacccagcatatatatatatatatatatatatagttttttggtttttgttttttgtttgtttgtttgtttgtttgtttgtttgtttttttgagacgagtctcgctctgtcgcccaggctggagtgcagtggcaggatctcggctcactgcaagctctgcctcccgggttcatgcctcagcctcccgagtagcttggactacaggcgcccgccaccacgaccagcaaattttttgtatttttagtagagatggggtttcaccgtgttagccaggatggtctcaatctcctgaccttgtgatccgcctgccttagcctcccaaagtgctgggattacaggcatgagccactgcacccggcctgaaatgactattctttttaataacttctatttattgttttgtgttattcataattgttgtgcaatttaatttatttcactagtagaacactatgtacaggactgtactgtgtggaggttttagaagtgacaaaaccagttaactaggctcttggtccaaaggaatttagtgaaagagataagacataaacactaatgactgtaacatttatggaataataaataggagctgctgaaaattgtgatttcttctcattatgatagtgcttcttggattataaaaaatttaacctagaacatgaggtttcaagaggcagagatggggagagaagaattccaggtttgggactaggatgtagaaaggcagaaaggtgaaaatattcttgtgatgatggcaaacagtgactggtcaagtttgccaagagtaggttttatgcaagagcgtagtaagatgaaaccctgaaggaattttactgtcagatgatagaaaccggaataaagctgaggatacagttcaataatcaaagggaaccaaatgaaagttttgagcaaagaagggatcttattaaaacagccttttattatttcttttaagctagaggtagcttggcattatctgtgccagctcagagtgaccttcaccccaaaattctagttggattatggagcagttaatcttacaggctctaataattctgtcaccctttgttgtcattctatatctgtgtcccttcagttatgtgtcttctcccatattctcataccattatttctctgtctttcatttctttactttcatcatccacatcaggacaatgtttttattctatagtagtttgtaaacatgtcacattctttagactttcaagctctttgtcaacagtttttcaaagtccttgccttacataaacactaattctttccctttagggacccctttcctggcccttccaagcaaagggtgctcattcatccactcctcatgcacctcattgctgggagcaagtagagatgtagggattgctttcttctttttcttttacctcatattggaaagagatgtttcctttaaagctcatgttaagttgttgtgtacctttcttcaatttttgcatcaatttttgcaaaccttgcatcaatttttgcagctgctgacaccttggataccccagccacctgcctgccagatacaatgaaaaatttcacctctgactcacagtgtttctctgcatcattatcagcttttggttaatgaccatgaagcttcactttttcacctcttgaaaacttttggctacagaatgaagttaagcgcctaggtgcttatattgtctttgagtctgttgggttccttctaggttcagtttcttcacttctagcctagcccacaaggaaaatatctttagtagtcttttaaccattttcttttatttcattttttttcattctgttgccaccagacacctattctcaaatcattcacctgactgccttcttaattcctgtgtatagattgcagaatattactgaaaaaaaacaggtgtgtggattgaggccactaaaaattaatgatttccaactagagatggacccttagtgcagccttagggtaaatttcagaggtgcagctgattcaaagggtgtgcacaatttcaggggtatattgacctactgtcttcagaaaatgtttgactagtgcagactcctaccgaaagagaatcagagtgcctattcctcaaattattgttaatataaggaattatcttttctcatttttttctaattttatgggcaaaatagtatgagtgtattcttatttcatttagcatttcttcccctacctcgtacttatcttaccttacataggcttattagccagccacatgtattttttgcttctgggtaatagctgtgtattgttctcttatttttttaaataaaggggtctgcatttttattaatgactaagaaatcttgatatatttagaaattatatgtaaaaataattttaaattttttttattctactttaagttctggggtacacatgcagaacttgcaggtttatgtcatagttataaaaaaagaaagaaagcataggcagagaaggaaaatcactctggacagaaaaaaataattggttaaaatattaaagaataaaatttgtaggtaaaaataataaattttaaaatgacagtttaaaaatttatatgtaggctgggtgtggtgccccatgccgatagtcccagcactttgggaggcctacgcaggaggatcacttgagtccaggatttcaaggccaggttgggcaacatagcaagacgtcatctctacaaaaaaaaaaaaaaagaaagaaagaaagaaagaaaaaaaattagccaggcatggtggtgcatgcctgtagtcccagctactcagaaggctaagatgggaagatcttctgagcctgggaggtcaaggctgtgagccatggtcgtgccactgcactccagcctaggcaacagagccagatcctcttgcaaaacaaacaaacaaacaaattacatgtgaaaagaattatacgtgaagataataatttcagacatacaatcctatgttaactcccatagaaaattaagggagttatcacacctttgcttttaacaattctttctcttcccacattccagttttgttgaaataagcagagcttcttatcccagcttattgtagcaaaatcattatagtaaaatgatatttttatttcaagcattacaatagcactttataacttatttaaaaatttatatgatgttaaaaggattcaatactcattgagtatcctttcataacatacatctctaatttcttaatttgaattgagctttctatttggtgagagtatttctattctgaaaaggaacatggccagtgatgtaccttctgaatctttgcgtagttgagcctgtctttctaatgcctgtacccatgaacaatgtctggatgatgatggatttttttttcttataccctttcgtttgtgagcttttaatacattgcatcgtgtttctgaagagaaatctgagacaagcttaaggattatttttcactgtgggtgacccgtttttgtgtgcctgagtgagattcttacaggtttctttctttatccttaaaatcccaggactaccagcctatagtttggtgttaattaatctttgttttcttgagaatatggtaagcttttcttagctgaatattcaggtcatatttttaatcccttaattttggtttctatcatgtctttgagtttatattttcattatttgttttcttcgggctttcatcctgtgaaatttagtgaccaatatagttttattccttttatgtccaagatacataagaagttgtatgtactctagtgtccattcgttcatcaacttattccaattaccccaaacccctatttccaagggcttttcttcttccgttcagactctttatttgggtcttttcgtggttccttgcttaacactatgcacttttcacggcacacactttccctgggaattcttactcacaaccatgactcctagtactattttcatatgcatagttataaaacctgtaatttctaaatttatattgccacagtgctatcagtgagctttcaaaattcaaattcaagtatgatttttcttagttttaagatttcttcagttggaatggagacccttaatgacttagctctgacaactgttcagcctcatgttctgtaaggtctcctctgggacctcacattctagtaacactgagctgtctagtctttaattgtatccatctttcttatgttgctacaactgcacatgttctttaccaagaatactctcccttactatttattccgcttaatcctactttttcctttcactcatttggcatcaacattttcaggaagccttttcttatctcaaaatctgagtagacatgcactcatcctttctatgaaattatcgcaatttactcaatgtgctttatttgtgtccatcactagactccagaacttttagatcaagaattttaccttatttagtgttgttcccttcagggctcggcatcatgtttgaatgtgatccattctcaataaacaaagtttgattgaatgagtgatggcatcatccagtattagaacaaagttgataggacagtttgtttagaagctcttgcaagaatacagttgacccatgaactacaaggaattgaattgcccaggtctgcttttatgtgaattttttcgagctaaacacagattgaaaatacagtacttgcaggatgtaaaatccgactatgcacagggccgactttttgtatccctgggctccgcaaggctaactgcgagacttgggtatgattagattttggttatttatgcctggatcctggaaccaatcccttgaagactgtacagatgagagatattagttgatcgaatatgtagcaggagaaaactgaaaaaggaaaagaaatttatgaagtaaattaatgagaccgctgcatttcattactactttggagattagaggaacaataaaggtgactttaaaattttgaaccaacttctttataacatggcttacaagtggtagctagaaagaggagggttggttacttttgctttgtatattgcaatacatttctgattgttccctttccacttttccccctagtattgttgattactttgtctttgtaaaaaacttcatcgtgaaaatttctttctaaaatgtaaatgtgattacctccttcctctccttaaataaacactatgctcacgattgctcacactccagagaatgaaatttccttcccttagcaacatgttcaagatccttcaaaatttgttagatggtgcctctatagcttcattgtccttctatgtactttgagttttaaccatgatatttttttgcctcccaaaatcatgtactttgtggttttcatgcaagctcttcctgtttgccttattcagttgcttctagcttgtacacttttccctctccctcttcaactccatttctttgtgtacgtatctcaatgaccaccacaaatacaacttcctctgtaaaacacactaatttcttctctccttttctcctctctgctcctatagcacttttttttcttattggctgtatgacatttattacataggcatattttattagatattaagtaggttttgcattaggtatatttttgaatgtactgaaaggcagatactttattcattcatatgtgctcagaagagcaaaatatctcttacataatgtatgtttaatataagtaaatatataaacaaatagaaatattgagtttggtaaaagatgatattgagaaaaagtgatatgtgatagaatgaaaagctacatatattttctaaatgatgggtggacatttacaactttgctaaattatatattaaatcatctctttatcctgaaaaaattatcttttccatgattagtaagtactttacagtctcttctaggttataaagctcagtactctaattagttttagaaaaactgtgactaaactagcagtactgttttttctcccatattttgtctcacactgaagtcagtgatatttttttctgttcacagatatattcactcttagccttccctgagctctattacagcctggaaaataactggaatttcctttaaaataatacacattttcttaacttatcatattaaatgaaaaacacacaaacactggcctcctttcacattccctagaactttttgttttttctgtatttggcatttctgatgtctttaattttttgtgattctggctctgtattctggtgcctggaacagtgttgcttccaaataaataggcagtagtgatagcaatactcataaatattttaagctatttggaaaaagatattttttagaagctgtgttttgaatgaccttcccatttaactacagtgaatttcattcttagttccttcccaatatctaccctcttgcatcttcttttatgttgtttctaacgtcttttgcggtacctatcaatttactgtcatctactgttttcattaagattgctacttgtagatcattaataaaaaggtgaaataaaactaaattccttatcaattctctccttaagtcaataagtatccagttttaaatgacagtgcttgaattcaagttcatattaaatgttacttcaaataagtttgggagtttacacatacatggctctttggttcaattacatttgtcttatttattttgttttctgttcccttgtagtattctttgataaacttgtcctttaaaatatatattccaactaaactctgcttagggcctaagtggtgtagccctctggggagggtcgcaaatgtaatttgtttgattggatactcaagcttttcaattgttttcttttccttagagaaatagaacctttctagctttcaggtcaattgatgtaatggttggattcagatggaatgacactttctccccgttgtaagtctctagttcctcagagaaatccttgggaaatctgttgacaacttgctgtcatccagctgttctgatggtataaatgacttagacactgattcctggtagtttaaaagtctaatggaacagtgaaattttgagatctcaagtgcatcatgaataaagcacttaagtagcacttgtatatacttcttacaatttgttaactggttttctgctttttttttttgctggagaaagagatttacagttttaatctgattagacattagcagctggttgaagatgctattactgtgaagtatggaaaagaacacaatcatgatgaaaactttttactcaaatccttagaagaagaaagcagatgaaattagattggcaaaggaaaccagcccaaattacacacaggagagaaatgtagcagaggagagtactgagttggtgctgcacgcatagagcttacagcctccatgggcaggggacatgtgggtgtgactgccagggacaggaattgcaaacagcatttggagtgacagtctgggtcagcttctcatgctctttcccatcaccaggcatcagcgagtggaaagatttgacctgattttggagcacagagtgtgggctctaaggccacaggaaggcaggtgaatgggactaggatgtagtggagtccccatggctaaaaaataagttgtattgcatacctgcctttgccccacaattatcaaatccaatctagggtgaatagaaacacatctgcagacagatccaatgtccacctacaaaaagtttcagaaaatgaaaacagatggagaaaaaaaattataaaaatataaagaattctggtaaagttgccaaaagaaatgagtcttctagtcaaatgggctttgttctattagtagatgttgagacgaatgcagtgaattgattagaactgatgttatttgtttgggtgcatacatgtgtgcctggtgaggggtgggtgagggaagaaaaaaaactcaaacaaataagaaacatattgagagaaaaataatacctagagaattaaaatagtacactataacaaagtttgtgagtgattattaaggcttgtgtgggtattcgggggctctctgaggtgtcaatatgtaaactgagatctgacagtaaagactcagctaccttatatctcttcatccctacatcttgttctaagaaaacatcagaagtcctgtgatctcagcataagttgaaaactcgtaagtagtcattcaaaggtggatttgtggagggtagaggtaaactaccttgattatatttacatagaatggaagtgatgctaatttagaaatgtccattgctgtaagtcttaggagatgtaaagtaccaatgaaagatcctgaacagtattatgtgacagaaaatgagtgttacacttttaaaaaaatattagatgttgtaactttagtcattctcacctttaccttttaagtatttcaccatttaatatcaaccttcattattgatttatttctaaagatatctggaaatagtttaggctcattaattttctttttaagagtcaaatcggcatgcaaatgtttctcccaccaagaaatttttttcctggacttcaccttctgaggcatgtccacctttgaggcaagctaagccaggctttgtgaaggcagaaccatccgaagcacacagccccaccaaatttctctccctccttccctccctcccctgttcctctctccttctctttcttttttctctttctttctctttctttctctttctttcttccttccttcctttctttctttccttctttctttctttctttctttctttctttctttctttctttctttttatttctttccttctctttctttctttcttttttttttctttctctttcttctctcttcccccctcccctgctctcccctgctctcccctccccttccctttctttcagctgctgcttacctggggtaacatggtttgggaagaaacatgtcagaattggagtgaataaatataaatgataaaaagacaaaatgaatattattttcaagagtaattaccagtatgaagttcttcagatgataacaaaaactattgacttattttgtctaaatcaatgccactatcttatctgtgtgattgtgaagggaggaaaggaaactgttcactgaatattctgcatttgacccgtaaatacctacttttgtattcagggatgatatattcttaccttaaattaatgactgttttctactgttcttttttggtgcaaacaaattaaatgtgtgcacttctccatgactgattgtgcaaaaactgcttagacaattactatctctctagcttttgatcagaaaggactaccttgaaacaatggccacaataatggtattattctcaattctagaatttatttaaacaaacaattcaaatcatatttcataatacagttctctgaaggagcttaaagagattcagatttttccttttgtttaacatggctcttcatttagtttttgaggcatatttttaataaattttgctcagtactgtctactggagctgaaaaaatctaagaagacacaaaatggctgaagcataggtacttacagaaaagcatgcctttcttttaagaatataaaattaatacattatttatttattatataatgggatgttctacccttgttgaagattttagcagatataactcatgcacagtgtaagtgagcattcacccctgttttgtttatatggcaggactatttctacaaattttacaaattactgtttaggatctttatgacatccattgagtgctggcatgataaatgattttctatatatctgtctacatattgagggcctgattgatggcccttctgacttggggtcagcagtgagttcacatctcttggtatactttggcttattccctggaagtataaacagaaatccaatgaccactattttcattattttccttcaggcataatctgacctaatgatatgtaactgtattactgtgatttaagagatttttaaaaaactataaacattttgaggaaaagtgaaaatggtgattttaaatttaacacatttaaatattcattttatgaaaagaatatttgaaaaatagggatttatcaggatcaatagaaggcttggagtaacctaatcattttaaattttattccttcttgtttttttctgttttcccacaacttattcactaccctctatattctcatactttgctaaatcatattaatccttcaagagttggtttagatgaagcttcattcatttgataaagattaaatgagtgtccagtagttgctagctcaccttgttctgttgtgcttcacagacaatgtgttttatttttatttttattttatttttttacaaagtgaaggtttatggcaaccttgcttcaggcaaacatgtcatatattagtgctatttttccaacagcatgtgctcgttttgtgtatgcttcacattttggcaattctcacagaaatttaaatttttttccaatcattatagctgttatggtggtctgtgatcagtgatttttgatgttattataatttcagggggtgccatgaaccacaccaatatgatatggcaaagttaaccaataaatgttgtgtgtgttatgacttctccaccgacagaatgttcttctgacttgttccttctccttgggcctccctgttccctgagacacaacaatattgaaattaaattagaccgagtaataaccctacagtggcctctcagtgttcaagtgaaaggaagagtaacatttctctcacttgaaatcaaaagctagaaatgagtaagcttagtgaggaaggcatgtagaaagttgacaggttgaaagctagtcctcttgcgccaaacagccaagttgaatgcaaaggaaaatttcttgagggaaaattaaagtgctactctaatgaccacaaaaatgataaaaactgaaacagctttattgctgatgtggagaaaatttgagtggtctggatagaagatcagaccagctacaatattctcttaaaccaaagtctaatccagacaaggccctaactattccattatgtgaaggctgagagaagtgagcaagctacaaaagaaaagttggaagctagcagagattggttcacaaggtttaaggaaagaagtagtttccataacataaaagtgcaaggttgaaagagcaagtgctgttgtagaagttgcaagttatccagaagatctagataagatcactgatgaaggtggctacactaaacaacataatttcaatgtggatgaaaaagtcttctgttggaagaagatgccacctaggactttcatagctagagaagagaaatcaatgcctagtttcaaagctccaaaaataagactgagtctcttgttaggggctaatgcagttggggactttactgcacaggtggtaggtgccctaatccccatattgttaaagggtcaatggtttatagaaataatatagaagtaagtgtgtgattctatctaatctatctatctagtagtatctgtctatattcatattccctatatatccatagtccctacagccatccactgaggggagagagtgggcctgggagtagtaacactgaaatagcacgaatctacttagcaccgaatctttgttcctaaagaccactcatctcttagaggaaccaggattccttggagaaatggctgattccagggctgtggtggggaagtacaaaatgagcctagaacatcttgtgtcataaagtaagaagatacttaaagaattattagaacatgtcaatatgatccagaatgcagctgtatggggtctatactgtccaaacctggaacaacttgagcactgaaatacatattgagagtaattaattatatcccactgagtaaaatagagactcatgagtctatatagataaaaataagcctaagcatatattgaatttttaataagcaataggatatttatacagtcttgaagtatctgctcgcaaaatgtttgctaattgcaaaggggaaaattgtatttttacagtgtggaagcctggcagatatattaatgcaaatgattaaagttaacatcattaataatggaacaaatagaaatggtgtaagacatgataagatataatatgatcactgtatcacctgaatttaatcatgaggaaaaattagacaaacccaaattgagaggcaatctacaaaataactgggcggtcctctttaacagtattaagatcagaaaagccaaggaaagattgaagaactcttttttttttttgggtcggcactgcttttttattttattttattattattatactttaagttttaggttacatgtgcacaatgtgcaggcttgttacatatgtatacacgtgccatgttggtgtgctgcacccatcaactcatgatttagcattaggtatatctctcaatgctatccctcccccctccccccaccccacaaaagtccccagtgtgtgatgttccccttcctgtgtccatgcgttctcattgttcaattcccacctatgagtgagaacatgcagtgtttggttttttgtccttgcgatagtttgctgagaatgatggttttcagtttcatccacgttcctacaaaggacatgaactcatcagtttttatggctgcatagtattccatggtgtatatgtgccacattttcttaatccagtctatcagtgttggacatttgggttggttctaaatctttgctattgtgaatagggccgcaataaacatacgtgtctctttcagatcaaaagaaaactttatgacaactaaaggcaacatgtgatttggggctggaggtgttttttctataaaagactttttggggtcattgacaaaacttgaatgggctttaaagataaaatggtaatgatatacgaataactttgatgtttacatcgtgcttatgtaaaagaatgtctttttgtagcaaatacacgttgcggtattcagggggaatgggtcattaggtcaaaaatttaatctcaaatgggtcagaaaaaattctttgtactactcttgtgactttcctgtaacgttgagatagttattttttaaagtaataaaaaacagaaactactgattgagctgcattacagatagaatgggaaaagagaaaatggacagaggaagtacaaacaacttacttgaggaacacctcaatagagagaagaagagtaacagggaaatatttggtggaggagacttccaagatattttcacgttctcatctttgttcctaaccactttattcatatttatttattatattgcctcctttcattgaaagtattttatacgccatttctattacagattgtaaattccttgaagaaaaggtctgtgctttatataccccttatgtgtagtatatgtagcatcacacttagcatatcataatgtgcttgtttcatattcaaacaacaggaccattttcaaacaagtgattggattttagtgagagtatgaagagcagttttctttataaacatgggagacaaaagaggttgactcacttttaaggagaggacattgtagttataacaagtaacttctagctcattgggatgtaacatgctgaaaaagttttctaaggtattttacagctaacttgataatcttttggaaatcatctgttctccatgagtaaaatagaaaaaggcacaatgatatattgaaataattaagagtatctaatattgtgatgaagtgtgcaccaaaagctttcttaaatgtagaagtgtacatgacacctctttaagcagtatctacaaaaaaccagctggaactctccctattccttaggaattcaataaatcagactgttggcagattttccatcatgtatatgtgtaaattaatagcttttttttggcagtagagagaagagagtaatctaaatgtgtaggaagaagaggccatgagagtttcacatccagtcaagataggacaaaaaaaaatctacttgcattcctatgttaaatttttaaagatcaattaaatggagacttgtttggtggaggttgcagtatatgaagagctttaatagagatgaggggagaacagcaaatccagagaatcatacccagggcacaaatgtaatacacgtaggctttttctgtagattgcttcaagagcctggcttggcttgtctgagttactcagagaggaaaaaatgaaagtgagtgtatatgttggtttggggtgtgtgaaggtgtgggaatggagagaagtggacagagggaaaatgtgttgaaataaaacaccaggagctcatggaaaatgcaaaacagaaacaaaaccaagaaaaaatctttgaggggcatacctgtgtatgaattcatttttccatagcacctttaacatagtcaaaacaaataaaatttaagcagttattcagtcaaactagtagcaggtgcacacacacattccaaacattacaaatatttgtgggccacccacctggttaatttctgccaaagcaactatccctgaataatttcctcaagtacttattcatattgtttgtataaacgtcactcaatagagaatatttaataaactggagcatttataattatataaaaattcatgtcagtaaacaaggccactctgaaaagttatgtgaagaatcacagtatgacacattttgttagaaaacggtgccttttctttattgcttagagttgtaacatcacatagttcatgttgttgttttcattttcggggtatcaattagttgatcaatcagttagtgtttattaagcttctgtccagcaggtaaagcatgctcatcaaatttgcaaatgacataaatgttagagggatggtaaaggcactgcatgacagacatagcatccaaaaagattttgacagctcggagcaataggctgaatctaacaagatgaaatataacatagataaatataaatgcctacctttgggtccacaaagccaactgtacatgtatagcattgagtagatgtgaattagctgttgatgtaagcaggaaaaaaaagacagtattttagttaatagtcagctcaacttaatttatcagttttagctgcatgatgtcattgccaaaaatctagcctgcaattttgaattgtattaaggtgacaatcctgtaccagtttgacaggtcagaccacatctagagattgtagtatttctggagccacattttaagaagagagacactaaaaactatgtcatatttagaacatcacagaaactaaacacatttatcctgaagaagacttaggagaggaatgacatccttctttacgtttatgtaagctctcacatggaaaagggattaaatttgtttggtgcagtctcaataattagaactggaacttgtgaactgaagttataaggagatacctttgggttcaatcatttataataattacatataatagtaaaagctgttcagagagaaaggcgttcccaaaatctgcagaggcagaatactagcacagtttagcctgagtgtcctcctttgcaaagtggggacaacaccattgtgaagcagcgatctgggaaggcagtgggatgatatagggaaaatgttcagcacaatgaggggcatgtagtaagtaagtggttatagtacacaggggatgtcacctttcctattgtgggaggtggtgacaccaatcctgaatcatcactgggtagaggtatagaagagatgctaaatggatggatttgacaaactgactgttacttcaaaaccctaactgactgcaacttattaattaaatttgccatttaaaactgtctctgaaaccaccagtcacgcttctatagcaccttgagtattttttttttttttttttttttttttgagacagagtggctctgttccccaagctggagtgcagtggcgcgatctcggctcaccacaacctccgcctcccgggtttagcaactctctgcttcagcctcccgagtagcccggattacaggctcgtgccaccatacccagctaatttttgtatttttagcagggacagggtttcaccatcttggccaggctggttttgaactctttacctctttacctacctcgtgatccacttacctctgcctcccaaactgctaggaatacaggcgtgagccaccgcaccaagctattctttttttcttttttttctttttttggatagagtctcactctgtcgcccaggctggagtgcagtggcgtgatgtcggctcaccgcaacctccacctccccggttcaagtaattatcctgcctcagcctcccaagtagctgtaattacaggaatgcaccaccacaactggctaatttttttgtatttttagtagagacggagtttcgccatgttggccaggctggtctagaacttttcacctcaagtgatccgcccacctcggcctcccaaagtgctgggattacaggcacgcgccattgtgcctggccaaatttttgttttcaatcctctgtgcttatttttaattatctttaaaatggagaaaaaggtaaacctgccttaggtaactgtaaagttaaaaagaatgaatatgcataaatattttagaacaatgtctgacatactttttttttttttggcagagtctcactctgtcacccaggctgtagtgcaatggtgccatcttggctcactgcaacctctgcctcccgggttcaaaagattctcccgcctcagcctcccgagtagctgggactacaggtgtgtgccaccacacccagctaatttttgtatatatatatattttttaagtacagacggggtttcactatgttggccaggctggtctcaaactcctgacctcatgatctgcctgcctcagcctcccaaagttctaggattagaggtgtgagcctccatgcccggcccatactagctttttaatatatgttaactacttttgtaatgccaaagtaggtggcaaaggattattggagaagagaggacttgagatgtgtgttttgaaaaatactaaaaatttagttaagtgcctatatggaaatagcttgaacacatcatgagattaagtggtgtgtgatcgtcagacagtgaggagactttaccagttagattggaggtcggctgttggtgaaggttagaaataaattgggtgagatgagtgaggaaaaatctcagaaggccttaggtttaggatggtaagcaataggatgggatgtgtggggattccacgtgttcgtaggtaggggaatacaacatacatgtgatttttaaaataaacttatagagttttcaggatacattgccttactttagcttaaaaattatggatggaatagtggaatctttttatgcaaatccttctttcacttagaaatagaaatttctatttcagggcaatttctatttcagaaagtccaagacttttctcctccataaagttttctcttctgattcatattacagtggttttctttttgtttgaatttcttagcattcaaaatgatgttccttatatttgtatcatccatcatgatcttttaaggggaaatttaaatttaagatacgttgtcaaatcgcttaatgttaatctattagaaaggtgttattctgaatgcataaaatggttttgctttaaatgaggccctccaaattaataaaactgctcttcctgggaagcttctaagttggttctgggaaagcaagtcacacagagaaggtccaaaaatatgttatacaccacatatattaacaaattaagacataatttctcaaagcaactccttggaaaagataatccttcttgactgcattaagattcagtatttaagttagaaacaaccatcatcatttatagtgattcaaacactatctagcatattaaaatgtattttgttgtcatcatacatacaagctccttgagagaaaggatcatgacttaactcttgttggtgtagctcatagggccactgtgggtaccgagttgatgctttatgaattcagtttaaattagaagaatgtaggcaatgggattaccatttgtccagtaacaaattcagcacaggtattctgtctctctatttcccagcctgagtcagcagtttcttttagttttgatggccagcaggagtaaaatagcagcaaagatctggcatttcagtggcacaggtgattgtggaaaattactataatctaggtggactcgattctattttccccttgctaggtactgagatattgtgtaactttctggacttttgaattatacttctcactaatctagcatgagaatgggtggatagtgtcaagaattctacttaaaaaaaaaaaatctagtgtactcttgtactcaaagggatgagtacaatctatcacagggacacaaatgtgaccaaaaaagtggttaaaataaaatatgaaactgaagagaatgaagatttgagcatgaccttctctgtatcttctttccaaagtgttttcggatctcttatgaaggggatttaaaggcttttctacaactgctactgcttttgtcaattcattcattcaagacacaccaataaacatgcacgagctcctcttgtcctcatagggctagagaatgagataggtgcaaagtttattttagcagaaggctttcttttcacaaatcagaaattccattgtatgtattcccttaaataactggcaaggggaccatcggaatgagctatggcaaaaatccacctcagtctttacagcttcagggtgatggggccccagatcagaattgtaaaatagtttagagaatcttggaacataaaacatggtgcagaaaaaccaaggaagatttaatcttatgtatggaaaggtggttggtagtggagggggcaatggaagagagtggcttgggatcatcattaatcattatttaagtacctataaagtgaaaatatccttctggaattcactgcaagtgacactgaattcttctactaagcaaatatgtgatgagttgataaaaaagaaggtcctgaactcttgacaacagatataatacagtgaatacagaaaatcaaaaacatgctttctatctgactcaaaataaaggtgcacttaaacttgtaaaagacaacatttttatttgaatgatatgacagaagtgtcacgggagtgttacctgctataaagaaagcctaagaattattacctttattagaccagtgacactgagctttagccatacatttctaacttctgtccctctacagagacaattttcttttcttaaataaactgtcatgctagtgttaatatattgttggctctctcatgctctgagaatactgctgatataaaacgtgtatatgttagattggtaatagtatctttagtgtagctgactagaacaaatgtgtttccctcatggctgtgctaatgtgataaaggaaaattggctgttcatcagcttttggctgggtaaagacagtagagatggaaccacattcttttttatgcattaataccactgagaacttttcactagttatatttcatgtgcctgcatgttgtgcaaagatgttgtaaaacatgagataatgctacaaataacaaagtagaaaagcctgtatcttttataatgataacagtcaaacaccaaatgacagtaacaggctgtaaaaaatgggatgcaaaaaaaatgcagccctactacccaacaaagcggaatatatccaggcccttgaggacttggtatatgatttgaggtatattaaagctttgttttaaaattaaatcaaatgcaacactagatcaatggatttaagaaagaacatagtttaaatgaaagtagggtggttagaatggagaaaagccattgtgggtaacttcttgaaataatccgtattaccaagtaattattgtagtaacttcctgttttttttgttttgttgtgttttgcttgtttttttggggggggacattgaaaaagatttttaaggcaatagtacacatgattttaagatgtttgagaataaatgtttatcttcattaattattgcaagtctttttaacataaaagcattaaaagtataaccagtttcaggctcacagcaaaactgagtggaaatttcagagatctcccaaacatgctgtacccccatgtacccacagcctccccctctattaaagccctgcaccagagtggtatatttgttacaattgccggacctacactgatacatcattaccactcaaagtccatagcagaatagcatgttgaatgttttgctatcattttaattaaaatgttaacatccaacctttcctttgcatgaccttaaatctcactctttcctcccctctctcaacccctcccctttccagagccttttatttgccatttcagctccttcactaattagagtaccaattattcctttttcatttaagctaaaagcacttgaacaaaaagactatttgcagagatgaagttgatgtccaaacagctgattagtttatttagaagtgtatgcaattaaaaattttgtgcaggtatctatgggtgttttccataaaagtttgatagcattggctattctgggctccagtcgcataaacaaaaatcccatagctttttaatcatgtaatccaagagttatcaagctacaacctgtgggtcaaattggctggccacctgtttttataaataaagttttatttggacacagccatgcccatttgtttatatattgtctgtggatgcttttgcattacagcattagagttgggcagttgtgacagtaaccatttggcccataaaaccaaaccatttgacttgcagagaaaaaaacattctctagctatttacagaaaaaaaaaattgctaatccctaatatgtgcagttattaggctacttgcttgattgattagtctagaatatgattggcaactttttgttaccctacattggaaaagtatatctgaaaatcaccaaccggataccaatacccaagacagtaaattcaagaaatatttgatcctagtaacttgaattatatccacatgcaattctttgttgttatatctggttttaattatttctttcccttgtactcattttgctctatttccaaatatagccataacaaatttaatttgtatttaaagaagtaacatatcctcaaaaaccctgtaaaacatggcaaccagagctgttacatgtatgggacaaactattatgtatacctgtgaacaccctgggagatatcatcacagcacaaaatgacactatataggtttatatctagataaacacatggagatatcactgagctattaaaataatgttttcagtcttcccagctgaacaaagtaaagaagaaagaaagttacttaataaaaactgctgaaatgtgtttaatataaaataaaagtttatgcacttaaactaataatggtggtaatttcttacaggtgcatcagacaaaaatcagcttctttatcaatggcgtggagaaggatcatacacctttcaatgcaagaactctaagtggttcaattacagattttgcatctggtactgtgcaaataggacagagtttaaatggtaagtttctgacttcagaatgttatttatttcatccaattacattgttcttaaaaatgcatcaaacaaataatattttaaaatatctacgtgtattcatcttctagggctactgaacaaattaccaccaactggatggcagattaatgaaagtaaaatttattttttcacagttttggaagctggaagtcagaaattaagggttcagtggtgttggttccttctggaggctctgagggcaaatctattccatgtctctcttcgtggtagctactggcaatccttagtgttcctttacttgctgcttcctaactgcaatcttgcctcagtcttcatgtggccttctcctctgaatcttttcccctttacctctgttataaggacacttgtcattggatttagggcccactcacagtcaggaggatctcaccctgagttccttaacttaattatacttgcaaagaccctttttccaaattaaagtcatagttacaggttccagatggataatagatcttttgggatctactatataacttactacatttgggaagctttcaaatataaacttctttattctgatcagtttttaagtaatttcaatgtgtaataaactatatttcctttctgtctcttttctgaggggtttgcattttcatgtagagaattgttaaagtagaactacgaagtattagatggaacctgagaaatagtattgacatgtaattaactggactgatgtttacatttactacattaaaaatgggccatatagtttaagaagatatcatatactatatattgaataaaaccagaagttgaaataagaaattatcttgaaatatctagtacagtggtctttaaaatgcctgcatattaaaataaaaatagtattttatattattatataatatatgctcattataaaaaaatctaaacaatatggaactctgtgaaatagaaagtattttccatatttctatcttcagagatagatataatttaacttttttatactcctacagatttttagtacatttttagctagagatatagttataaatacatttttccaaaaataaaattacaatacatatgcttcctctgagccttctaaaaataaatacttctccttcaaatgttataaacaacgtttcatgtcaatgtatcttctcatttagatatatgttctcatttaaaatggctgtattctatgcaattgtatagttgcaatccatgagatttcttaagctcctataatgaacatttaggtttttttaatgtttcagtgcaattagcagttattttatggaaaatattatatatatatccacatatatttatatatctgtgtctatatctacatttccatttatatatatcaaccatcaatctatcaatcatatacatagatgtatacatacgtacatatgtatttgagcagttgcctgattgcacagttccttaatatcctatttggtgccaacctgcgtgaattcatatcccatttcctcacttactagctatatggcctggcaagatattttaatatctctaaagtgtagtcaccccaactttaaaatgatgatgatgatgatcataatattgatttcccatagggccaatgtaaggatcaaatgaagcaatgtcatgtaaaacattactgtgtttcaagcacctggcatgtattagatattcaatatttatttgttaaatgaatgaatggatgaagtgctaagcacaatgcctgtatataaactatattttctctttcttgggcatggggctggattttaatgtacagcattgttaaagtaggactgtacagtattagatgaaaactgagaaataatattaacatataattaactggactatgtggtttatattttcgcacactaaaaattggccatgtagtttaagaagataacatatatgctatatattgaaaaaaattactaaactatatcagtaaataataataatattattattttattattttttttttttgacagggagtttcgctcttgtcgcccaggctggagtgcagtggtgcaatctcggctctctgcaacctctgtctcctgggttcaagtgattctcctgcctcagcctcctgagtagctgggattacagatgtgcaccaccacgcctaacttttgtatttttagtagagatggggtttcaccatgttggccaggctggtctcgaactcctggcctcaggtgatccacccaccttggcctctcaaagtgctgggattacaggcgtgagccaccgcaccctgccgtaaataatactattattaatgttattataattatttcctaaaaataaatccatagaagttgaatggctgggttgaagtatatggtcattttatattttaatacatattacagagattgctctaatgcataacaatgggctacctccagaaaggttgtgaaaatttataacctcattaaaatatatagccaagtacttgtttccttaaacactaactatccttacaaattatccacttttttttcacccttgacattcctctaagtgaaaaatattgttgaatgctgactcagaattatttggccattaatgagtttgagtagctttttacgtatgtcttgatcatttgcatttcatttatgaattccttattcatacaatgtgtccatatttatactctataattccttatttatttataaaaactcatttatgttaagaatattatgttgtataagttttcttcagttttttgatggcttatgaactttgtggtctagatattttaaagtaatcctttaatatttaagcaaaataaaacatgtatgcaagatagtgcataaatataaaaggtatagcttgatgagtttttaatatttatatacacctgtgtaactctcatttaaaaaaagtcgtagaatatttccagaatctcagagtcccctaatgaacatccactgtaaagataaaaacagaatagcatcaatgtagccctctataaccatagattaatgttgcctgttctcaaactatcatacaaataaaatcatgaagtaggtactcttttgtgttctttttgcttagcactatgccaatgagatttttccatagtgtatgcagttatatctttagctttagcaaataattctgtaaagttttccaaagtgggtgtcccaacaagcaacatttgaggatttcagttgttccacatccttatcaactgttagttttgccagatgttatcattctttgccattcttgtagccatgtagtgcatttcctgatcattagtgatactgagatcttttcatgtgcttatttgccaaatgaatatgcttttttgggaagccttttgccaagttttaattggacagtttgtatttttcttaataatttataggaggtcttccatattttgaatatgagttctttgacaaatacatgatagcaaatatggtcttctgggctaaggcttacagtcacattctcttgatggtatttgtcgataagcagatcttcttaattttaatgagtctaatttagtcattgttttatacttaatactttttgtgttctgtttagactatttttgcaaaccctgatatcacgaagatatcctcctacagtttattcaggaagctttattattttacttttcaaattttggtctatgttctatctggaatagattttttgaggttatataaggtaggggtcaaaatttttgtcccacctgaatgtgtaattaacctagaaaaccttgcctcttgaaacaaatcaatgtttctaccattctgcagtggtaacgttgtcgtgaatcaggtctctgtatatgtgaagatgggtttctttctgaactttctattctgccccagtgatctgtctgtctgtctatacttgggccaaaatatttagttttaattactgtaacttcatacatgtcttcatatctagtagttctccaactttttttcttttaagattgccttggctattatatatgaattttagaaacagtttttcaattttcataaaaaattctgttgagatttaaattactcatttgtatttaggagaatgggcatctgaacaatatcaagtatccagcccataaatgtaatatattccttgatttctcccagcaatgtttttagttgtctgtatagaggtctcactcctatttgttagacttgttcaaacatattcattggttttccttcttaatagactatttttttagagcaattttagagtcacagaaaaattgagtggaaagtatagagagttccagtatactctctgctcctacacacgcacagccttccccattgtcaatatccctcaccagagcggtatatggtatatttgttacaattgatgaacctacattgacacatcattatcacccacagtccatagtttacattaaagttcactcttggtgttgtacaacgacaagtatccactactccagtatcctacagagtagcttcactccctaaaaatcttctatgttcctcatattcatccttatctctatcctaacccctagcaatcactgatcttttcactgtctctgtattttcaccttttctagaatatcatatagttgggataaaaaaatcatgtatcctcagattggcttgtttcactgagtaatatgcatgtaagatttctccatgtctttcatggcttggtggttcatatcttcttagtactaaataatattccatggttagatatagcatagttgatttattcattcacctactgaaggacatcttggttgcttccaagttttggcaattatgagtaaagttgctataaacatcagtgtgtaggtttttgtgtgaacataagttttcaacttataaataccaaagagcgcaattactggatcgtatggtaagatatgtttagttttgtaagaaactgtaaaattgtcttccaaaatgactatatcgttttacattcctatcagcaatgaaagagagtccctgttgccccacatcctcaccagcatttggtattgtcagtgttctggctttttggcctgttggttttcatgcaattatacttagtattgtttttgaacttcatttgctaattttgttactattgcattaaaatctaatcagtttttatatttacctatgtttagtgaccttgccaaactcattattatgataggtacacaatcctatcatttgcacatatcaggaactcaactctttttgaatgtttgtaataaatgtatataatggacatgccataaatatctcctgtagatatttttgtctgatgcacttattaattctgaaataatataaaatgttattttgtttttctgtatgacctgagttattagaccaatgtctagttttaaaaaagaaggtatatatttttgatattcaaaacactgtggttaaattgccaagctctggtttaaatataacccaggtgtgcttctttgatcaaaatattaactctctttaagtctggtttctaatctattaaatggtggtttaatatataattcataggaatcttataagaattatgtgagatgatgtatgtttagaatataagttgcttgttgtatagtaaatgtgcattaagtggtaactatttttaaactctttgaacatcaattttcttattgtgaaacaataagatagggataacactatatttccatatgattgttgtaccaatcaaaagagaaaatatgaagaccgtattactttagtttgtgtatgctcttagatcaagctaaactcatgtgaagaagcaatattttaaggaacttatatatttaggaacttggtttgagtaattagtataatgcataatcttataaaatactctgcgtgaagaatttttaaataacacattaaatcttgtgagccttatttcaatatttaatccccattagtacttctaaaagtgttttattgcaccaaatgttgctcaaagtatttgatagcgccataaattagtcccctatgcactgcagggttaaaatggcttgcttctattctacttcagtatactaaatgttggattaatgcttcaaaagaacagtgtgaactgaagatgatatttttaaactgtgtagaaataaatttcactcctgattagaaaacatgtaacaggaaaccggtttatttcaaatattatttagttttcattacaactttctcctttatgttcttgacatctgagagctacagaaggaaaaggatattttaaataatttttatctttattctatcaatttatatgtacagtcgtacctactgtatcttttctctaattagagatggcgtatagactggctcattacttctgcctaatgagccaggctccatgccacctctctaatcagaaaagagataggtacagaatgttcctatggacttattataaatcattttctttctcttacttgctcctttttttaatcaaaaaattaagtcactgtcctccatacttttgtccatatccaagatggtttctttcaaaagaggtaattgtgcaagcgattactgagctgaattaaaggtgctctcatgcagtgccaggccggctgtctctgctttggaacagacactgcctcaaacacaagcacatcaaatgaaggcctatagcagatcaagatggatcttttctgtctttctctgattaggtttgacttggttctctgtttctgcacccagaaagtaacaaccttccatatgagtgttggctactacagagctttttctttgagtcttatctctagcataactctctagaaaaatgtgttgccagtgacactttctgttactgcaggacttgtctttgctttccctggaaaagtaatcaatggaccaaatgcatgctttttactgaaccctcatttatccttattaatggtataatctgatttgatcaggctgaattttatgtatacaaatagaaacaccttagaccatctatatcaaccaaagtgtgatggctcctttttagaacattttcttttagttgtagatttattttagtgcttccaattgggtatataacctggagcacttgtgttagcagatatgtagttatgaggagtcagcaatgtcatcgtggtaataaaccatactagctctccaaattttggatttaaaattacagaactacatgaatcaaaacttttcccagttatttctgaacttgtttatcaacagagttctagttgccgattaaaggtgagaatttctacattatacattcaaatgtgcatagcactttcttaagaagatcattggtcattaaggaatcaataaatatttgttgagtgtctgttaaagtgaatatgcagggaagaaaaggatcatcgtctaaagctaactcctacttgccttcctttctgtgttttcaacgttgtgtgtcttagcccatatgcttgtacttgattctaaagttggaatgctacttctaatttctaccagtttcccatgggttcacatttctaacctctgctagatacacaaactccattttagttcagctgaaatcatgctaatttttttcagagagaattatttttgggaattagatttaaaaaaagcttagaaagtattgaaattgactaagagattggaatggaagaagagtataggaatatagtatatagataggagtttacttagtttcagaacattgcagacaaggtatctagcaatattatcagacaagttatgttgtatatttaaaatgatgttaatgtagctctctcaaccatactaagtaaaaactgctgattaattaaaatttgaatgcaaaatatgcaatcataaggtagtagaggaaaatgaaggcaagtgtttctataattctagcatattaaggacctttattagcacgataccatgtccagaaacactaaaggaaaatattgaaacatctgactattaaactgggaatttaaaattcaaacaacgattatcattttgtacttgatagtttggcaaggactagaaaagcgattataccggtgttggaaatagtttggggtaacctggcaaactatcaaaagtaaaaatgcgaaaactacttaatccaagatttctacttccaggacactatctcgagaatataattagacaaagacttaaatacatactcaaaatgttcattgtagaatgatttaaagtaacaaataactggaatcagttaaaaacttcaaaaaggaattgatttaataaattataattcatgcctactgtggaatagtatacaccatcaagaggaatgaaatatgtctctttctatgtacatggcaatgggttcatgatgtgttattacatgaaacaaacaagattgtatagtacaaaattctataaatttaatgtatatgttataaacatacatatacatattaaagttctggaaggaaatatgccaaaatgttcttcagaatgttagtaatgttaatctctatgagtgggattgcaaataattgctttttaaatttctttttgtgcaatttttttcagtaaactataattttataataagaattaaaaatattttccaattttggacaaaataataaatggaagcattttcagaatagatttattctatgaatgtaacaagttcagccagagacacctaatttgtatagtacagagggtggtcttgaaaatgttagtcatttaaattctgtacttgtcacatggattcaggaaacacaagcgttcattggacatttaactcattgtacatacaattattattactataataatttgtgcctgagaagcaaagcatgagatttagaatcagacagatttgggtttgaatgctagttctgcttcttaacagccaagtgactttggcaaagaatataacttctcaatccaatttcctaatatgttttctcatttataaaatgtgttttatacacatacttttcagggtgatcagagagcttataaataacacatgtttgattcatgttaggtattcaataaaatttcgctatcataaatattattgttaatttagttattaagtttattgactgtgatacttaaaattttaacataatggccatgaccatatttaattttttttggctgaaaatcaaaatttacttagggtgagggagaaaaaaagtccagtttagattcattatgtagcagatattttaaaattctgtgttttgtctatgtaaaccccacaaaataatttctctctctttttaaagatctgtcctttctagtgttcttcaatgtttcctgttcatcctcacttccacctgatgctatttcttcttaatccgaagaacctcccttttcattgcttgtagctcagcctgctgaagcaaattctctcagcttgtgtaaaaatgtctttacttttgcaggatattttcatttgatatagaattctacattgattactgttacttcttttagaactttaaagatgttgtttccttgtcttcttgccttcattgtttctggtgagatatcagccactatttatataaatgttttcttgtatactatatgtttctttctttctttctttctttctttctttctttctttctttttgaagcagagtctttcactctgtcaacccaggctggagtgcagtggtgcgatcttggctcactgcaacatctgcctcctgggttcaagtaattctcatgcctcagcctcccgagtagctgagattacaggtgtatgccaccatgccaatttttgtattttcagtagagaccgtgtttcaccatgttggccaggctggtctcgaactcctgacctcagatgatccaccctcctcagcctcccaaagtgctgggattacaagtgtgagccaccatgcctggcctatatattgttttccacttgatgctgttaagattttatttttatctttcatgttatcagtttatgatatgcctaggaatgattttcattatatttgtcctgcttgaggtttgcttaaattcttggatatgtacgttggtgttttcattacatttggaagttctgatagttgtatcttcaaacttttctttctttttttcctttttttgcttccttttctttcttctgtaataagactctagttagattgatgttagagcactagatattgtcccatagatattgggtacagttttgtttgttcctttgttttcattttccccactcttttttgtgtttcagtttggatactttctatttgacttgtctttatttcactggtcaatttctcttttgtgtctaggctgctgctaagcccatctagcaaactgttgatttctaaattatacttttcatttcaagtattttcatttggccgttttgtagacttcatctattggctcaaattcacccatctatttgcatgtattattcactatcacccctagatcttttagcatttatattataggtattttcaaatccctatttgataattccaacatctgggccatgtctgcatctccttctattgactctttcctctctttacaaagggccacattgtgttgatttctcatgtgtcttaaatatttttattgtatgataaacactttgcgtaaaagaatgaaagaggtggaagtaaatcatattttttggcgtttttccctttacaaagaagagcactgctggttctatgagaccttttgaatgggggtgggcagtaggaaagaaaaaataccaaactgacttgaagttgatctgtacgtgggctttactacagttttaatattatttagctcactactggtttcagatatctgtggatagaattgaaaatagttagacacatgtctggtggggcctccttagaattctaatatgtcattctggcctctgtatggctgcttctttcttactccttctatgcctgaatcctctatttcttacctctgagctaagtatgggagtagccctgggtctcgtccaatgagttacatgtccagtaaatgtttgtgtttcctacaaaaggcttattactttctagaatttaattcatttagttttttctgtgcgctctacattttgattggttaaaaaataatgactttagggcttatctggcttgttttggttgttagattgacagcaaagtgatggtcccttacaactttttacatttaaagcagatgttgaactattataacaacatctaatttatacccctttttttctttggcacaactctgtctatacttaactctccaaccctctagattgtttcagctatggctggtcactgactctgaacaaaaaaggtgcatattacttggccccaaagattattttggtagaattcaggcatcgacgttttaattacctcctctaatttttcatggggattttcagcttttgtgggccctaatttatccctgactcttaacttttatatctgtttctttggtttgcctgaaatctgtttactgctaatatttaaaactgaaacatgtttttttataaatctagccattggatcttgtttcactaatgatcatgtggcatcgtttaatctcggtgcccccagcggctctgtttgttcagtttgtatagcacatgcatctcttgtgtttctttttctgtcagatacataatcatattgattagtgtataccccttataccctgagtccaaaaattcctcatccctcccgggatcttcaaatgatttaacgactttccactatctctcactttttgatgtggtctgttccctccttactcaacttaagtttcatggccagttattataaccacttcttttcatggaactggacttccctgccgttttttcttcacttctactatgatcttggcactaccacagcataggttaaatatacccaaagaggacgactcttcccaccttaaactcatgaccatgaacttcctatgtttcctgatgctgccctgtgatcattccatatttccctcattcattcactttcctgtcttatgccaactatttatacattttcctttctcattatcctgatcctcagtgattatattacctccaactttaccataaaaattaacaaaaagaataaaagagcttctatagatttccactgctatatttatccaccactggcataccacctattaatagatctgaccaagaatatcttgcctcatttttccccaatttactgctgtattgtaaaattttcttgtattaatggaacattttcaagggaataaaggcatgttgttatttttccatgaaaaattattcttgaccctcccccatttcttctactagccattgtcttatttatttgctctccttttagcaaaacttcaccaaagtatattcaaccataggagcctttaattcctcttttcaaattccaccatctacagtcagactttagctcaccactgcacttaagctacacttgtcaaatctctactcaccttcacattataaatctaatagttaatttcaagtctttatctttttgacctattaacatcatttaatggagttgatcgctccttcctccttggtatacgttcttcacttggcatctaacactccatcatctctctgagtttctagttgctgcgtctcagtttgatttactggttcctcttcatctacttgacctcttagtattggtaccccaagccttaagacttagctctgctcccgtgtctacagacactcactcccttaaagatcacctccagtcttatagctttaaatgtcatctaagtgacttgacctccaaatataaatctccccaccccagcctctttcctgaactccagacgactctgttacatgtatcaaactacccaaagtctccatttgaatgtttaatttacatttcaaaattaaacttactttttttcaaaatggaactggttttcttaagctctctcactttgatccatatactacttcttccatggtcttcctcatcacaagtgaaggcaatttcatttttccactaagacagagaaaaagatttggagtcatccttgtcaattctctttatctcatgttcaacatttttttttttgttttgcaaaatcttgttggtgttagaatcaaaatatatccagattttgaatccttcttagcacttccactagaatcatcccagtccaattcatggttgctgctttgccgggattactgcattgtcttttaactacttccaggcactccgctttattctcaacacagcagccataattgttctgttaaatatcagtcaagcatattacttctctgctcaaaatgctctattgtttctccattttaccagagtgaaaaccaccattcttactataacctacaagacctaactgagctaacagcagttacttctctggctttatttcttacatttgtttattttgttctccttgttttacacaaattggcctctttgccgatttttgactatgggaggtgcacttctgccttgataccattcgctgttctttcaacctggaacttttcacctcctgatatccatcaggctgactcccttacctgattaggtctgctcaataccagtttcttaaatacatctttcttatcaccccgtttacatctgcaaacaccacctccccactttgggtctcattatgttgctctattcttttccatagcacttagcatctttaatgtattatagaattgacttatttttgttgaatatatctgtttttccctctataatataaaagagaaagcaagattttttttatttgcattactcactgatataccccaggatccagaagattgcctatcacatggtagctactcaatacatattttccaagtaaatgaatcgatgggcagcttccatgcagcattaagcctgtgggtgtgtggaatgcaagaattgaagcttgggagcctctgcctagatttcagaggatgtacagaaaagcctgggtgtccaggcagtggcctgctgcaggggcataaccctcatggccctagaacctctattagggcagcgaaaaggggaaatgtggtgttgcagtctccactgagtcccctctaggacattgccttgtggaactgtgagaagagggccaccatactccagaacccagaatggtagccactggcagctttcaccctcagcaaggaaaaactgcaggcactcagtgccagcatatgagagcagccactggagctaagccctgcaaagtcagaggggtagagcttcccaaggccttgggagctcactcctcccaccaatgtgccctggatatgagacgtggagtcaaaggagattattttggagcactaaaatttgatgactgcccttttgggtttcagacttgcatgggggctgtagcctcttttgtttggctgatttatcccgtttggaatggaaatatttactcaatgcttgtatctgaattatactttggaggtaaataactgggttttgattttacaggctcataggtagaagggaattgccttgtctcagatgagactttggactttggagttaatgctggaatgagttaagactttgggagactgttgggaagggataattgtattttgcaacatgaaaatgacatgaaatttgggaggggccagaggcagaatgacatggtttggatctgtgtccccatgcatgttcagttgtaatccccagggtggaggtgatacctggtgggagatgattggattctggaggtggatttttcatgaatgatttattgtgatagtgaatgagttatcacaagatctggttattttaaagtgtgtggcacctcctcccactttgctcctgctttccacatgtgatgtacctgcttctccttcaccttctgccattattgtgggcttcctgaggcctctccagaagccaaacagatattagcactatccttcctgtaaagcatgcagaactatgagtcaactaaccctcttttctttctaaattacccagcctcaggtatttctttatagcaaagcaagaatagactaatacattatcctttgttactgatgtctaaaaatcttttttaaaaaaattaaaagcaagtatattaagacagtaaaggaataaaaaatggctactccataggcagagcagccccaaggactgctggttgcccatttttatggttttttcttgattatatgctgaataaggggtgggttgtttgttagttttccctgaaaggggtgggcaattcccagaattgaggatccctccctgttttaggccatatacggtaacttcctgatgttgacatggcatttgtaaactgtcatggtactgatgggagagtatcagtgaggacaaccagaggtcactcttattgccgtattggttttcgtgggttttagctggcttctttactgcaatctgttttatcagcaaggtctttatgacctgtgtcttgagccaacctcctatctcatcctgtgacttaggatgacttaccctcttgagaatgcagcccagtaggcctcagccttattttacggagcccctattcaagatggagttgctctggttcaaaagcccctgacaattaccccctcctttttaaaagaaagctcttaatcttaagagttgtagagggatgaagatccatcttctctaacttcttcaagctgaataggggtgatgatattcctgcctaacaattagggtctcttgtctttgggatagagaggaactcaatcagaaaatgctggtatgtcaaggtccattcagaatacttgagttctgacaaaagttgatacctggaagattaataagtatttaatttaagaaaacattcggtaagcttatcctacacaaagagtataacagcaatacattccgcagcagtaaagcaaaataaataaaattatcacaactaaactaaattagaagactttccatgaactgggcaattgttagaaccaagctaatatgtggttgctagtaaatcccagtatgtgcccagaattagaatattgatccagattttgacattgcccattcattttggttttttttgaatagtagtcagagatcacttggtggtacacagaaataagcagagtctgtctaaattacagaaaaaaaaccttaaacacaactaatgagactagaatctaataacaggtgtaccatagtttttgaagcaattctttttcttttcagtctctcatttttactaaagacaaattataatagaatcgatttgtgcgcaaaaatgagctttagtcttatacttggcctgattacttgtataaaatgctaaaaaataactatttttcacataggattttaaaattggctttgatggaactttgttccataaaaaggaatctcagataagacctttttaaagctgagcccagccctgggtttgtacaatcaaatacctatgagttgggttaattcctttactcttgaggtcctaagatatcttcgggcccctgagtctatcagaaagtgacattctttacttatcacaggtcaggaaccctgtacagggcatgtgtaaacaaagaatgtgaccagttttcccaaggggtttttattggctttataagtcaagattgattccttaaaggaaagcacaccattccagtgaaagtcttggtaaaataacaaatttttccaattgtgtcctgttacaaaataaaacagatgcttattgcacttatgcaaatatctattgtcataagttaagaatactcacaaatagtttctaaattctgaagaaattaggtagaatcaaatatgccccaaattttgtttacaggagtaaaatttactcaattgttaaaaagctgtaaatagcttaaaagaaaagttgccttggctctgatagcaaaacaaaggatcagcaacattttaagcaaaaagttttaaaagattacttcagctatctattattcagcccatgcagttaactcttgttcagcttgatattcatgaacatttcagctctccatcagtactgaaagttttatcctctcttctaatgtcacaatcttcaaagttattagaaacgtgcattcaagagcacctgtcaaaatcctatagctgactctaaacttactttttaaagaggattaaaacaggtcaacaattttctatggatgacaaaaagttttagaacgacatatattaaagccacaattgataaagaaattttggttagttctgtgacatacaatgattttactgacaattataactattactgataatgtacactaagtcatatcagaattacaggactttcccataattttggaacacaaaccaataacatatttttacaaatacagtccaaagaaagcaaagaccatttcatatttttctatgcttcctgtatgatatttataccaaataacctgaatatgccattttggactttaggccacctaatagctaagagattaattaggtcagaagaagacatactttgtaattttattttggaaagcttgtcaaatattaaaggtttaaaacactggatatcacaaaatataattccaggtcatcataagtcattcattaggccaaaataataactcaaaaatatttaaaggggaaaaacctttactcattaatagagggaagacttagatctccaaaccatctgtctcttttctttcctttcctatataaaatttcttttttagaaacaacctctttgcatagttgggaatatggctaattccacatgtccccaggccttatctagaatctaaagtctccaaagtaggtaaattgaacaattttcaaaagtcaaagaagcagtttctgaccttaaagcatttagtaaacttaatatgtgacctgcctaatttagaccaaatgtctttattttatcaataatttttaaagctgtttttatttcccaaacattcctaaagtcacatgaactaaaagtgattacactttttacttttctgacaaaatatttgatttagacacttattatttttaaaccgattaatcaaagctcttttatatcacatatgcagcacatataaatacacagacagaaaaagatccagtaagatttttcatttttcggtttcttaactggattactggcttcagggtggagccttagaggaacagagccaagaatgcgtgaaatttctaaagcctaataagcaggcacagctggaaggcaaactagatcttcaggaattaagggttccattttaatagcagattctggatcccaaaaagagggaattagcccatctcccatgggagtcttacctctcagtggggagtgggggcatttccataacttctaagtgaccaagagcatgcttctctgatccaaatgtgcaaagagccaagtattccataactgccattagccattctcaaaagtgtatttcctacctagttattgcataccaaagctctttcctaatgtaaagtgatttctgatacccccaaaagtaaaaaacatcagataacgcaatgcgaaacacaagacagccttagattttgagagggatctatccatttccaattcctgggatttcatgaggaaaacagatgttttttctcaaaatggggtctgtggtgctcctttttttcccaaggagtcccaggctgttagaacttaaatatctgcttttaattaagctgacttttaatggtactgctgtttttaaaaagtcctcttaaatttcttattacctgactttagccaggcgaaactgtcaataattctggcttttgaactttatcaaaggtaacctcccaggtgttcagagaaaggaaaattcaagacagaccattgaggggaagagaatcaacaaatgttcatgcgcatatcaaaccagaaaggactcattccctaagctgggaattgaaccctgaacctgggtcaccattgtgaaaagaaagcctcagctactgagctactcactgggcagtttccattgctcttcccagaaggagtctagagcagcagattttgagcttgcaaaggttttaaatgctcaagataattttgtagagctaactatgacatgaacccccaaattcctgttttctggatggtagagacctagagaaagtaccgccatgtggtcacaaggtcaagctcccaaggacataactagccagtttgctgggccgtcttgaacagtaggcttatggggtcctaagcttgtgttctatcctaaggtacccctctttctaacagaaatatacaggaagacaaattcacagtgcaaagtacaacagattcactgtagcttaaaactagcctcacaaatcctttttcacattaatcagaactttacagaggagataaacagtgatttttaccattctttgaactagtttgcacagagagaaagagagaggacagaagtctcactggtaagaaattcttacccttttgctggcatgccaggcttctgggttccctttccctgagcagtcctagtgacccagcttgacgcatcatagccctgggggccaagctgcaacacaaaggaaaattgtctttttttctgtcctggccagagcaaaatatgtgtgacatagacattagccactctgctcagcatccaatatcaaactaacaaggctcaaatttgcccctggttggaccctgtcatcattaatccaacctctgaccagaagtttcaacatgtggtctctgggcaagatggtcaccctgagtaagagaaaaggtaagaaagggaaaggagagaaagaaagaaaagcattggctgcatacagcagggtggggaaggcaaaataatcaaggataccagagaaagaccctcccattgcgcaaaagttcaggctgccgcttgaagggatctgtcatgaagggatcttttccagtagtcccattagctctcaaacatcccccttttgggaggaaaaagctccccaagtcccacattcacatgcatgcctaattatgtcacccacagccatcagcaaagagggcaaggcagattaacccaacgagaatagcagttaatatctcgtattgccaaacccattattagctgagagggactttactgagaggggcctgaaaccccctaaatcttaggaaggactctaaccttcttaagttgggccttgaatccatgttctgtcaagtgtccttgtcttttattaagaggggcctttaaccacctctgtcttaagagagactctaacgcccctaaattaggcctctaacccatttccatcctttacccaagcaaatgtaccccacttacccagagtcagccaataagtgctgaagtctatttcctttgggtcaggggagtctcctccgtgttgtcccttccatggttcaccagaaagatgttaccagaaagaggtccagatccagaccccaagagatacattaaaacaaagcaagttttccttttgaacttgtcaaaaattccatcttgtaaaggatattaaatgttgctttaagctgaaccttgagcaaattaggtggtttgtgtgaccatacatgtatgtggtggcttcttgtttgcaacttcaaggaacaagtattaatagttcagtgtatgatgttgatttgagttgagcatttgcagtttggataatcttaaattttgacagacactagctgtggagactctttctgttactaaatccttttgttttgaagctattgccattcgtctttctcttgtcctttatattttttgtctgtttctttaagcttttattggaaatgtgcataagtaaagaattacttgtgttacttgccaagcaatgcacatttcatagttttaaatctgtaatcagcaataaaaatcctaaaatatgtatctaagaacatcttaaaaaattctttctcactcaagaaagaattcaaggtgagtccatagagtaaagtgaaaccaagtttattaagaaagtaaaggaataaagaatggctactccgtgtagagcagcacccccaatgtctaaaaatcttaacaatgataataaaagcagaaaacatatggtaattttttggcataaaacccttactgcagtgagcattaaaaacaaataaactgctttggttcttcattctagagacatcatatttaaaaacttagatttcattatttgattttcattttgttacaaaataaaatattcttagtgtcacactaaacagagatcagataattaacctgaccccatgatgcataattttaattttaatttcaatttgagttcttaatagaaataatgaaaggctgttatcatattttggttgaatggacacagatctatttttttatggtaccacattgagaatttgtttttttacatatataaatctattaatggtattgtcaaaatactgtcttttttttttttttttaagatgtagtattgctttgtcgcccaggctggagtgcagtggcatgatcgtatcctagtgcagtctcaagtaatcctcctgtcatagcctactgcatagctgggagtacaggtgcacaccaccatgcctggctaatttttttttttttttttttgtagagatggttcttactatgttgtccagtccagtttgaagcaatcctcctacctcagccacccaaagcataggcatgaaccatcaagcccagctagtcttttaagctttgttgttttgaaaataatgaggattattactttgatatcatattagaattttttctaaaaatttaacaagaaattatctttagttctgtataatctgtgggcagctatatctatttataagcatctatgccaattattactttacttctagttgtaatttaaatttgttttagttttcaaggacacagctagtcttaataacttgatttgtttttatttccatttattgagtttagcatttataataacttaaaaaaaattttatttcactttaagttctgggatacttgtgcataacgtgaaagtttgttacataggtatatgcgtgccatggtgatttgctgcacctatcaacctgtcatctaggttttaagccccacatgccttaactgtttgtcctgatgctctctctcccctccccacacctgaaaggccctggtgtgtattgttcccctcccttcgtccatgtgttctcattgttcagctcccatttatgagtgagaacatgtggtgtttggttttctgtttctgtgttagtttgctaaggatgatggcttccagcttcatcagagtttctgcaaaagacatgatcttattcctttttatggctgcatagttttccttggtgtatatataccacattctctttatccagtctatcattgatgagaatttgggttggttccatgtctttgctattgtaaatagtgctgcagtaaacatatgtgtgcatgtgtctttctagtagaataatttatattcctttgggtatatgcccattaatgggattgctgggtcaaatagtatttctggttctgggtctttggggaatcaccacactgttttccataatggttcaactaatttacattcccaccaacagtgtaaaagtgttcctgtttctccacagtctcactagcgtgttgtttcttgactttttaataattgccactctgactgaaatgagatagtatctcatggttttgatttgcatttctctaatgatcagtgatgttaagctttttaaaaatgtttgttgactgcattaatgtcttcttttgagaagtgtctgttcatatcctttgcccactttttgatggggttgttttcttcttgtacatttgtttaagttccttgcagattctggatattagacctttgtcaggtggatgggttgcgaaaattttctcccattctgtaggttgcctactcaccctgatgatagtttcttctgttgtacaaaagctctttagtttaattagatcccatttggcaatttttgcttttgttgcaattgcttttggcatttttgacatgaaatctttgcctatgcctatgtcctgaatggtatcgcctaggttttcttctagggttttaatgattttgggttttgcaattaagtctttaatccatcttgagtcaatttttgtgtaaggtgtaaggaaaggttccagtttcagtattctgcataaggctagccagttttcccagcaccatttataaaatagggaatcttttccccattgcttgtttttgtacagcttgtcaaagatcagatggttgtagaagtgtggtgttatttctgaggtctctgacctgttccattggtctatatgtctgttttggtaccagtaccatgctgttttggttactgtagacttgtagtatagtttgaagacaggtagcatgatgcctccagctacgttctttttgcttaggattgtcttggctatatggactctttgttatttccatatgaaatttaaattagttttttctaattctgtgaagaaagtcaatggtagtttgatgggaataggactgaatctataaattactttgcgtggtgtggccattttcatgttattgattcttcctatccatgacgatggaatgtttttccatttgtttatttcttctcttatttccttgagcagtggtttgtagttctccttgaggagctccttcacgtcccttgttagctgtattcctaggtattttactctctttgtagcaattgtgaatgggagttcattcatgatttggttctctgcttgtctatttttggtgtatagaaatgcttgtgatctttgcacattgattttgtatcctgagactttgctgaagtcgtttatcagcttaaggaattttggggctgaaacaatggcgttttctaaatatagaatcatgtcgcctgcaaacagagacaatttgacttcctctcttcctgtttgaataccctttatttctttctcttgcctgattgccctggccagaacttccaatactatcttgaataggaatgatgaaagaagggatccttgtcttgtgccagttttcaaagggaatgcttccagcttttgcccattcagtataatattggctgtgggtttgtcataaatagctcttattattttgagatatgttccatcaatacctagtttattgagagttttaacaagaaggggtgttgaattttattgaagcccttttctacatctatcgagatgatcacgtgattttgtcattggttctgtttatgtgatagattacgtttattgattgtgtatgttgaaccacccttgcatcccagggatgaagccagcttggtcgtggtggataaggatatgctgctggatttggtttgtcagtattttattgaggattttcgtattagtgttcatcagggatgttggcctgaagttttccttcttttttttttttttgtcatgtctctgccaggttttttgtatcaggatgatgctggcctcataaaatgagttagggaggaattcctcgttttcaattttttggaatagtttcaaaaggaatggtaccagctcctctttgtacctctggtagaattcagctgtgaatctgtctagtcctgtgctttttttggttggtaggctattaattactgcctcaatttcagaactcattattcgtctattcagggattcgacttttcctggtttagccttgggaaggtttatgtgtccaggaatttatccatttcttctagattttctagtttatttgtgtagaggtatctatactattctctgatggtagtttgtatttctgtggggtcagtggtgttatcccctttgtcattttttatgtgtctatttgattcttctctcttttcttctttattagtctagctagcagtctattttgtttgtttgtttgtttgttttcaaaaaaaacagctcctggattcattgattttttgaagggtttttcgtgtctctctctccttcagttctgctctgatcttagttgtttcttgtcttttcctagatttttttatttgtttgctcttgcttctctagttcttttaattgtgacactagagtgtcaattcgagatctttctagctttctgatatgggtatttagtgctataaatttccctcttaacactgccttagctgtgttccagagattctggtatgttgtttctttgctctcattagtttcaaagaacttcttgatgtctgctttaatttcattatttacccaggagtcgttcaggagtaggttgttcaatttccatgtagttgtgtggttttgagtgagttttttaatcttaactctaatttgattgcattgtggtctgagaaactgttataatttcagttcttttgcatttgctgaggagtgtttactaataactttttaaaatatcagtgatttttccaggtaatagacatttatggctttgaaatttcaaagtatgtttaaacaaaaaaattcatcaacaacctcctcccacattctgcatttacatttatcattatcatgtgtgttcttatacttttattattagattgaaaaatatacaattgccattcttatagattaaaaatggtcaaacattggctatttcaaatagttcaatatgtaagtatctcaaaataatataacacatgctgttatctttatgttgttagtatttatgtaagtgctcatatatatatatgcacatatataaaaatacagagtatatcttcaatttgcctttttcataaataatttttctgagaattacccattttgatattttgttcattcattttagtttctctattagtattccactttataaaaaaaagtatggattatgtatttgtttccatgtggagagttagcttttctctttatataatttatagaagattgcaattaatattttgtatgtctccttgtgtgcatttgtgagaatttgcacagaaaaagcacagtgaaaggtatcataggcttcttaagtattcttatcttccattttgatatatcgccaaactgttatctaaagtggttgaaccaatttgccttcctatggcaacaggtaaaatacccatttgcctgtgttatcaacatgttttgttttccaacatttttgccaaaatcatgagtataaaatactcccttattttcgttttaattttaatttctttagtaactattaaaatattgaaacatatggcatttgagttttcgcctctgtgaattgcttgttctggtatatctttcattaaattttccattgcatttccttgtcagtaaaagttacacttataatctgcattttacatgttttaattatattgattgtaaaaatatttccttcagtggtttgacttttaaaattttttgtatttttggtctgtcacacaagagttttaaattttaacattggcgaatatatcagttactttttatggttcagatagttttatatcttacttaagaaattctcttttatcatgatatatattgccttctattttttctgaaattaatttttgtataatgtgtgaggtagagatttaattttaacttatctttattggcacattcttgtcccactgatttttattgaacacacattatttcctcactgatttttaaagccacctctactgtatctcaagctccaatttgatggtagtgtgtttaacatcttgtttcagaggtcaatttgattaacttcttgccaaaagctatagcacttgattatcttttgatatcttgcagtggattccttcttaccagccttcttcagctattgttaggtcttactcctccaaatgaattttaggatcagtttatataaaaatgtttattgagattttttattggaattgaattaaatttatacaacagcttagggataatttatattgttatgctgatttttttcatccatgatcatagtatatcattctatttatttagatcttcttttatgtcttttagtaaatttctataaataaaatactcataacttataataaaagggataaatataaaatttattcctaggtatctcaaggttttggtgctattgtaaatagtatcttttattaaattgcattttatatttattgctgatataaagaaatattataaattgttatatatcattcttatttccaacaccattttggaacacattaattcgaatatttgactatagatttatttgaattgttgaggtagaaaaccatgtaatttgcaaataatatatttatgtcattctaattcttatggattttacttcttttctttgtctgattgtgaggtctagacattcctttaacaatcttggaaaaaaaagcagtgagagcaagcatcctcaacttgtcattgctttaatggaaatggctttacattttttcctttaaataagatgtttgccatatcacgttaaaaactttcccacctattcctaattgtttagggttttctacttgtatattatgtatttttcaagacatggcagatttaatttgttgagatataattttcatgcctatgctaccaagtgagattggtcctgtcgttttcctttctcttaatgtccttgagaacatgtttcagctctcccatttatgacctgttttaccttgggcaaatttcttaatatctatatgcttcagtttcctcatctttaaaattagcatcaaaagaatatctttccatagtgtttttatgaggattaaataaaataatatacataaagcacacagaacagggcctgctactcagtatgcaatagttattagctgtcattgtcatcattaatattaagatattttaaaacacttttcccctaaaatacttagagtactttgatgcatatcctaagatctgtctctggctgctatttctggacatttctttgttgtaatatttctggtagctcttacttgtgactgtgaattgtagacatttgatgcccacagactattcagctctttcaacttctaccttgttcctaaggaaatctgaatcaattcatcagggtctttcctaaagaaatttgtcgaagttatccaatccaatgccacgattatatttcttcttgtatgattgtgtttttgttgtttgtcaaagaaatttttgcccaagtcaaggtcacaaagaattttcctgtaattttttctagctatattatagttttaggttagttctattatccatattgagttaaacttttacataaggtgcatgatatgttttcaggtgctttaaaaaacataagatatccaatattccaggaccgttcttggaaagaagagtattctttttccatttaattttctttgccacttagttaaaatacagtggactgtgtatgattttattatcagcattttcattgctactgaaatgcagtaggtatgcaattgattttcatgtattgatattgcaacttgcaactttgctgaactcatttataattcctaatagattttagtagatttcttagagttttctatgtacaagagatagttttacttctactttttcaatatggaaagatttatttcttctgcttgcctatttgccctgtctggtaactacagaaaaatgttgactagaagtggcaaaagtggacattgttatcttgttcctgatcttagggaaaaagcattttttcaccactaaatatgatgttagctgttggtttttcacagataccctttattagatgaggaagttgtcttctttaatagttagttgctttttaaaaattttatcatgaagtgttaactttgactatgtagctattaagatgatcatgacgtttttgtcctttatttttccaagtttgtgtattacttgattacttttcgtacattgaaccagccttgcatccttgtgataattccacttgctcatgatgtatgatcctttttgttagtactgtatttggttcactagaattttgttgaagacttttgcatctgtattcataaggcatattggcctatagttttcttttgatgtctttgatgtttttggtattagggtaatactggtttcatagagtaatttggagagtgtttcttcctcttctattttttggaagggcttgtgaagtaatggtgctacttcttctttaaatgtttggtagaattcgccaatgaaagcatctggtcctaagcttttctttgtggaaatttttaaaaaattactaatttgatctcttttagtggtatagatctattcagattgctaatttcttcttaagtcagtttacatagtttgtgtgtttcttggaatttgtctattttatctaggttgtctaatttttggcatacagttgttcatagtatcccttatgatccttttttgtgactgcaaagtcagttgtaatttcccttttttaattcctgattttaatcattagagtcatctcttttcttggctagtctagttgaatgtttgtcaaatttgttaataatttctaacaatcaacttttgttgtttttcttgttgtttttctattctctattttatttgtctgctcaaatctttataatttcctttcttctgctagctttaggttgagtttgtttttctttttctagtttcttaaggtagaagattaggttattgatttaataaatttctctttaaatataagtgtttacagctctaaatatcactttaaacactacttaaatcccataaagtgtgatatgttgcatgttcacttccattaatctcaaaggatttttaaatctttttgtaatttcttctttgatcattagttattaggaatgggttaattttcacacatttgttaattttacaaatttgcttctgttattgatttctaattttttctattgtgatccaagaatatactttgcatgatctcagttattttaaatttatagagacttgttttatggcctaacatataatctatcctggagaatgtaccatatgcacttgagaagagtttgtattctgttgttgttgggtggagtgttctgttggtgtctattaagtctaattggtttataaagtcattcaggtcttccatttctgtttgtattctgtgtagttgctctctccatgattgaaagtaggatattgaagtctccactattgttgttaaatggtgaatttttctctttaaatctttaaatttgtcattttactgttgttagacacatacatgattataattgttttattttcctgatggattgatatcttaaaatattcttgtctctactaaaaattttgtctaaagtctattttgtctgatgttagcataggagctcaagctctcttttggttattgtttacgtggtgtatctttcttttcattcttgaacattcaatctatttgtttcctcgaatgtagagtttgtctcttgcagaactcctatagggggtcatgtttgtttgtttttccattttgtaaatatctactttttgattgaagtgcttaagccatttacatttagcacagtgactgataaggtagttacaatgtcactttgctgttggttttttaaaatatgatttatgtcttctaaatttctctattctttcactgtcttctttgggttaaaaagttatcttctagtgtataatttaatacccttgtcatttattctactatgtttgttgcccaggatgttatcattaacatcttaattcataaaaatctaattcaaattaataccaacttaattttaagagtatgcaaaattttgcacctatatagtttttgttcactctgctttcttttgtgccgttattgtctatggagattttttacattggatgcccatcaacacagatatataattattgctttataaagtcatcttttaaaacaaatgtgagagagaaaaagaattacagtaaaaatacatttataatctttttaaatatttacctatttaattacctttacaggtactctttatttcttcatccggattacattgctctctaatatcctatcatatcagccagaaggacttcttttggtatttcttgtagagcaagtctgatagtgataaaacctctcaatatttctttatctggaaatgtcaatttatcctgcatttttgaaggagagttttgctagaaaaaatagtttttggtgtacagtttttttttacgactttaaatatgtcattcttctcccttctggacgccatggtttcttcacaagaaatctgtggttaatcttattgaagatcccatgtaggagatggccttttctcacttgctgctttcaagattttctctttgtctttgtctttcaacagtttgatttttaatgtgcctagggtgtggatctatttgaatttatcccacttgcagttcattgagcttcttggatgcatagattaatagttttcatcaaattttggaagtttttggtaattatttctctaaatattctttcagtccttttacctcttctctgaaactcccattatgcctatgctggtactcttgatggcgtcccacagctttctggggctttgttaatttctcaacattctttctctttctattgctcacactgaataatctcaattgacctgtattcaagttcattaattatttcttctgatcatttagatctgctagtgagctcctctagtgaatttttcatttgaaagttttctattttctatttattttttctttttttgatgaaatgaggtctcactacgtttcccagggtggtctcaaactgctgggctcgtgatcctcccacctcagcctcccaaagtgctgggattacaggcatgagccaccatgcctggctaaaaattttctatttcttttctcatattctatattgtctaaagcatcattgtcatactttgctttagttctttggacactttgttttgttttgtttttagttatttgaacatatataaaatagttgatttaaagtctttgtctggtaagtttaatgtatgagcttacaattgacccatttccattgcccatttttcttcccctgtatattgtttgtaggagtttctttgcatatgccatattctttgttgaaaaccagacattttaaacacatagtgtagcaaatctggaaatcagattatttccctttccagagttgttttgttgctgctatttgtcactattactactgtttgcttgtttagtggctttcctgagctaattctgtgaagtctgtttctttgtcatatgtgataaatgaagtcattgtttgctcatcttagtagtcaggcaatgactgaacagagaatttcttaaatgcctagaaccaatacattttccagtctctggtgagagatctgtacgcatgttgcagaatgccatcaacactgaggcagtttaacactctcctttagtccccacttcctgcttgtgcagagcctcaaagtcgagctgaggtgagaccttaggactttctcaggtctttctttagcatgcgcatatacctgagcacatacttagccttttgcatgttcataatcttgtagattcgcaggcattttttaaggatttgcaaagcgtttatggacatgatgtttcacatcttctccttttaagtattttggattgtttgttgtttcttctgactgttgttactgcctgggtcaactgcaatgttaagcagttgccagtgattatttttagcaaataattgttttaaacaaacagagtaaatgctgtttccagtggatgaactctgagtcaattcaagccttactagtggggctttccatggtacttccaggcagatcgaataatgacaatcatctgaggatagagctttgaaacagctccactcccattctgatcctctagcagtaactaggctgctggttttcaccctgattgcaaactgttcattttcagggcttccagagagtggcagagaggagtacgggaataggaaagctaaaatgccatagaacatgttgttcttaccaatattcagtcatttaaaaaataaacactgtccacattgttgcaagtctttgctttatttccagagttctcaataagttgatgtgatattctttgccagtgttcccattgcttttatggaagacagactcttccattgttttcactctgccattgctgatgtccttttattcgtttcctcaatgtcttatagtttttacctatatacattgccttgctttaatagatttataactaatatttcacattttcagtgctaataaaatagtatttaaaagttttaatttccattggttaatcactagtatatagaaattaaattattactcatttaacttctatcaaacaaaattaactaattcacttgttatttctaatagcttttatgtacagtcatggaaattttctgagtagataattatgctatctgcaaatgagagtttatttctttccttctgattgttgtgacatttgttacttagccttattatctgtttttaccctgatttatatgttggattacttagttttcccatttgactaattttgttgtgccacccagttgtaatgcataacaacttctttccagtcatcacctgtctattttctgactagacagctatgaggtctttcttgtatgagtcatgtctatttccttgatcaatttatataatttagacatatctttgccatatgaatatttttcaaagaagaatttttatggaatgtttatcccaatgaatatctgttgttaaaaaattggcaagtagcaaaggaataagtaaaatttatttctatggctgtccttgaaatatttgatagtattctcacctcaaatcataattcttttatttgggatggatgattcacattaactctaggtctttagaaaacttgctgtaactcttttttatgaagaatttcttcaaatatgaattctttagcaatggatatgattgcaagctccaaaatttaaaactaaaatggtttttaaaggttataaaacccagcccctttattttatagataataaaatagatttcattatccccctgcagcagagcttccctttagctattattaaaatatagggagtgaattctaatttatcagcattgaaaggtacacctccacttctaataccctggtctgactgccaacatttttcacacatatgactgtaatatcctcctaactggcctcttggcttctactcttatcttcctatattctagtctcagaacttttgaataatcctgagatcacatcactcctcttctcaaaaccctccaatggcttcccattttactcagaccagaaatcaaatttcttacagtaggctattagactttgtatatataacaatttgtacctccatcctcccctctcccccagccagctacttgtctgacctaaccttctaataacctccccccttttattctgctccaggatgctagctccttgcacctcctctaacatgccaagcatactgatttagaggtctatgtgcttattaatgcctgcctggaacattttgcccctagatatacgtatgactcattcccattcccctgtcaatgccacattctcaatgaggcctctcttggacataacatccccactaaaatctagccatgctctccaacctgctctaatccttctgtttttcataaaatgtattgcattctaatatactatatgaatttctcattcattatgtttatctacgtgaatgcaagctccataaaagcaagggtattttgttgttgttgttaactgattgtacttttggcactcgtgaaagtgcctggcacataataggcttccaataaatacttgtgaatgaatcaatacgtaaaagaatgaagccaccctgacatttaaagccatggttcaggctttagcaacatcacagtgttcatcagttttgctgtctttcagttatggtaagtctttcaaaattatgaatggctagcccctgtttgttatgatctgggttctttgagataaaacacttccctagaggttatataaaatattttagacaatattttatcctgagaaagcaaattggataacatgaaatgcaggtaatttctttttttctccttgatatctcattatgttggcaaaaataggaaatgaagactgtcagttttccacggctgccatgcaaaagtactgcaaactgggtggcttctcccagaaagagaatgcctaggactatagcggggcacagaaagttccccacaaggagtatttcaaagctgagacattaggggctgtatgaggcagaaaaattggaagcagaggcaaaatgggaaccttagggctgagagagcctgaaggttgtggggcattaaaaattcatgctgtagattaacagtgtggggtgtaaaggatgctaggagaggaagaactgagcatggttagggatagttgaaggtaaagaaaaaacgggacacaggcccagcttccttgacaacattatctcttacctcataaataaaatttatgctatgaggagtgactttcctattcgtctttcctattccccaaataaaagcataggcacacaatggctttgctgtatttgcatgtattcttctcatctttcttctaagaatgacatgtccatctttctaccattccctctttgtttaactttagatcctggatccaggtcaattgatcataaatcatgttgcctggatggccaattaactgaaagaatattttaccatgttttcttatttcttgtaactaattataaattttagaacaatttgtgttggaaatcttctaaagatttctgcaaagttttagtagatttagttttgtcttcataacaccacttggaggaataattctttgcacttgtgccagctgcctgttttaggatagatagagtagagaaactctccctacgggaaagtcagagcaggaggctgcctagagcacatcttcttgtgggcctcagctcatggggtatgtggaagactgagactaatgggtagaaagagagagcctataagtgtatttttcttagactacatcagctgagaatacactaatgaagaaatatttttatatgtaatattttggttattttctcaaatatattatttaatataaatataacatgtaaatatatgaatatacacaaatatatgcatacacacactcacacacagacacatactctttttaggctcctaagtctcacactttgcttgtgagtttcttcctgattctgagatcactatctcagactacttcgtgtgctaattctcctctccatgttttatttatcagccatatcctcactctgtcccagtttcctccaagcaaccaccaaggagcagcagaaaacataaatcaaacattctttaaaactctatcaagacagagtgaaaactgaatagttaaaagaaaaaacacattgggaaaatggtcatttgatgattaaaattgctccaattttatttttttagaactattgaaataaacaattattgaaataaattttgttattaaaaatataacaaaaaacttggagtcggtagtttttctgctttattctgtctccactctcttgggcttatttgtctcagtaagttctgaaaaaatatttgccaaacaaataaaataataccatgtggattaaggttgatagctacatttgccttgaaaggtcacctaattcaaagtagattggtctttgaacctggttttcttagaagattttccctgaggcaataaaattctgagagtgaactatgatactattgatatatgtgaatgacacagaacctacaagtaggaagtcttcgatgagtcctcatttggagattttctagaacagacattaatttaactttagagagaacccaaacagatagcctggagcttggagctataacaggtgggatgtgagagtgaggaatcttccttttggcattgcaaatactctggaaattgcaatcagaagcagatgacaatcaaatttagggctgatgagataatatatctatggagttataaactagagagaaatttgacttgggaagggacttctggagaaagccatgagttcgatcagtaaataggctggccaaagtattcactttgacttaagtcctacagtgtccatggagataactatgattatttttgttattaatgtggaattagcaaactagagattgatctgtaaaagtttcaaagggcagtgacataaatatctttttaaccttaacatcttcaaaggaatatcacttaaatacttgtcaggtattgcttggtaaacagagacttcttatattatgcacatgtgtgtatttgcaggtttagagcagtttgtcggaagaatgcaagattttcgattataccaagtggcacttacaaacaggtaagcagatgttgcattgtaaacctcaagaaccgaaaggataaatgctgaattcacttaaataagaatactatgtagattataccattttttatctttataccatttggcaaacttcacctaattaatgtttacagtgtttgctttggcttagtctatggttgttattcactagtgctactcttgaggaactccttgtaatatgaaattgatcacatttttcctaaggatattctgtaagaaaacttgatatttgaacattttataaaacttgggatacaatgcttaaattttctatatgaggtagtttctattaacaatacttgagaaacttctacatctgccttttttaaattggtttgttgactttatacctactagagaatgtagaacaataaacgtgattaattattttgatacatgggaaattctcaagagactgatctattagacttggagacaagaagaatgagcatttgaagtattgtgatatatttttctattttcagtgaacaaataattatatagactcaggctagctttaatgacattatttccttatcttgagagtagatgggaaatctttcttagggcttcttaaaagcacacagaattttaaaaaatttaagtgaaattctgcttaggatgcctttgaactttcttcttcagcttatgatatcatggtataatagtatattgttgtatggatgagttgatcttatttacttctattaaaaatcaaaaagaagaatgttcattcatatttcttcaaggcagatataaattagtgtggtgggtttccaaatgagaagactagcccttgtaaatttagaagcattgcttttgatgtggttcttagtccatggcagatcattaacaatataaacattctttcttaccaggctatataatcaaggtatgcctcagtaaagggtgccatggccctggaacacagtgttaggtgtatttactgccaaaagccttactatattttagatcacctttgtctaaaatgctgaagggcaatgttgtagtaattctttgggaataaagtttttccttgggagtgaaagattttatactggattctatactggtagcttttggtcccattcaaaacttggtatcagttgaaaagaattgatgagatttaaagaaggtatgacttcatgtgatttaatgaatggaaaagctgcctgactccttcactgctccactggggtctgagaggaaaagcctggtttctctggtaagaccttgattactaattttggcctacctgaaatgtctgggaaggtgctatgtggaagaatgcctataaatagaatgactaattctggtctagaacaagtatattgcccctaatggaaaaattaaatatatctacctggaattggcattctttgactgttggcagccgccatatgatctgaagccaatgaagcattacaggatgtcaggatctgtactgatgagtcacaggaaaccattgacaaatggccttggcctcagtccttcacttaaaacagaagcagataaaatgatacttgctttcgtacttctttcccatggatgaactgaaaacattatctataactctcattgttctccatatattattgttcactctcagtagttagtttagcatcctaagtaaatgtgatcatttctatattatcacaaatagacacggtaaaatattgtggtatttaaataagtatcttaataatcagacaagggcttatgcatgcttcttgatataaataaaaagttaatattaaaatgtgtgggttttgatatacattttatgataatgaatttgtttatttggccaaaaataagttttattttatgtttcatgcatcaaattattaaaactaaatggatactcatgaaagcactaaacgagtgacattcatttgtaacgactcctagaagttctattactgttaagctctttgtccttacagtctccctcttgactcccacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtaatgagaaacgataaggtgtacattaatttcctgtggttattgcaacaaatgcccacaaacttcatgtcttaaaacaacagaaatatattccctaacagttctggagatcagaaatatgaaatcaacatgttggcagggctacattcccttaaagattccagaggaggatccctccttgccatttgcagctcctggtggcccttggtgttacttggcttgtggcaccacaacttcaatctctgcctccattttcacatggtgtccttccttgtttctctgtgagcatcaattatcccttttctttctcttatataaggcccaccctattagacccaggatgatctcatattgacatccttaattatactgcaaagaccctatttacaaataaagtcacatttacaggtttggacagtagtacttggacatatctatttgggaacacaattcaacccactacaaggtgaaaactgaactaggcaattgaaccttgcctcaataaagtagtgtattataatgtatacaataaaaatatctaaaagacaacatgtaggaccttatgtttgagatttgtatcaaaatgatatttatgaaatgttgaaaataattatttttattaagtagcaaaaattaatacaaactaaggtgctttttctaaattaagaagtctctatatatgacatttatttcatagaagtaatgttctttgtttatgtctttatttgcatgttgatttataaaatccttgagcaaatgaacagatacacaattatagaatatgttgcttttaccacagggctatgaagtttctggatgtctaatacatatttgataactataattatgatgaagtgagccaatatatttgaatctaataattccatggtttgatatatactgatggttaaacttaaaactttaattacattaattaactttccattttcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaagtatgaatatttttaaacaattaatttaatagactgattggttattaataatgtacaagtatgctagctctctaggctggtggagacttcccttcaccaccaacttccttgaggcagattctcctaagtcttatccctaaattgggcttaaaactatgtttaaagttcttgtaaaagacattagagtgactcttatttcaatctcactgatgtttcacaatctgattttcagattgtttggcaagttatctatgtaaatagaattttcattatgttttcaaggaactgttttagtgtggctttctatgataatcctgtattgtttatatatgaaatatatggaatatgcttttcctagaatgaataatttaagcttttattgatactgtgtagtaatttctcaacattttgatttctgttttgccaaaaatgtgaatagattttcatgacatcgaatttctttcattaacagttttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggaggtattattatgaattttgttttcaacaaggtttttgtcatacttactgtcttaacagcacattaagatgtcagagcaagccagatttcaagctttacattttgaaatgatttcatactctaagattttaggggaagatctgtatgtgagtcttttctctatataacattgttatatatatatatatatatatatataaaacgtattttataaataaatatatatatatttatatatacaggaattgattttcaaaagctgttgcttttagaagctatgatactctgaatctgacttagaagtgatttatccaatattttacttgatttgttctggaatataattttcaaatattctcaaaagcaaagagatggagctgaatttggagttgtaactatagcaccagagagtttttaagtacagatcttgatctacctgagttcatagtgcacagttccatgggtaatacttgtttttctttagtggaaagatctgatatgccctaagtagtttataaatgtctgatcataattgagaacatgactcacaatatttaaaaagaaatgacagctgcaaacctaggcagcatactgtctaatatagaaatgtacatatagagtatatttagaatggattgttctggaggaatgataggccttgtgaataaaatatgtctttaaaagcagaccaaaataccagtatataagcattgtttgtttgctaagtcatagcataatgaacaaagcaatactattaaatattcatcatctaactttggaaaaaaaaataaaaaaattgaaatatgttaactgcattctgcagtttattgtcaactttatattcttttttctttcttttttttttttttttgacaggcttttgctctgtcacccaggctggcatgcaatggcatgatcatggctcgttgcaacctcgacttctgggcctcaagtgatcctctcatctcagcctccaaagtaactgggactacaggcatgtgccaccatgcccagctgattttttttttcactttttgtagagatggggttttgccatgttgctcaggctgctctcaaactcctgacctcaagtgatctacccgcctgagtctcccaacatgctgagattacaggcgtgagccaccgtgctcagcctgaactttatattcttaactgtattttaaatagtgtagtaaatgccttcccttggtacgtggttggtatagatataaaaaattccatttccctttagaggttggcttgaaaattatctttacaatacacgggtttggatattggtgacagtccttctgacatttccagataaattaaaaacgtgtatggatatccacacgattaaggagaaactgattttgtatcaattaaatatacaaaaatcttccctgttaaattcacataatgcatatagtcctaggaccttaaatatattcacagttgagttggtgttccttaggagtgtgtgatgctcatgtttgcagatgtcagtgccatggtcatgccgataactgcgacacaacaagccagccatatagatgcctctgctcccaggagagcttcactgaaggacttcatgtgagttctattttatgcatggaaatctaaaaaaaaaatagtagagatggtgactataaattctatgaacttaatcttggcctaacaaatgaaaataaatttaaaaactgatatgaacttaaaatgtcaattattgcagattttttaagaaaaataacagccatcaattaagttgaaattgtagtttttaaaaataatttcagccagagaaattacaactgaaaccaaaccctaaggttcttttctcttttgtttttctttctttgtttcatcagcattatcatgttttataaaacaatttttaatgtgtttggatagcatggcactaaacaaaaaatagtttgattcttactaaagggtatttatacaaaagtatcaataaacaaaagcatcgttagatgaagaacaatgtttatgtatttatgtcaatcaaggttcatttattgctaatatcaggcattttaattaattgaaaatctatagtaaaatgatttatgagttatgttactttagttttctgtgacgatcaggggaattccatagttgaggtggaattttagcttcatctttagggaaaagaggtaagtggaaataaaatcaagaaacattcgttggtaggaatatctagcaacaacatcagaaatagctgatatgaaagacggttcagcagcagtaacaattataccaataatgagagtagataatatagactcttcagtaaatatgtttaagacaactggctgctaatttgcaagaaaataaaattagagctctactgattgtatgtacaaaaatgtatgtggcttaaacttttagtgaaaaataactataaatatattaaaataaagattagaattctatatcttaagttgagggcttttatcagctaagcaaatgaaatacaaacagaaacaaacatctggagctatgaaggaaattaatgacatattctgttatataaatatttaaaattctacacagtataagggttaacataaatgtaaggtagtgataaatgatggattgatagaaaatatttgcatcatgttaacaggtaaagagttaagattcctaacacacaaacatttacaaaatattaagaaaaatataacagtctgataaaaatgagcaaatatatgaacaagcaatttacaaatgaacaaattgtaactttaataaacatataaaagattacccaacctcagttttaatcatattcaacaattgtttttaacatttcaaattagcagaaaatataaagattggtaatatttagtacttgtgggaatataacctttaacacatcactgatgggattgccaattgacacaatagttttggggaaaatttgtccacctctactaaaattaaattttcaaatatagtgaactacattatataattgctgtcattctgaaaagcagttcttcaatgacaagtgtatggaatggtgtattagtctgtttgcattgctgtacaggaagacctgagactaggtaaatataaagaaaagaggtttatttggcttgtggtactgcaggctatacaagcttggtgccagcatctgcttggtttctggtgaggcctcagaaagcttacaatcatggcagaaggcaaagccagaagccagcctcttttaaacagccgtgtctaaacagccatgaactaacagagtgaggtctcactgctgaagggaaggcacttcatgaaggatccacctccataacccaaacatctcccaccaggctcacctccaacactggggatcacatttcaacatgagatttggaggggacaaacatacaaactatataaaatgcttatatttctatcattttgttacataaatatgggcttatatgttagtgcattttagcttttcagatggtagcactgtctcatacactcatgtatgacttgtgaacatctctgcctcttggaccttgccctacacttgtgttttagttagttacttcacttctctgtgaaatttattttaggatattatagagcatcttgctttttaaaaaaccatctgtaaaggttttggcaaattccatttctgtcttctgattcttactctgatctaatttgcttttgactgtaacattagtgagaatagttcaatggtaagaatattatctataatgcagactttctctagcacattcaaaacgtagtcccactcctcagtttcaactaagagtctttgatttagttatggcctactttctttctttctttctatgtgctcagaccaaaactttcatgttctaatttagatattcttttgaatttattttctagatcactactttatatacatctagtcctcaccattagtcaatacttgctttaaaagaagaaatcttttatggttttcttttggatttctaatgcctagagtctttgcatttgatttcattagtatattatgaggaaaaatcttttagaagaactgattttaatatgcttgattgtatggcttatcatattgtcacagaaatgaaattaattggattaacttgattgatttattcttcactgagccataattgtgtgtttaaatttttgccaattttatttgttctagattttaaagttaaagcaacatttattatatttttctactgtcttcttttgatcccttaagatggacacttacttccttataatcagtgatttctttcattaaccttgtcctctcctccacaaagccactaacaccccaattaaaaaatgctttgggatgaatttagcagggcaccttgaactgaatatgtctagtatttgcaagctacagtttggctaataccttcatatgatatgttcttttctgagcttctcttgctttctgttgactagtcagtcggtattagtctctctcatttgcttgtgacgtcctgtcttgttttatctttctgtctttaattgctcacagttaagtgttggatattttctgattcttggatgatttcatgcttccccttaaaaatagagccattaaatgaatgaaggctcatgattggtttcagaagacaagttgggattttcagacttggtctcaggtggtgaatgttggattatgaactagtgaattaattaactataatttgggttgagaatacattttaatgcttcttatttagaccttaagtaccttttgaaaacaaaaatgaaaaactaaactttttttgttattttcctccttgacatattttgatagtttatgaatttagccataaattttaaaaagcaacaaatataatttacttagcaaactttggcaaatgcaaatgcagctgcagggaaaaagtcaatagactgttaagttgaatgatttctcagtcctatgatattttcaataatgtgttgaaaatgaaaaatgattttatagaaacattcataggcatgacattctcctttgttaccattcaaagtattttaatacaagtagagacttacatatctgagaaaagtcgtcttacggtaatttgaaaatatacctattctaatgcttttcttgttgttctactttttaaaattatacgttttaatataagccattcacttcctattgggatccatgttctttttaagacctggacataatccaaaaagaatgtcttcaattccacagtgttatgctatccattaataatattacttaataaacagggcttttgtgaattatattacagacatttggcaaacagatgaaaatgtaaggactgaaaatatgccaattcttggcaattgtctttcctatgagaaagtgtttttagtagaaacaaaaatgaatgaagttgagaaaaggtgaatggtgaattcaggggcaggttcacatatttagccatcctaaggaattttccgtacaaaatactattcatttgtttataaggtcaatgtcacaaattggtggctcacaggtagaaacagtgtttaaacagttttaatttaattttctgcaagagttttcactttaaaatatttatttattcttcaatcttttttatttatttatttttttgagagggagtctcactctgtcaccgaggctggagtgcagtggcatgatcttggctcactgcaacctcagcctctcagcttcaagcaattcttctgcctcagtctcccaagtagctgggactacagctgcacaccaccacacgcggctaactttttgtatttttttttttgtagagatgggtttcaccttgttggccaggcaggtcttgaactcctgacctcaagtgctccacctgcctcggactcccaaagtgctgggattacaggcatgagccaccactcctggccctcaacttttattttaagttcagaggaacatgtgtaggatgtgcaggtttgttacttaggtaaaggtgtgccatggtggcttgttgcatagatcatcccctcacctaggtattaagtccagaaaccattagctattcctcctgatgctcttccccccacagcccccaccatccctaagaggccccaatgtgtgttgttccccgacatgtgtccatgtgttctcataattcggatcccacttgtaagtgagaatacgtaatgtttgattttttgtaccggcattattttgctgagaataatgacttccaactctattcatgtccctgcaaatgatttatatttctggtaatacacagtaatgggattgctgggtcaaatggtatttctgcctctagatctttgaggaatttccacactgtcttccacaatggttgaactatttatactcccaccaacagtgtaaaggtgttcccttttctccacaaccttggagcttctgcacagcaaaagaaactatggtcagagtgaacagacaacctatagaaggggagaatatttttgcattctatccatctgacaaaggtataatatccagagtctagaaggaacttaaacaaatttacaagaagaaaacaaccccattaaaaactgggcaaagaaccctgagttagcgagttgttgccaggggaggacattaatgtcttcttttgagaactgtctgttcatgttcattgcccaatttttaatggggttgtttgtttgagaacagttctcaaaagaagacatatgtgtggccaacaaacgtatgaaaaaaagctcagcatcactgatcattagagaaatgcatatcaaaaccacaatgagataccagctcatgccagtcagaatggcgattattaaaagttaaaaaatgacacaaatttttaattcctcacttctcttaatcagaacatagtctaacactgtgtccatttcctgccatcaacaactcactgattcagggtgacatttaccacatttacaacagtatcactcttgggcttgctacaacattcactactatgtatatccttatacatgggcgacatcactttggtgaactacctggccttgaaagactcggagcttcttaacctcctaaagcaaaactgatggatagattgagacactagaagctagaatacatttttaattattctgagtagagaaagaccagctgttcattgctatattcattgttaactcctatttcttttacccctttataaaaataaaaactcacaaataaccgaaaacaactcaagaaaatctattagcaaagacactgtttactctgagatgaaattaaagccatgcttactttttttttaattacatttttgacatctaaaaacatttaccttggggagcctcactgattctcctctgcactctttgaccaggaactccgatacatttttgtattgtactggcaattttaaggccttgactttaatgtatgatacataccataaatacttcactcatagagaatacttttagaatacttgtcgcatttctttccaagaatgaaaaaaaagcagtaaatgcttaatttactaggctcactttagaactgatttagggtgaaacaaatccaaaagcctagatgctattcattaactttcatacaaagttaaatatttcaaagtagaaattagaaatacatggtattgaacttgcatgaatcattatatatctcacaagttacaaacatgttatttataaatgtttaatttcatttgaataaaaaatagccactgttacttgcatttttaagtaaacttttaattttgagataattatagatttatatacagttgtaaaaaataatataaagacaatttgtgtactctaccaatttgtcccatggtaacatctggcaaaactagtgtttttttctttttacatcaaaagtgtgatttgtgtacaataaaatatacccacttaaaaatatatagtttgatgagttttggcatatgtgtaccctgtgtaatcaccatccctgtctagagatggaatgtttcactctcccaaacgttctcttatgcttctttgcagtcagtgctgtctctgaacccccaatcccaggaaaccaccaatcttatttctatcaatacagattagttttgcctgttccaaaatttcttagcatagtgttatttggtatgtaatattttcgtacataggcttttaaatcccacctcacccccacttttagatcattccctaattacatgtgctgttagctttactgcaacatggtatctctggcccacttaatcagaaatccattataagtatcaaagtgtatatattaagctcataggtacataatacaagctaggaattggaagcctgggtttatctgtcaactaacatatttgcaaagctataatatatttattacttctttttcttatctagtactttctttacttgatctaagagttcaagtgttgaatagaatctagttttaagaaaagtgttgtcagttgaaacttgaatccttatgagttgtctttttcctttaataactacatttacctttcggggctctggccaagagtgatgcaatgatcagtgtctcagccaagcattggcacttcattggctacttagctattctttcgtcattttgtgacatcattacctgcaagggtagccaagccttcacagagcaatttattagtaaccatgaacacttcttattctttggctctaacttatgacccttttataacattaatcatagatcttatgaattaactacaatcaaactatcagtataaatttttgttagcattataaatagcacagccagcttgaaactttttatataataagccttcctaccactcaataatttgaatggtgccaacatcacactctagaatgcttattatataaatgaatatttctgttatttttgaaagattcctttagagcaccaaagtccaaaagtatgaatcatcatgactaatttgtgtcatatttatattatatatcaggctttaccactgcttattttttctctgtttgttcgcagattttaccctaaatatattttatttatattttaattattgtaatgctagtaaattaattcatttttatataactagcattcacacagttcatattataggatctacatttgatatatgtttagtaagtcaaggtaaagaattttctttcctcactgacatgatgatattattaatctttgaaaaacacttgtactagttctttccgtgagataggtatgtgcataaatgcttttaaaatataagttgaaaacatgaaaaagaggttatgagcatggagataaattaagacagccttacagaagaagcaaatagagatagtgaaagtataaacatagtaaaagaaaagataatatttgaagggataagagtaaagaattatctaaaggtgaggaatgacatgatttttctgaatcccaagtaggctaagaaaagtaaatgcatacataggtataatataatgaatccaataatcaccaaagaccaagcagccagaaagacagaaatctgataatcaccaaagacagaacagcatcctaaaaacagccagagagaaaaatacaaagtgtaagaaattaatttctaagacactactgatatatttctcaacagccacaatgaaagccagaagacagcagagtagtgcctttgaaatgcagagagaaggcaaccaagaaatatggaattgtatttgtagtagtaccatcaattagaaacaagaaagaaagaatgcatttttagtttacagatatatatatcaatattatcaccagcagactctcaataaaagaatttttcgagaatacttttcataaggatatataatgtttccagaaaataggcctggtgtgaaggaaggaattgtgagcaagtaaaccagcaaatatgtggataaatatagaggaaaatttactgcgttaaataaaaataaggttatatgtaagaaagagtataaaaagtagcaggataccattaaatggtcattaaaaatagcatttaaagggaaggggtaaactccaacttcagctccctctagccattctgttgcaccttggggtaagaagagcagttactgagaaatacttgtaaagttcacagccaatgagcacagggctcattaaaaactgaaaactaatcctagaatcatagaacaggggtccccaacccctgggccactggtcagtagtggtctgtggtctattagaaaccggactgcatagtaggacgtgagcagctggtgagctatcattacttcctgagctctgcctcctgtcagatcagcagtgacatgaagttgtcataggagcataaaccccattgtgaactgtacatgtgagggatttaggttgtgcactccttctgagaattcctgatgctttgaggtggaataccttcatcttgaaaccattccccatgtgctgccctcacacccagttcgtggaaaagttgtcttccacaaaaccgatccctggtgccaaaaatattggggaccactgccatagaacgctttccctcccctctcatcttaccaccacaccatgaaaggcctgtttgccagagttccctttactcagtacatcatgtctggatttcaacaaaaagttacaaagcacactaaaacaccaaaaacaaacaaacaaagaaacaaacaaacaacctcacagtttgaagagagagagcaaaaatgagaatgagactcagacatggaaaggatatggaaattatcagaccagaaacttaaagcggctctgatgaatacactaaaggctctaatggaaaaagtagacaacatgcaaaaatagatggcaatataagctgaaagataaaaattctgacaaagaagcaaaaagaaaagctagagatcagaaacactttcatagaaataaagaatgcctttaattggatcattaatatttggggacagctgataaaagaatctgagtttgaagatgtgtcaatagagactaccaaaatagaaaggtaaaaagaaaaatgactgaacaaatagagcagaatatctaagaactgtgagacagctaccaaaaatgtaaatacatataatggggaagaagaagaagaagagaaaggaacagaagaaatatttggaacaataatgactaagaatttttcatattccaaatgcagaaaaatcaaagttagggaaaaatatcttaaaaggagcctggctgaagggggaacatctagcctatgaaaaagcaaagataagaattacattctacttctcctcagaaagcatgcaagcaagaaaagtggttaaatagttaggtgttgacagaaaaaaaaaaatccacctagaattctgtatcttgcaaaattatcctttaaaagtaaaggaaaaatactttctcaaacaaaaaccagtagacttttcttgccttgcaagaatgttaaaggaagaacttcagagagagagaaaaaatgatacaggtcagaaaactcagatttatgtaaagaaagggagaacattagagaaagaataaataaaataacttttatttttcttatccttaattgatctagtagataccagtttgttcaaaattataataagaacaatgtatttcattattatagcatgtgtgtaagtgaaatgaatgatagcaacaatacaagacaccagagggaggaactaggaatactttattattattaggtactcatgccaccttttaagtggtatcgtgttatttaaaagtcaacttggaactctcgcatgacattattttgtcttgatagttcaagctccacctgcggttctcccgtcctccatgccaggtgtcaggggctgctctggatgttaactcttccgccccatgacttccagttccaaaatggcggcacagaaacaagctgccatgccacaaccccaccgcgcccctctcccgccaaaaagaaaaattaacaaatatacattgctgagattatcaccagaaattgtcacgatagtccagaactcaaatatgaagatataactgttcccagggccataaggaaatgagaaacaccaagtggatggtaagaaacctgactttcacatttgtagcactcgttaccccattttgcctgacaccaaatatgcagaagattttcctccaactcacttttttctacactggaaaaattaagattgaggtaaacaaccagcttccccagccattctgggttaccggaaagagacctgtcctatccatgcctcaacccactggaagcgtcatgagtgcctaaagggagacatattcctgaagataggcagagacaaagggggatgtaggtctgtcatccccagcctgggaaagtctgctctgtaacttgaccaatgcagacacaatgtcagagtagctgcttagcagcactatgatgcaggaggattatttcactgttctcctcggcacaaacccttaggcagccttcccatactgtcaggatattccctttgggacctctcttgttaagaagggcacaattggattgtttactgaagccaaggcgaacctgggcttaaagcgccccctatagctccctagaggaagcaatttagcagcaaagacatagatgtatgtccacaagaaaaacagcagtaggaaactatgatgtctccaaacagacaaagcagggaaccagggactggccctaacaagacagtaatatgtaagctccctgaccacgaattttaaaatgcagttttaagaaaactcagtgatctccagtagaacacagaaaaataattcagaaattcattagagaaatttaacagagattgaaattttaaaaaatctatcagaaaccttggaactgagaaataaatttaccgaactgaaaaattcactagtagctctcaccatcagaatggattgagcagaggaaagaatcagtgagcttgaagacagaatatttgaaaatatatggtcgaggagaaaaaaagaacacaaagaaatgaagatttcctacaatatatagaaaattattaatacctcaaaaggccaaatgtaagaattaatggtattcaagagggagttgaagaggaaggattagaaatcttattcaacaaaataataacaaaaaattccaaaatttaaaagtatacttggattagttataaatgtatattataagctttatagggcaacccccaaaaaagttttaaaaaggtatagttgatatatttaatacttacaaaggaaagaaaatggaaccatgtaaaaatgctcaactaaaaccacaaaaggtaaaaagtatatagaaaacaagaatagaaacaaagaacaagggcaatgaataaaaagtagtagatattaatccaactatgccagtaactactttgagtgtcaatggtctaaatataccaattaaaagagagagattgttagaatgaattgaagaataaaaccagctcattttataatgccaacattaccctgtaccaacatcagacaaagaaattacaagaaaagaaaaccacagaccaataactctcataaaaatagatgcaaaaattctcaacaaaatattcaaaataaaactattaagcaatgtgtaaaaataattatatatcagaaccaagagggatttatctcaggtttgcaagactggttcagcattcaaaaatcagctaaagtaattcctcacatcaacaggctaaaggggaaaaattacaagattatatcaataaatgtagaaaaagtatttgacaaaatcaagcatccattcatgatcaaaactctccacaaataaggagtagaggagaacatactcaacttaatagaaaatatgtataaaaacctagagtgaacatcatacttaaggataagaaaccagaatctttcctactaagatcaggaataagacaagaatgtttcctctcagcactccttttcaacaacgtattaggaaggaataaaaacaacaacctcatttcaaaataaggcagtaaaggagaacgaaagaaaaaggatatatagaaaatagaaattccaaataaataaacaatcacaacaaatctaaatgtgctgaacatattagaattatgagactgtctggctgaaagagaaaacaacatccacctattgtctgagcagaggctgaattagggcaagagaatgtcttaatcacaaactttacaaaagcaccaaaaacaccctattaagcaagatctataatatttttatgttatatttcaaaaagtcaaatgatttagaaatgtataattaaaaatcaaaattttaagtaaagacacattagtgttgcttgttttatggtcctgtgttattttgtaatgggagctgttgtttctaatcagtccataattcctacctaccagttttataaggttggcatgtacctgtctcatagaaggttttacaatcgtctagaaacagactaggcatgatgggacattatacacagctatttttttaaaactgtagagtgtttattaactttttccatttggctccaaagattggtaaatattttctagttgtatacagaggttcgtatttttcctttgccctcatgctgcaatgcagctcagcatggtacttgtgctgagggtgtgagagacatactcaaaaaacaagcacacttcaagtttgaaaatttaagaaagctagcatgagctacataaatattaggcaaaacagacattactgtttcattaaagaaaaagaggcttattgtataattataaagtataaaattctaagtttacatgcatctcataatatagtttcaaaagtataaagcagaattttatagaaccagaaagagaaattggcaagttctaccatcagcatagaagaatttaatacatctcttattaaaaatgtctttttataaaaagaaagaaaagctacatactagcagttgtcattagcaagacaacacatatataactgacaaaggtaacatttaaattaagcaaactatttgaaaaacagacaaaagaagtgaacaagtaattcacagaagaagccagaagtggcaactgaaatggtcaatatacatgtaaagacatgtgcaactttactggttatcagtaaactaaaaaaaaagaatgtgataatattttatactcatcaagttgtcaaagatggcaaaatctggaaatttcaggaactggtaagtggggactcatacaccacttatgggaaggtgctgctgcactatggaaaacaatttgcaaatgtctacgtggaacactttacagtagtggatatgaaggaatatagctatcacatcaacatgaccagacttctcaaacaatcatactacagaaagcttgttttagaataatacatacactgtatacacttatataaattttaaaatcatacaaatagaaagaagaaactgataaaaggataggaggcaggactaacttgcagctccccctcggacagacagagcagcatgtgaagacacacatcatgaacttttctccaagaactactgcagcaacataccaggaaagccacgagaatccacagatcctttgaaggaaatagattgctgctgcaggctccaggagacagccgaaaaactgtaagtgcccaaagtgtgaaagggggatcttccacccctgaacacatagccttcctggggaacctgaaggtccaggtcacaggtgatggatttggccttacctggagctgagacaaacttagagagctgaacaaaatataagggtaaaggaagcagggggaagagccctgtggactctctcagcccccaggaaaaccatttctgactttgtctcctagggtccttgggtaggactgccagtggaagtggggaaagaccacaaggagaaggaaacttccagatgaactctgtaacaatttcgactgaatgccaactttcctagcagaatctgggggtgagggtgaactgggagtgcagacacagcacagaagttgcatcaggcagggaggtgtgaaacctgaaacccctgcttgcttttccagtggggagacctggagcaggggcaagtcctcagccctgttcacccattgcctggaaataaactcagtgctgttgtggagagtattgtgggagtgagactggccttttgggttgcatgggagctgggtgaggcctttcactgccagctttcccctactttcctggtgacctgtatgatgtagcagaggcagccataatccccctagaaacataactccatcgccctgagaaccacacccccaacactcagagcagcttcagcaaggcctgcccaaggagagtctaagctcagacacacctaaccctgaccctacctgatggcctttctctacctgccctcgtagccagacaaaggacataatctcttgagagctctatggccctgaccaccgcctgagaaacttatccaggagactctagagcaagcttgtatcctccctatgctactgccgttgatgctctcttgaaagcgccacctcctgtctgaaggccaaccaacacaaaactagtgcaataaacaaaaatacaacaaaggaccctcacagagtctacttcactcccctgctatctccaccagagcaggtgctggtatccagggctaagagacctgaagactgatcatatcacagggctgtttgcagttactccccactaccagtctggaggctgctagctccactgggtggctagatccagaagagaaacaacaatcactgcagttcagctctcaggaaggcacatcctggagcacccacatccagggagcacccacatctagggaacacccacatctggggagcaccctgtgggaagaaagaatctgaacaacagcacttgagccccagatcttccctctgacatagtctaaccaaatgaaaagcaacctgaaaaacagttctagtaatatgacaaaacaaggttctttattatccccaaaagatcacaatagcttaccagcaatggatctaaaccaagaagaaaactctgaattcccagaaaaagaactcagaaggttgattattaagtgactgaaggaggcaccaaaggtgaatatgaactcaaaggaatttcaaaaatgttacaggatatgaacagaaaaatctccagataaataaatagcataaataagaagcaatcataatttctggaaattaaggacacacttagaaaaatgcaaaatacactggaaagtcttagcaatagaatccaacaagtagaaggaagaacaccagagcttgaagacaaggcttttgaattaacccaatcaaacaaagacaaagaaaaaaaaaaattaaatgaacaaggcctccaagaagtttgggattatgttaaacgaccaaatctaagaataattggtgttcccaaggaagaagagaaatctaaacgtttggaaaatctatttgagggaataatcaaggaaaacgtccccaaccttgctagagatctagatatccaaatacaagaagctgaaagaacacctgggaaattcatcacaaaaaggtcattgccaaggcacatagtcatcaagttatctaaagtcaagatgaaggaaggaatcttaagagctgtgaggcaaaagcatcaggtaacctatgaaggaaaacctgtcagattaacagcagatttctcagcagaaaccctgcaagctagaaggaattggtgtcctatccttatcctccttaaacaaaacagttattggccaggaattttgtatccagtgaaattaagcttcctaaatgaaggaaaaatacagtctttttccgacaaacaaatgtttagagaacttatcaccaccaagctagcactacaagaactgctaaaagcagctctaaattttgaaacaaatccttgaaatacaccagaatacaacctccttaaagcataaatctcacaggacctataaaaaaaaaacacaatttaaaaaaaagcattcaggcaacaaatagcatgatgaatagaaaggcatctcacatcctaacactaacattgaatgtaaatggcctaaatgcaccacttaaaagatacagaatggcagaaaggataagaactcaccaagcaagtatctgctgtcctcaagagactcatctaacacataaggactcacataaacttaaggtaaagaggtggaaaaagatattccacgaaaatggacaccaaaagcaaacagcagtagctattcttatatcagacaaaacaaacttcaaagcaacagcagttaacaaagagggacattatataatgataaaaggactagtccaacagggaaacatcacaattctaaatatatatgcacctaactccagagctcccagatttagaaaacaattactactaaacctaagaaatgagataaacagcaacacaataatggtgggggacttcagtactccactgacagcactagacagatcatcaagacagaaagtcaacaaagaaacagtggacttaaactatgacttagaacaaatgtacttaacagatatttacagaacattctacccaacaactgcagaatatacattattcatcagcaggtgaaacatcctccaagatacaccatgtgataggccacaaaacaagtctcaatacatttaagaaaactgaaattatatcaagtactctctcagaccaccgtgaaataaaattggaaatcgactcaaaaaggaaccctcaaaaccatgcaaatacatagaaattaaataacctgcttctcaatgattcttgggtcaacaatgaaatcaagatggaaattaaaaaagtcctttaactgaattgtttgatatagtgacacaacctatcaaaacctccatgatacagcaaaggtggtgctaacaggaaagttcatagcattaaatgcctatatcaaaaagtctgaaagagcacaaatagacaatctaaggtcacacctcaaggaactagagaaacaaaaaccaaacccactcttattgacttaataaggaaattaaaaaaagtatgctgagattgctaagatctattataataatgaatcttctatctgtgaaatagtgaaaaaaaaagaaattagtgctagatttgctgtcaaaccacaaagtgcaaaagttacggccgcagtgctagataagtgcctagttcagattgaaaaagcattaaatttgtgactggaagacatgaacagaaaatatgtactatatggaaccaaaatatgtactacatagtacacatagtaccaaacccagttgctgtcacttggcacatagagatctggcatctactggaggtcttcaaatgtattccttgtggaaaacaggactacttactatactactaaattcagatattattagcggagtggaatatatatggcagtatcttgtttctaagttgagtggtacataaaatggtacaattctttttttaattattcataaatttatttttaatatttcagtataatttcccttaaacacaataatatgattgattaatctatcaggaatgtatcacctatgtaaatactcatgctactactaaagacagagtggaggtgactctattcacaatggaataaccattactaaattcatgattactgtgtacatttatagttttactgtaaagattgatcatttgctagctttagtcactcaacaaatatttataaatgccttctatgtgtagtgcattatgctagagtacagccattatgtcttgattacagatgcaagtatttgaaaatattgaaggaccttcatttgtgaaattcaaaaaagattccctggcagacaccaattactataataaatagagatgacttcagtgcaaacaaatgattcaggctaacaattagtaattaacaaataatataaatagtatagacattttaaatcttaaagaaaaatttaaatgcagcaatacttaagaaagggttttttaatttactaatgtagtaatcaagtctaatactacaaaaaatttctaatatgaaataccctttatatttaaataatcaaataccttgtataccagttgactaagtttagaggaatcttaaatattaaaaaacatcaataacgccttatacttcttagtatgtgaattcgtatttgtatgatgtatattattttggagagttgcctgtaagcaccatattaatataatgaatgaagcttttcttcattgaagtcctttgtaaaataatgcaggttatcctgaataaatatggtctctattccaggccatatttcctggaatatcaatagggttaaattattatggttgcaataaaatagaattgctttatcttgtccactatctacaatcttgaataaactttaaaatcctccttctgttctcttaagggaacgtggtgtgtccccatgtgtcttttttatttagtgccctgaacaatccataaataagaggaagaaggaataaagaaggacagagatttcaaaggagaaatcaaatacctaacaacatgcagtattgaaaattaacaaataagaatgcaaggcctctcatgcaaatggttccatctcattcaaccactagacataattacttctgtattcacaaggcctacagtaaggaaatactgtttaaaaaaataggctatcaattatatttatatatagacaacatgtagactgaaggattatccgaataatcctgcctagagtttctgtttttctaaatataggttttatgtcacgtattacaatttgtttcattggataattttccaatcttccatttcactttacccatagaattagactaggcattacttgaattagaatgtttctaaaaatagccacttatattaatagttgaaatattgaagtaactatgtatgatgtgtttgtcgtcattgtattgtcacctatgtttgatcagtattgtccaacagtattagtagttatttattttatgctattaatttcagtatctagagagtgagtaagtacattgtatctgtgaacactttaattatgtaagaatttctagccaagggaaagataattactgaaaaagggatatgtcattgaaggataaacacgtggcatttctgtcttctcagtggtaaagaatagtatttgttttggcttttccaattgaaattacataatctgtaggtaaaaattcacaggtgaagtattattgcatttgcctttaaacctttaatgttactattcaattaaatgctagtcacattaaagtacagtcctgtaatgtgtcataaatgcaatgagtctgttaggacattcactcacacattcaccaaatatatatgatcacctcccatgtgcaaagcacagagccattttctgtctagattctctatgtagttgggcactttatctgtgttcccctctgaaatctatcactgataataaattaacaagtttgtctaacattacctttgccatgggaacattagagctacctagggacacttccattggaaaaaagatacctgagtacactaaagtttttatgtttataaagatgatttctctacctagtagacaaatcacagtgaaactggatcctttgaattacaattgaattgctccagccagaggaaaggggaagccttgaatagagccagaggacaattactattattagagatttaggctcttaacatttccaacatagggggctggtttctactgatgagaaagggaaaatgtacagattttcagagggtctgcaattcattcaggccatctgggaatagttaaaaaaattacctcttttattcagtgagcagtactgtaacagtactaaaaagtgatcattttataatctttcactttgaagcagattgtctttctctccttctcacataggcagtgctgcatccatatctctaaattttatagccaggagtggaataactacatcttttggtttctagggctttgctgtccagtttagactcagcagaaagtaaagatggactgagccagagtgactccagtcaacacctctctccctcgaatactattttcggtccctgaagccagtataaacatggagattagaagtgaggtctttgaaggaaaacatccagatatataaattgagtacctactatgttctagggctccttctaggcacttcttcaacatattgaagacaagttgttttcgatgactcattgtgatcattatgaacttaagcttccaaaggtcattgacactgggagctctcaggaccttgaagggaaattttctccctagcccccagccttttgcaaggacttcatatatctttgtctaagaggatatttttcttccttcttttttcaaagatacatagtaggcatttaagattgttgtataagtgactgaataaataaattgctcttgcagttaaattacttaaacttgtattttacacaagtttctactttctctgtaaatttgaaggtgttaagaaataagtaaaattgagtgtgtggcttgtcatggtggctcccgcctgtaatcccagaactttggtaggccgaggtgggcggatcacttgaagtcaggagtttgagacgagcctgggcaacaaggtgaaaccctgtctctaccaaaaaatacaaaaattagctgggcatggtgatgtgtgcctgtagtaccagatactcgggaggctgaggcatgagaatctcttgaacgtgggtggtggaggtttcagtgagcccagatagtgcctgggctccaacctgggcaacagagcaagactctgtcctttatctccaaaaaaaaaaaaaaaaaaacattgagtctatcaggagtggagttgataaaaatgctttggagactatgggttatctttgaaagattgtctttgctgctctgtaatggtaacgaagaaacactatacttcagtttaatgatccataagaaataactgtcattgtgtattattagaatataatgtaataaaataaatttcatcagtgtcttctagattcaatgactattcaatgattttcatacctgaacatgtcaaagtatttggctgcaacttagcggagttgattagtagcctttaagaagctatcaaaatgaaagcagttaaatgaatcagtggtaaaggtccttgaccctgatatagccattgtctaatctcataatttgggcattcagggacatatcgggggaatccagttgttacagaagaaaccgaaacataattgaaagtgacaaatgatcaactggagattgggaaaacatgaaatagaaaaccatttgcttcaggagctgcctaaaatataagatacacacagagttcttgattttaaatcaaactttaaaatcactggtagaaaaggcagttgaaaattatgagaattcaaaaatttacttataatgcacttaccaattattatttcttccattttgtcatggttatccttgtattatctgaaacgagttgttaagaaccaattatgggaccaagaatttaatacttcatgaaactttataatcaaagaatagactacaaagtattccttctgtctttgcaaaccatacaaaatgataatagaacagtatcatctttaggatcaaagacccaaataggcattggtgtgtcatttagttgcatatgtcttaaatcaaattttaaaacaaatttaggcatcatctctcaaaatctttgcttctgtatattaatcccattgttttggaaaaaatgtatattttttacaaatcatactctgtttactggtggctcaaaaactttttagcttacatagtagttgaaaagagaatcattttttctgcagatttttgctcatctgtgtgtaatttaaaactgaaacatattaattttcttaggttttcttagtgaaatgttacatgcaaatgatgtataattatcttgtaactatccatgcagttacattttatttgctctcaatttttaatacattagtaataaatgtacactgtggaaaaaataaagttataaactttatctgtaaacctaccacccaccggtaaccccagccaataatcttagtttatatactttcaggcattatattattgttattattagtaaacctgtctcatctgtctctatcttcttaaaattgcatatttatatctatagataagtccacctttatctagaatagaggattatactctgtatattatttttaacttgattttcaattcaagctgtattatgaatatatttctctatttatatttataaatgttagcctttttttttttaggaattggaacatcttaaaccactctcttgcttttgggcatttaatttgtttccttctcttcagtattatcaacaccccattattaaaacagaaaatctttatcaagcagctttaaaaacatattctcggacaggcacggtggctcacgcctgtaaacctagcactttgggaggccgaggcgggtggatcacgaggtcaggagatggagaccatcctggctaacatggtgaaaccccgtctctactaaaaatacaaaacaaattagccgggcgtggtggcaggtgcctgtagttccagctactcgggaggttgaggcaggagaatggtgtgaacctgggaggtggagcttgcagtgagccaagattgcgccactgcactccagcctgggcgacagagtgagactccgtctcaaaaaaaaaaaaaagtattctcctaaattctcagtggaatttctgggtcctgtggaatgtatacatatgttgctcctcctaaaaggagtggataaactcctctcctacaagcagtgttctgcactggccctttctacaaattcctttcaccctggtattatcataatctaaaaaataataatttgagaatcaaaaaataacagctatgcttgttttcttcaggaaaacagaacaggttatccatatatctgcagggtttttttctccacaaaagaaaggccagccattttcaataacaagtagtttggcaggaccagaaccattccattgggtcactggtaaaatttgtctttggctttaaacattaaggcagccaggactgtgtctttggacattgatacagcatttagtccagtcttatttacaattaggctttttgataatggcttttgggctgacgttaagtataaaatctgaaattagattttttaaagattataatcaaaaagcaaaaatgtcttcctagaaatagcaaaggaatgcttttgctggatttgctccactaactcatgtaggcaatataccaaactcaaacagccagcagttgttttgtaaaagacaaactgcatctgaaatcagtatgacaggaccacagtttccatctcatcacttccaccaacttacatttaagaaagcacaacttgaataataaaaaccaccatagagtaaacaaattcttcaatgagaatgctttgaagtcaagagaaaaataggctcagggcattgtgttacagcaaaattttgcctttggcaaaagttttacgatggaatagggtttttaaaatattgggaatcaggtaaattgcatggctaattgaactggggaagacagcttaatgagctcatttctctccttcaaatccaagaagtcagaaggcaagttttcatctattctttcatttatccaattagaacatatcgtccccacacatagggctactagaagaagtaatagttatgtctgatggctcttaggaagtattgtcaatagataggacctcctctgtagttataactacagatgatcaaattaaccagaaataaattttggtcataaatttcttcttgctccactctgtaggctacctcctccaaagcagatcgtagaccagtgcatttataaatcacagaatcaccttttaatggttatagactatatatagcatagtgacagtcatatactgctggtgctggtcaaacttgagatcaacaattctgttggatttttacccctctcttccttctttttcctcctcttccatattctgactttcaggtttgagcatgtaataacttccaggatttgttttgggcattatttatatattaccacttatcctaagattattttgagtcagataaaagtaagacattctattaagttatcttcattttgaagatgaagaaactaagattcatagaagtaaagaggactctaggagtaactaactgtccattgtcattgttaatgttacttaacctctttaatcctctgtcgtgaatccaataacgatcaaagtagtaggcaagtttgctgagggccaactgtgtgacaagcactttgataactgattggtctttacagcaaccttatgagagaagtattattactctcatattatgagtgagaaaaataaggattaaagaggtacaggcaattactcaagaacacagggctagcaaatcaagaaacagaagttagatgtgagatattgtatcacccaggcctaaaagatgcaatgaaacaacccattttaaatgtttaatatagtaaccagagtatactctcatttgatgagagtatactcatcaaatgagagtatgcatttgatgttacttttcacagtggcctttttgcggttaggaaacagcagcaccaataatagaactaagctgtctgactcccagcctgtacctaaatctctaacttttgattttatgaaataaatttgatttgcagatgggcattgctggtgagggaaatgtaaagaggtcaatttccccactttaaatttttttggctaaagacccatagctgacaatattttaatggttgccacatattcttcttttatgaaatgagtttcattttatatttgtaagtggtttttattgcaaatcatcacctaacagtcaattctgaagactttccataaatgtcaccttgtttgtgaattgttctcattctgtctcctctctaaattccctcaagaacaactttctttggacattaatatcattattaattgtgaattgtcagctaacagcttaacaattgtctatcatgctcctaatgcatggatgatacagagaatataaagtcaataacttgtatttcctgaaagatacatatacagaagccaatcatttcagtagagtgacaggagcaagattgaggtattaatagagtactctgagagatgagaagcgggacaactaccttagcctaaaggtttgcaaatgattgtggggaaaaataatctttatcactccaaaaagaatattacagtgatattttaattgaccatagagtttaacttgaccattgtaaaatgaccaaaagggtgaattattttttaccaattattaaaaagtagcactacctgatataaacagtgtgacctaatgtttacattcttattattttttctcctttttgtctttttctctctccccagctaagtagaaaaaactcactttgttttcatgctaaaattttggaataccattaaacagcaacacactggacaactacattcttatgttttatcttctccctttaagattgttaaaggaagaaattgaactagtggggaaaagtaaatactggccaaaaaaaaatgcttttgactagtgtatgttccaatgatgattatgaaatatgtcaaactgttctaaaatactaaatatgtgttactatttattctgtattaaaatagaacaatagaataacctttgttgtcccaatatgaaaatagtttttaacaatgttaatataaaacaaagagcaaaggaccattatcttggataaacagagagacattactttacatggtttgactcccctgattcataatttaacatgtaactctggcatatgctgggcacttagggaagtcacattaagtatttcacagcaaatggagagtgagaaaaatgattttcagaaatcctggtatttacttattataaatcttgtcttgaatttattgtactttacatgaaatataatttgataaaatgtaattggtttcagtgtgtatgcaaaatgagaattttctgatcattcagatatcaaaattaactttataaatacaaatacatataattacctattaaaattctaaggtgtatttattttaataaaagtctttatcaaacctagataaatctcatttatgattataaatgtaaaactcctaaatttttttttacttggctttatttactattaatgatgttgggtttattaaaaaatgcaagcacagactccaattagcctactaacctattgtataatttatcaattcaataggtcaaacaattaaatcagaacatttaataaaattgacaatatttttttatttttttacaaaaatccatattggttgttttgaagtagcaatttcttcttcaaaatgataaaaattgtctatgtaaaatcaatagtcaatactataaaagctgcaacattatagacattttcattaaaatgagtaaaaagataattatgcctatcacactactataccatataaattaactattatgctgaaaattctggccaataaagtaggggaaggaaataaatataactgtatatttaaaattatgaactaaatcttcactgttttacaggcaaaggaaaattctaatatctgataaaatctttaaagtcaattaaaaaagagtatactaaagaaaaatgaataattttctcaaaaaggactatatctaaccaagaactaggtgaagattggcattactagtatccaaagacataaatactaaaacagtaattgacatattatctaaaatcaaaatagtgaagatataacaattatgggcagaacacaagaaaatggacattctcagatattgctggtgtgagtatgagtttaatttttctagaaggaatttgaccatatttaacaaaatctttaaaatgtttatactctttgataatgtaatttcatctcataattttcttaaggtaatacttagatatatatccactcccgatccccaaaataaaatggaaaaaaaaaaactaaatgtgtaatgattgcagaagggttgaatgttattttatgagaaatataagaaataatgcagcaaaatacatgatgtttaattatacaaaactatgtagtaatacaaaatatatgatttttaataacacaatacccatgtatattcataattttgaaaagaagaaatatatgcatatacaaatttgaaagaaattatctcatgttgacattttgacttatcatttgctagtcaaattaccagtgcttttaattttctacctcctgcctttgttttataaagaatatttttattatgtctatagttatactaaactcagttcagttgaattgttatttaaatctatggaaaaaattttgctttgtccataaattgtatttatattagaaagttaaaataattaattataaaacatatatccaggtttttttatttgttccagtacataacagacctattacataatttgagtaaattttgtcttacagttatacaggcagttctctccttacacaattctgatatgcatgaatatcagttatcatagtttagttaaatgctaacagtcctccaacaacgtaactcaagtgttgggtaacattgaatattactgtgagtaattacataaacaaacattgctgctggctctgcagtccacaaattaccacataaaataacagatgcacattgtgatcagtgaccgatcacgtttatttttttcagtatctgttggtgattgcgcactacacatttatcattcagtttatttatagaagagaagcgtgtggttgtgttgcctccttgtgagtgataaacccgagtgacactttacaaacacagatattcaaaaaagaagaggaattggacagcaaagaggaaagcactgcaaagaaagaaaatacttgaagtaaaattcagattgaacctaagtggagtcatagaagaaatagtcactactgaggtttgagagattctgaatacgtagccagagctacttagtgaaggtaaacttaacataagtgagggaagtgcttgccacaaatagggtgaagatgtcctggaggaagtgacacccaaacacttcacattagaggaattctcacaggtacttcacaacactaaaagcataaaagttaaaatgttggaagctgattcaaacttagaaaggagcgtgacaattcaccaaggcatagaaaagatgtggccgggtgcggtggctcacgcctgtaatcccagcactttgggcggccgaggtgggcagaacacgaggtcaggagatcgagaccatgctggctaacagggtgaaaccccgtctctactaaaaatacaaaaaattagccaagcgtggtggcgggcgcctgtagtctcagctacttgggaggctgaggcgggagaatcgcttgaacccgtgaggcggagcttgcagtgggcagagatcatgccactgcactccagcctggggaacagagtgagactccatctcaaaaaaaaaaaaaaaaaaaaagatgcttgtgttcagtgtgataagttataggtgagatgaaggcaagcactgttcaaagtacttttagtgagtattttacaaaggactaaaacaacttctccaagtttttaatgttttaaattacagagtactaaataaatggtcatttttactggtttatttctttacatttataaccagcattggagagttgttaacatgttgaagttttacaaagtcttagagctatcataacctttcctgttgattattaagatcactttgcatgtttgtaacacaaaggttaaacacttgaggggatagatgtcgcattttccaagatgtgatgattacacgttgtatctctttttcaaaacatcccatgtagcctataaatacatacacctactacgtacccacaaaaattaaaaattaagaaaaaaaaagatcattttccatggttcaagtttgcatggtcacttttacaattccaccctaccatgcccgtaaatatgctatttctgacttacgaaatatttttcaaataaaatcattgctgacttttaactcactgatatgtgctttacttctggtgaaaggcctaacatatcaataaaatgaaagaaaatcacagctttattttctttactgttctgatattttttgttctagtgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggtaagtagcaaataaattcctgagttggtttggaggcctgtgtgcttctatctacaatgcatattattttaaattatgttattgctatcttatttaaggatgtactttcatacctttaagtttgaaaatcaaagctagttcaccaaatcttcctatttccaaatcactaggtagttttcagaaatagcactctagtcttaaactatatcttttcaggaaaaggattttgttgttgttgttttgttttgttttgttttttaaagagttcacaccatttgactaaaccacaaccatatttagaataactcgggaatgcttactttgaacacatatccttaaagtaagtttccttttgtcccctttattgtcctttatgtctggattctcatgtggagatggcattcattcagatttggcatggacactggtagtctgagaatactctttttgaaaatactaattaaatggagacgatgataatcaaagtcctgttctaaaactacaaagcctttgactagtcattgaaaaataccatccttattttgaaaggcaagaaatggccaacatctgaatttgtgaaatataatagcatatatctgatgggtttcaaagtggtactcttaagcatgaatccatttatcggctgattattgataacttaaatatcacaagatcttgggtaggtgctggggacatgaagatgaataagacaatgaattttctgtctttgggttattgtacagtgggaaagacagactattgaaaggaatgattacaaagttgtctgatgattgctaagatagggcaaggacagtaggagttaaccagttgaaagattaggatggtgaactaaggcttacaattagggaaacattttgtgcagtggcctagaggagggagaaaaatgacacgtttgaaaaaccataagatgggcaaatggctggtggtaagagatattaggaaggaaggcaggacaatatcatagaggactctggagccatgataaagcctttggcttttatctaaggtcaaggagatgacacttaagggttttatatgggaaaggggcataatgagttacttgttattaaaagatacacctggttataaagtaaaaaatggattggagaaggttagagtggttggggaaaactagttagtgaggtgctgcaatagtccaggtgagaaataatgtcagaatacatttcagatggtacggatagagagaaatggatccaagagatatttaggataaaaaagtgagtgttttgtgagcagagtgtaggcaagggaaggaaggagagccaagactgatacctaacattacattctagcttgagcagtaggctcaacattggtgccagccattgagatagaaaatacaggaggattgagatgagggaggagatggcaagttctgttgtggatatgttcactcggtttctaagagacataggagaaactcctgggggcagttggaaacacagttctgaagctctttccttcaaggaaatcctctcatgatgctttagagaagatcagaatcacttacacatgttagtgacaactatgcttatcatggtttataaatgtgtattactcctggtattatttagttcagattcctcttacctcctagactgtaagagagctttgtgaaagagatgcaatgggtattgtgtatttagttcactactgtattacacagcacttagcacagtatttggtacatagtaatcacgcgataaatattcattaattcataaataaaagagagatttctggattggagatatggatttgggagtcaacagcatatgtaaatggaaatagtctagaaatattataaatcaatttaatttttaactagctcaatagccaatatctatcagaatatgagttttcatattattgattattgattatttctgtagtcttcaaatattggagaaatttcaatattttttgagcaaagtacatcatgtttaaagggggaattgatagtcttgagttctacttcagcttatttcaattatcttatacactagtcacgttcactttaaaaattccttgtagtttaggttttttattacataatatagcaaaggaaatttgtaattataaattataaactatgggaattacctgatatatctaatatgtcaggctattctagtatttagtatgaaaagtacttggtatctctaaatataatgaatttctatttcaatctttgaaatgaaaaataatggccactaacataatcatttgtttttaattgtgttaactacagaataataaattatattaagagaagtctcccattttacatgattgagttctagaaaaatatttccaatactacatacctgcttgcttcttactgtataagtatcatctaccacatatgtagaaatttctcctgctgtattgagtttagataaagtgcctggccccagatataaagttttaagtttaggagcaaactctttccaaatgtatgggcccctataaagcacagctttttagaagtgtggtattatataacagatgggagtttaatgaagtaaagcacagtttgtaacaggttcattgtttcatatgctctggatcactaaattggcaggtagagatgaaaggtgcattaaaacggacgttccgaaaattatagaattccctcaaaggaatacagtctttaattttgaattatgcagctgattttaatgaattagaagtcataatgcataacctttccctgatgcaggaaggaactgtgagctgtgcaaggattactttttccgacaagttggtgcagatccttcggccatagatgtttgcaaaccctgtgactgtgatacagttggcactagaaatggtagcattctttgtgatcaggtgagtttttctgagtatttaaggtaaaggattactctgtctgccagaaacttatttggatgttattccactagtagaattgaagactgcatttgccaggaaatcctctatgtgcatttgcatttcaaagagatggttgttcgtgtgcaactttgagtatggacatgaaatatagcactagttcggtggtcctttgcatataaaaaggcttattttagttttaattttacaaatgtcaaaaaatcgaagggtaggggttctaagtaaattggggtatatgtcttggaattattggtgaattaatattaatacatgatataaataaacaagaatagtttctccaaaaattccatagaagatcatatagcaaaagtcacttacacttagggccaaatggaaattatgatagcctcgcttctcaatttcttagtctaactttccctcttaaaagtacaatggattttttataattttaaaactttctgtttacttacatcacaaatatcgatgtctagcctacatgcacacagattctaactaacctcagttcatgtatcctacctcaagcaggaaaacaggcttcttattgaagctgaagtttttcctgttctgataatactaataagtgaaaattgtgaaaatcggtaaaggagaaatttactttgaagaatcaattcaatgattgtattaattttaaacagttatatattctgttatgaataaataaggctaggagcataaaccacaatccagttatagaatatttgttaaaaagttatattgtgaacataatacacacaagacaaaatatctttctcctataattttgagaattcattaaaaattgctttcccaaataaaagacaaatataaaccaagacaaaatatggattcaaagaccttcagagtaaccatcatgtgtcaataagggggcattacatgcttcattagaaagctgaagagtagaaaaattattaataaagacaatttctactatttttattttataatattgagggactattttctcagaaagtcatactacagttttccatatattaattagtaaactctgactgtatctttagattatatttcatttttacacatccaccctgagttttcagcatggctatcttttgcttatcattcaaatattgatatatcatattttgagatatctttgctgaccacccaattacaaaacattctcaagtctttcatatcaccatgttactctcattacaggctctgtaaaattaatttatttgtttacttttcttcttctctctttccaacataaacagaacagtttcggtcatataaaaagcccccaataagtatttgtcacataaatgttgaatgaataaagagagattatctgagcactgatcttatagttagattgttattttaaacggtcattacaataatctgagcattatgtaaattttcacttgcagaacagtttttctccctgaaaatctaaggtcaagagctttgttatatagtataggaagactgtaaactatagttttacctcccagaatctcagttacgtgtctaacctacacgagttacagtgcatcagatttgtctctccatttcaccattcagatctacaagaaattgaaacctgatttttctgaactcaaacttctatttcaagtccgttttatagggatgctagacaaccttgggtggttctgtgcttgtaaataattaacaactgactaagaaaaaaaaaaggccaccataatcaatttcaatctaccagtgagatgtcactgaacatggatttcagaagaaatgtacttaatctgctcttatgagccagtgcagtgtactccagcatactactggctctagatttctttcttaacatcttataaagtggagctaattattggatggaattatgaaagactgtaccatttataagcaggatattagctgtagatagtgttattttttaagttggagaaatttttctctattcctagtttttctgagagtggtttttatgaatggtgttgaattttgtcagctgctatttctgcatcaattattatgatcatgtgatctttttttctttagtttgttagtgaagtagaatacattggttgcctttcaaatgttgaaccagcattgcatccctggaataaaaccacctttgtgtgtgtctttgtgtgtaattcttttcatatattgttaaattttatttgctaaaattttgctaaggattttacatctgtattcataagaaatattgctctatggttttgtttttataaattgtgtttgtttcattttgttattaggataatactctcgtaaaatgaattataaaatcttccttcctgttgtttttctataagaaatgcagaactggtgttaattactctttaaagtttaccccattctaatacatagtattctagtaaatacagtaccccatgtattagtccatttttgtactgctgggaagaaatacccaagacagagtaagttgtaaagaaaaataggtttttatttatttatttatttatttatttagagacagagtctcgctctgtcacccaggctggagtgcagtggctcaatcttggctcactgccacctccacctctggggttcaagctattctcctgcctcggcctcctgaacagctaggattgcagatgctcaccaccatgcctggctaatttttttcttttttttgtatttttagtagagacagagtttcaccatgttggctagactggtgtcaaatcccacccacctcagcctcccaaagtgctaggattacaggcatgagccaccacacctggccagaagaatagatttaatggacttacaattctacgtggctgggaaggcctcacaatcatggctgaaagcaaaggagaagcaaaggcatgtcttacatggcagcaggcaagagagaagtgccgagtgaggaacagggaaagccccttttgaaaccatcagatttcatgagaactaattcactatcattagaacagaatgggggaaactgcccccatgattcaattatctccacctggttcctcccacaacacatggggattatgggaactacaattcaagatgagatttgggttgggacacagccaaactcacacttggcccctcccaaatctcatgttctcaccattcaaaacaaaatcatgcccttccaagagtcccccacagtgttaactcattccagcattaactcaaaagttcaagtccaaagtctcatctgaggcaaggcatgtcccttctgcctacaagcctgtaaaagcaaaagcaagttagttacttcctagatacaatagcggtacaggcaatgggtaactacacacattccaaataggagaaattggccaaagcaaagggcctacagtccccatgcaagtctgaaacccaatggggcagtcattaaacctcaaagttaccaaatgatctcctttgactccatatcttacatccagggcatgctgatgcaagaggtagctcccacagccttgggcagctcggcccctgtggctttgctgggtacagccctccttctggctcctttcacaggctggcattgagtgtctgtggcttttccaggcacacgatgcaaggtgttggtggatctaccattctgaggtctggaggatggtggcccccttctcacagattcaccaggcagtaccccagtggggactctgtgtggggggtctgaccccacatttcccttccacactaccttagcagaggtacttcattcattagggctctgcccctgcagcacatcctctgcctggacatccaggcatttccatacatcctctgaaagctaggcggaggttcccaaacctcaattcttgtcttctgcacacctgcaggcccaacaccatgtggaagctgccaaggcttggagctgccattctctgatgcaatagtctgagctgtatgttggtcccttttagccatagctggagcagttgggacacggcaccaagtccctagactgcacacagtgggggggccctgggcccatgggaccattttttcctcctaggcctccaggcctgtgatgggaggggtgatgagacatgtcctggagacactttcccccattgtcttggtgattaacatttggcttcttgttagttatgcaaatttctgcagccaacttgaatttctctccggaaaatgtgttttgcttttctactgcattgtcagcctgcaaatttttcaaacttttatgctctgcttcctctttaacacttactacttagacatttcttccactagataccctaaatcatctctttcaagttcaaagctctgcagatctccaggggaggggcaaaatgccaccagcctctttgcatagcaagaatgacctttactccagttccccacaagttacttatctccagctgagaccacctcagcctggcctttattgtccatatcactatcagcattttggtcaaagccattcaacaagtctccaggaagttccaaactttcccacatctttctgtcttctgagccctccaatctctttcaaactttcccacattttcctaccttcttctgagccctcccaactgttccagcctctgcctgttacccagtcccaaagttgcttccacttttttgggtgtctttacagcagcgccccactacccagtactgatttattgtattagtccattctcactcaactataagaacaaacctgagactgggtaatttataaaggaaggatgttaattgacttatagttcctcagggcgggggaggcctcagtaaacttacaatcatggcagaaggggaaacaaacacatccttcttcacatggtgacagcaaggagaagtgccaagtgagggtgggggaaagttccttataaaaccatcagatcatgtgagaactcactatcagaagaataggatgggagaaactgcccctcatgattcaattatctccacctggttcctcccatgacatggggattatgggaactacaattcaagatgagatttgggtggggacacagcgaacacatattgctccagtaaaactatctcagatttctttggaaacagaaataatttattattaattcaaaattaaatactacatatatatgtacatatatgtgtgtatatatgtatatatatagagagagaaagacagagagagagatacaaggaaatgagagtcatattaacatcattaggaatttaatattactagaagacagttcagaataaccttaaaatcccaaaagaagacattttgaagaaaaacttgatactcagttctatccaagctatggcaccaacatgaggttaagattctttttgtacgagagatggtcaaaacattaccattcataaccccatattaaaatattcaatatgcaaagtgaaaaaggaatgtaagactggggacaacattaaacaaaggaaatgacaaacaattatgatccaaagaaataaatacataagtcaaaaaatattttcaaagtatccattggtctttatggtctgcaaggatagtttccttacatacatgtttagtaattcaattttatttaagatcaaatcacaattttttgtgatttgagataaacaaataacaagtagagggctaaaaatactatatccaaatatttcagtgagaaactggatgcttttttcctaagatcaaaagcaagataacaatatcccataacattgtactgaaagttgtagccaagaaaatgaaataaaagacattgagactggaaaaagagaagttatttgtatttgcatatgccattatcttatagatagaaaatcctaaggaattaattcaaaagtattaaaactaataaattcaggctgggcgcggtggctcatgcctgtaatcccagcactttgggaagccgaggcgggtggatcacgaggtcagcagatggagaccatcctggctaacatggtgaaaccccatctctattacaaatacaaaaacaaaattagctgggcatggtggtgggtgcctgtagtcccagctactggggaggctgaggtgggagaatggtgtgaacctgggaggtggagcttgcagtgagctgagatcacgccactgcactccagcctgggcgacagaacgagactacatctaacaacaacaacagaaaaaaacctaataaattcagcaaggttgcagagtacaatatcaatacacaaagatcaattatatttccatatatttgcactgaacaatctgaaaataaaattaagaaaacgtcttttaaaaatcaccaaaagattaaaatatttagaaaaacatttagtaaaagaagtgtaaaattatattctgaaaaccataaaacattgctgaaataaagaagaactaaataaatagaatgacacccaatgctcatgtatcagaagacttaatattattaaattaacaacactctccaattgatctacagatttagtgtaatctttgttaaatgcccaccttacttctttgcagacattgaccatatgatcctaaagtttgtatgaaattcatgggactcaaaaatgtccaagataaccttataaaaaaagagttggaaaactcacccttcccaatttcaaaatttactataatcaagacagcatggtactgggataaagatagacatagagacatattcactgaaatagaattgagaatttagaaataagccctcatatttatagtcaattgatttttgacaacagtgccaagacagttcagtggagaaagtgtagtcgttttaacaaatggtcctgggacaattgtgtttttatatgcaaaagaatgaacttggactcctaccccacctcacatataaacaaattaattcaaattaaacaaaatattgaatataaaagctaaaattataaaatcttgagaagaaaatgtagatgcaaatcttcatgtcctcggattagccagtggctttttagatatgacaccaaacgcctaagaaacagaagataaaatgtgtaagttggacttcattagaattaatatttcaaagcacaccaacaagaaagtgaaataaacaacccaaagaattagttgcaaagtatataataaatctgtaataatgaagaaaatatttgcacagcatatatctgataagaagcttgtctagtatatatgaagaacttgaagtgaataatcaaaagacaaataactcaattttaaaatgcgcaaataatctgaatagatatttctctaaggaagatataaaattaccagcaagcacataaaaagatttttgacattagtcatcagggaaatgcaaatcaaaactactgtgcaagcccacttcccaaccagtgggatgactgcaactcaaaaaaaaaaaaaaaaaaaaaacagacaaaaacaaaatttggtgaggatgtggagaaattggagtcttctcataggctgcctgtgagaatgtaaaatgtgcaccgactttggaaaatggcttggtgtttctcaaaatattaaagatggaattaccatataacccagaagtttcactcctctgtatgtatcatatatcctcataaaatcttattggtgaatgtcaatgccacattgtttgtaatagtcagaatgtccatcaactgctgaatgaatagataaaatgtagtataatcacacaatggaatattattttacattaaaaagaaagaaattactggtacctgctacaaaatgtgctcaagtctcagaaattagagtagggaaaggaagacggacgaagaatagagaaagcttgttttgttttgtttccaagtgcaaaaatctgttttaaaaatatatggaaggaaagacatgctttaaaatgttaacttttttggttttaaaaacatttttccttttatataaacttttttctctttccaaatctgctttatttataacttttatagtcagaaaaaaaggagaattttcattcaacctgatatatagccagagagaattacacataagaataggaatgtaaataagaatgatagaactgttttctgactttaaacccccacattgtttatctttaaatcacattcatatattatcttaatttttattattttctcatgctccaagtatagagacaaagtttatggagtatcgttacatgtggagatattgtgtcaagtctaccttacctaaataatgttataaaagatttcaaaaaatgtttccagacattgtcaataggataacagaacacacacttaaaaagttgtcaacagtgtcagaattataaactgcaaaattgaattcaaggacatttaaaaaattcatgcaatttcaatccttaataatattagggagcacacaaggaaattaggcagtagttcaagtctcattttgttataataacttaggaatgaagccagccccaaatggcctgagtgactgtgtcgtgcgctctatgttctggaagggaactttccctttggcacttgtcatttgaaactcaatccaatctcataagatatggcatgtttgccttattcttccataagaaatgttgttgtaattcttccttatgtgaatgccaaaatcttgagaggggcataaagtaatgctctgagtcactgaatcctaaaaatactgatgccacagtcaagacagagagaacatctaaagcacagtactaatattaataggagagaggaaaatgaagagtaataatgattattgaggaataactaacatggaatccttggatcccttgggttactatatgagtgtatattttatgtctgtataaattgagtaggatacaatttatgtctgtgtcatacaactgtaagtctgtgtatttttccttttttttttcttttgtctgtatttttgagggtgagagctttcagtactttcatcagatccaaaagggatacatgaaccaaaaaagatgataattatttcaccatggaaaagaagtctatcttatgaacaggctgggttattagttcaggtacatattatgtgagtttttcaggataccactgcacttccttcttgtttgcttgaacttaatgcatgaattacttgacatgcatcctgagttggaggttaactgtccttttccatttcctcatctagtgtgacttaagttcagatcaatcaaatagagtcccaggcctagatgatgcctcttctgtactttgacatatctggagaagggtctgtgaatccacacctaaagtgcatacatctagagatctcagtctgatcctgacccaaggtgggagtgagccgcttgtctccatcctttccctccactgaccccactcctccacatattttctggtagccccagagtccctgctatagccacctccacaggtgatggtgataaggtagggagaccggtgaaagtccctaacataagtccctagcatatggcctgactcatgtagaatgcattcaagaaatattgtctgagtgctttcttgcttgggacttttttcatccctgctaccttctctcccgtttactttgcttgttattgggttgagctgaggaagccatgggggttcagccactgtagtcaagatggtggtcatcagctagggtagtcctcaaacttttaatgcacatgtgactatcctaggtatctttttaaaagacagattctcattcaggaagtttggggttggggctcagattttacatgtgtaaaagttcccagatgatacaattgccgcctgtctgtgaaccactttttgataaccaaggagttagaacactgtatatcaaagatatgtagaccaaagaagctgaatgtagatgggggtaggggagttgtgagtgtgtactcacgagcacatgtatactcttggtcagttgtgggtttactttgctccatcctctgaatcccatcttaaaagcaaggattttccaagtcatccaaattaagttaggcttgaattgtgccctgggctctacctttaaaattagagtatatcacctaatagccatttttaaaaggaaataaaaacaacaaataagggaattaaaaagttgtgtgaaaaccaaaaatatagttgtaattatataaaaagagagaatagcagattgtaatgctcaataaagcatcaataggttactgtaatagcaacagaacagaaataaatgattaagagatatttaaaaatagattaataagaaaggaaactgaggttgaaatgaattagacgaaatggaaaggcatcagtgaaagaagcatttctaggtctgacctatggaagatggaataataaggaacagagaccctactcatgaaaattgattgttctggtgaagtgataattttcaaaacaatacatttaaaatttgaacagaatatactttctctgcataatgtaccatttttctgcagttcattaatggtttctcttctgttcagaattaggtatttgtcattaattaccataacatgtccaaaagtcatcaggtgaacttccctgaagtatattcttatattttgtatgactcaaatattaaagtgtacaaatagaaaaaataagtattgcataagtttccttagcttatgagaaacctgaccatgaatagtatgatccatggatattggatgtatacattgaggtggtgaaggatgtgaaaagaggagagttttcccagagcttcaatagagacagaaaggtcttggcacaagccacgtggtctctccttcagagaattagggaagtttagtagtaatatttctcatagagctggtaaattgagtaatatctcattattctgagattgtagaggatgagattcacaaagacaggaacaaaggtcctggggtataaatgggaaaagaagggaaaaattaatcttagctggataggaaggttagtattgagggagttatccaagaatcaaggttgtgacaaactgcctgaaagtaaaaatagatggagttgtaactgagatgaggtcttagcctccagtttatgttgagttccacatgtttgaatacatctgacatctttttgggaacaagctcatcacaagggcccaggtatacaaaattggccaaataccaatacctcaggcatttaaggctagattcaatagccctaaatagccataatagcactagcagaagcattaggtagtgtctggatattggaagaactgatttaactagtaagtgcaagataatgtgatacaaggcccattgccttgctaccaatagcaatgtagttagaataggctaaacagatgtaacaaacccccaaatatctagtggccaaaacaatatacaggctcatttgttgctcatataacctctccaagacagctgttcctacctccttgttggatcttctctttgtgacaattcagggacacatgctccttccattgcctggatatgcctttaactagggaaggaaaagacaatgtggaaaacaacttccacttttaaaatgctttggtccaaaagaggtgtgtgtcgcttctgctatcattgccattgatgatagctagtcacattgctaactagttatatagaaggctgaagacatgtagtctctagctgggtaaccactttgcagctacatttgtgtactattgaagactagggagaatgagtcttgatggggagcatgtcatctctgcttaatactcatgcaacagaaggtagcccaagagcgaaaggggcattctcttcttttctacacacagaacaggataacttctgtttaatgaggacctctgagaatagagtaccccatgagcatctcaggggtgccaagccattaatattggtgggactacctgcttggaggtggaccctgtaatattggtagatgcacctgtgaaagcacatatcatagcagcatgtatcagcaagagagaattggacataggaggagaaacagcttgtgtgcaaggttaaaagatttgttcatgagcacatgtgagagagaagccccaggaacaaggaaatgagaaaacaattactgcctcctacatgttcccagaggagggggctgggagagcaattaagcataaagagcattaattgcatagaagatgctgagggatcatagatttgaaagcaatttcaaaatatgagtattttaagacttttagcaagaacagacaccataggctgtatatagtttcctggagttatgattaaaggatgaaaacaacttttgtttagatatgtaggtaggtaagtaggtagatatagatagatatgagaatagtaagtttgtttaaacaaattattcattacatcatagtgacccttagtgctttttgatgatactgactgatatggtttggctgtgtccctacccaaatctcatctaatagctcccataattcccacgtgttgtgggagcaacctggtgggagatgattgaatcatgggggcaggtctttcctgtgctgttcttgtgataatgaatgagtctcatgagatctgatggttttaaaaatgggagtttacctgcacaagctttctctgcctgctgccatccatgtaagaggtgacttgctcctccttgccttctgccatgattgtgaggcctccccagccatatggaactgtaagtccaacaaacccccttcttttgtaaattgcccagtctcaggtatgtctttatcaccagcgtgaaaacagacgagtacactggcttattgaggaacagaatataatcagcctccttcattcctcactcactaaaccaatgtgctgatcatttctagaggcaaggacactccaagaatcaagaaagagccgatgatgaggctttctattattctcctggactggacgttgtctcagcttctgctgggccatagaaccctgcctctaccttgacttacccacatgttgttttggtgccaagtattgagtgctgcattttggggtgtacaagacagattggcatattgctaaaaatgtgcgaggacagaaatgacagaaactagtctgtaagattctcataggttccacttgtcttgcactcgtcatgtacaaaaatatgccaagcattgtagttcattaattcagtccttaccaaagctggtaaagcagttattaatttatccactgtaaagttgaggacatccagccttttggaaattaaataactcctccaatatcacacaagtaataaggaggttgtgcagaaattgaaaacttgtgaatttccaaagctcatgcccagctggaggttagagacatagggttcctaccaaaaatgtgttcctagcactcagcatagtgttcagcacttaagaggaaacctacggcagattgctaaactgggtatttacttacactatccaaaagtaggaaggaaacatacccatttgtttgtgaattattgtatcaaatcctattaatttcatcctaaatattaaataaaattcctaaataggaaatagcaatgttcatataaagaagcagcaaattaatttattggaatcgacacattcctcaaatggagatttggttgatattagagacttaatgtacctcccttagtgcttaatgtataacagagattccacttatcttacctatataacctaagaaatttgaatattttataaagttactttttagaaaacctgatttatttgttttccttgtcatctcagatggataccttcctctcaaaatctatttggaatttatattttcaagtattcaattaactaacatattaagcaggcattctcctgtgtaagttcctagcaacttttaccacttgtactaaaataaaacagatagttaagccaaatgagttaacttttctgaaagtgtatctttatacaacattaactatagacatggaaaatacatttattcacgttagaaataaatgcttctgtgagatctttcattttgataaagtcaaaacaccatcttattaataactactatattaattttgcagcaaattacaataagaccacactgtatagttgtgccattcagatgacatttatgaaatgctctaatttaacatggtgacatatattacctgcatcttttacacattatagcttatatcctctgagcgaaatagacctaaaccatccaaaaaaaaagagagagagagagagaataatgcaatgggaaattatacccctttgagaactagaaggactataattacattgcttcctcttaaaaccattcaaatatgtaaccattgctgggaacagcagtatgtggggaacctctttacactctttctgtcttgaacactcaaaagattgagaaaaaaatattcctttcctactatagttttatttgagcatgcttcagaattttacctttttgcacactccttagagattatcgtggggaagtttagaaagcagtttcttggaaatgccttttggaggggaagaggagctataaaaatataccagcctgacaaatgacaggcattgtagactggaaaagaaaagacatcttggttttacaccaatgtagaagcttttctttgcaaatgagtatttttgacagctgagcaagatgataaacagaagtatcacaaaacacttaaatggaaacaagtattatgatgtactttattcacctggcattctccaattcatgacatttatatgtggcagaacccactgcagattcatttatttatttttgaagtggaatgagttccttacgaaggtagcctgttacattaatgtggacttttcttctctagatgcagaagcttaaggaaaaaagttattgtatctgtactataaataagtggtaagtctcagaatccacatcttagggctgagaaggctcctagcaagtacaatatactgtataaatatagacaaataaatatagatatagattttttgtgtaagcaccggcagtgttgcaaatgattagatatttcataaatgccttttctaaaaaggtattgctgaaaccagtctatttctagaacttatattcagatgtttagaggtataaatgcttcaatattggctaagcttagaaaggctatgtttctctgaggctcagtgatagacataccaacaatttgatgagatgcatgactaagaagaaaaagagagtaagactgagtccctgtgaattgattgacttggtgcagtggcagagtaggtagcaagtattaaagcaatagttcttaaatgttagtgttcataagaatcatcaacagaactttttaaaaatgaagattcctaggttttaactttagcgacttttaattctttaggtctggtatatttggttgtgggaaatcaaaagactcaacttcggaatacactgaacagttgctgactatagatttgtatattcaaaattttttggtatttaaaaatggtatgtatggtttattgagtcaaatattttaaaaactatgaatgtgtgctggtttgtttttttttttttttctggattggaggacaatttggggtaagcattctctatttaacaagtcataattaactccctgccaaaactaagtagaaattgtgatttctataactcctatatttgataatatctcctaaaaatatttcagtgatatagcatttaattgcaaataattcatctagtcaccaaacaaatgtagggacgttcctatataccaggcactgtgcatatcaaggtgtatattacagtgaataacagaaacactcacgaagtgttcaattgaatttaaccttgaaatgtattatttattattattatgtttaaataaactatgtgaggtttttttttcattgccaatgagaaacccaccctaacttcagaatttttatctttaagtatatcctattttaaccacccttacccatccactctcaatgatttctcctcagtgtggggccttgccgtggaagtgtgccctggtcagtgagttttgagagtccgtggaagctagattgccctcggctcttcagttcccactgcagaactcttgcagtcactggctattggatcagcagaacctcttctattttcagtcgcccattttcaaattggctcactgaactttaggttctccagttttcaggtctttcaaaagtccgacacccctttactatcatctgctttctcctacacaggggctaatgccatgcaggttttgtgactgctggtggtgtgttcctacctgctttttttgggaggcttctgggcacagctggtcacctagtttcattataatcatttttaatggctttgctgttgttgtgttgctgtttagttctgtcagcttttatcctgggatttagagagacccaagagttctgtggccacataaccattgatcctgattcccctggagtctcttttgacttttactgcctaatttaagctgaacatatgaaatacatgaaaaaactgaaagctcaagctcgtttgttgtttgtcttcctaggttatggtttccatttctccctctttctcaacctattttgccaatcaatgtctatccttccttcactttttgcctactcactacaatattcaattacacaaacataatttttcctctgcccaccccagcaccagcatttttctgggagtttaagtctcttatgaatctgggaagaaaggaactaaaaatgagcagggatgaatagcaaaatgagtgagtcaacgagtagcaggcaggacattagagtgaagctgttttcttacccagaagactgatgatgggaaaggaaaaaagaacaattcaaaattagtagaagaaaagaaataattaataaaacatgagtggatattaatcaaatagaaattggacaaaaaatagtgaaaatgaacaaacgcaatagtttgtcctttgaaaaggttaataaagttgatgagcagaaaacacaaagtaccaacatcaaaaacacaaattaccaacatcagaaatttaaaaaagagacatcaatgtcgttgcacattttataaacattaaaaaattacagttttatgaacagctctgctaataaatctgatgtcctgaatgaaatgaacaaatgaacacaaaaccaacaacaaaaaatagaaatagcctcacatatattaaagacatttaattcatatctaaaaacctttcaacaaggaaaatctcagtcccaaatggcttcactaatgaatttgccactaacataaaggaataaataatattagtcctacacaaactctttcagaaaaccaaggaagggcatatatttctcagctcattttgtgagggctacctaactttaatcccataacctaacaaagcactaaaagaaaagcccattagaatattccatatgaacatagatgtaaaataccttaacagcatattagcaaatggaatcctgcaatatataatagggtaatgcatcatagctgattggatttctcccaggaatgcaaagttagtttaacatctgaaaatcagttaatgtagtaagccacataaatagaatacaaaagaattcccaggtaatcatctcaatagatcaaaaaactttgaaaaagaattcaaaacactttcatgataaataccctctgcctactaggaatacaagagaacttcctcaaactgaaaagggcatctgcaaaaaccctatagctaatattatgttaacaataaatgttaaattttttaccactacatcaggaacaaagcaaggaggtttgctcttataacttctactaaaaattgtaacagaagtctaaagtaggacaaaatgaaaaaacaaaaagccatgaatatcaagaaagaagtaagactattattatttgcagaaaatatgccactgtatagacagtgggagtataaaaattgcttggcaagcatcaagtcccccacatacaatcccctcctcacactactctccttcgtaaagccatgaaaaaccgctttatattctaagtaaggacgggatgtttgatgtgcaaatgcagctgtaagataaatccctgagcaacatttttggccaccctgcccttcctatagaaagtctggggctgtcactgaggtagggttagtaatggtatgtgagactggagagatatgtggaaaccacctcatggtatttggtcttcactagttaggcaatagggagctattgaatatttctgagcacaggagtgacacagaggtgtaccaagtaggtaagaggcagtggaaacaatctacctcagtggggaagagtattgtatcacaaaatttgtttagaattgctagtacttggtgataattaaaagcaaaacaattttaactgaatcttattattttaattttacttacagaaagtgcatcctcttttgtgtacccaggtgtttcattctcaccaccttaccgtaggattattatcatcagaattaaagtagatgaggcaaggcacagtggctcatgcctgtaatcctagcactttgggaggctgaggcgagaggactgcttaaggccaagagtttgagtttatggtaagctatgttcgtgccactgcactccagcctaggcagcagagtgagaccctgtctcttaaaaaaaaaaaaaattggaatgaatgaaaattaattgatagcagtttattaaatggattagggagaggaacagactggtagatatcattcagtatacaatagctggttagtgatggcaattctgaaagaagaagtggtagaaactgggaggtgttgctagtgtagtatgacctttcaaaactcacagagtgcatagcttgtggatgtatagaacaatgtgaaagaataaattctccagaaaggaagaagaggagttagagattttataaaagagaagtctatgatgttctctaggaaagaaaagaattttctgaagaatatatgcattgattaaatgatttccttttgccctcatttatatttattttctgttcaaatgaaacacttaaactaacactcaatttccgggacagatttcctgttcttacattcttcaatttgctttttaaatttttactttgtttagcaatatcaacattgcctcattggcttttagtgagtttcttgagaagatgtaatctatagaacattagttcttctctcccaccagacagatgagtgcatagaaagacatatagttatactgctgctgttttaaaagtgttgcttcaaattacctaaaatatagtgactattagataatcactgataaaaactgtgttcatctaatttattcatcttgaaatcatgcttcatatttcctttaagcacaaaatagttatgttcacacatgcacaataaatcatatatggattacttgatgccttgaattcaccctcatagaattttatctcctaatgtaaagaaaactgactggggtaattattgcaggatcttactcttttctgttgtgagtaaccttcccaccaaactcattgtgacaattgtcacccggttgactgtgcatatccaccattgctccagagcctaggccagcagacttttgctgcatggtccaaaatggtgaggtcctgggtgtgatcacaaggcaatatgcagcaaacattagtgaccatcagtgctaacaaagaaacttacaaagtaacaacttgaccacttggccaattcttccactgtgttttcagctcttcacaggtgtaggccatgccttaaacttaattgagtctagcactcttcctgttactattattatatttgtagcttatgataagcagagtgaatttaacataggggttatgatcatgcatttgagagttgggccacttagtaactgtattagtccgttttcacactgctgataaagacatacctgagactgggtaatttatacaggaaaaatttatacaggacttacagttccacatggctggggaggcctcacgatcatggcagaaggcaaagaggagtaagtcacatcttgtatgggtggcagcaagcaaagagagagcttgtgcaggggaactcttgtttttaaaaccatcagatctcgtgagatttattcactatcatgagaacagcacaagaaagacctgctcccatgattcaattatttcccactgggtctccccccacaacacataggaattcaagatgagatttgggtgaggacacagccaaaccctattggtaactgcaccacctttaataagtaatttgatctttctaaggtttaaattcttcttctgtcaaatgaagattcatgtattttcacaaataataaaatgacgaaaattcctgccactatggagcttacattgtaaagtgatttggggagttggaagagaaagaacaatcaataaatataaaaataagtaagtttatttactaagttaaatgctataggagaaaactagacaaagtaaaatgccttgagagtaccatattaaggaaaggaattgcagttttggaaatgtagccaagagacttttaattgaaaagatggcatttcacttgagacctgaaggagatgaaggagttagtcatgtggaaatctggaagaagagacctaggcagaggcagcagcctatgcaaacaccataaggtggaagcacccctgatgtattcagaaaaggggctgtatagctgaagtgagcagaagaaagagtaggaatgtcccaagcctacgggatccttgtgcaagctgcaaataattggtcctttcactttgcaagtactgccccacatccatcaaatactttagaaggtttgaaaaaagtttgactatcaatcacttgatgaattttcctgcccactatttgctctataccagtgtgaaatgtacagagtaatacttccacttcatctttaccgagcacttactatgttccagagatgatgctaaacatgtttacattaataatctcagttaatcctgacaacagacctatgaggtagatattattatgctcattttattgataaatacgtgaagacttcagtagatttaagttgttcagagtatagttaattctgtggctagtaattgtggcacataatcctaatgttccaggaatttatatcatttagttgaggagacactcctcaactcctgtctcaggtgacaggagtaagtgaaattctaaggcacaatatagcatggtgcataagcaggcaggactgcagccacagaaccctcaattttaattcaggctaagtcacttactttcccttttatgttagagacgtctgttagtttttctacaggaagtataatacctcacagggtaatttattcacaaatacgaaaacatgtataaaacatcatagcagtctgcctgcaatatcgtaagtgttcaaaagggttgtggatattattattgttgttgtaagctaaggaacgctagaaaaacatcaaagattcaattactcaaaataacttttgctgagcatctactacatgtaaaatatgtatactgtgggatcaatggatgatgtaaaggtgcaaaaggttctggcccttggggagtgtatggtacactgggaagttatattttcagacaagacataataattctaatacaagctagaccttaaggaattgaatgacagaggtaacaagaaaatgctgtaaaatggctgaggagagaaaaatcctctaatttgggaggagctcagtattgacaaaggctagaaatgggtagagaacactttcccaaaagagatgtcgtggtgcctggtgagacaggctgtgaacttgacttctcccatccgttccattattaatgtgtgtctctgtgctctagcattcatttcatcttgtggacatgctattgtttccatttaaaaactctcttgatcacaatttcttctgtggcgatggtctcatgtcctgctctcctttttggcaaaactccttaaaagacttgtctaggctcatgcctccaaatcctattctgctattatttcctggaaatatatctgtcaggccttcactctcatcattactttgcaacttttcttgttaaggtctccaaggacctctgtctttttaaacaaagctaaattctgtcttcattgtatttgacatacaagcaggatttgacacagttgatcactctcttttcatttagaggactccacattctccgggttttcctcccatatccctgactatttcttctgtatcctttttctgtgccctcctcttacctttgaacacttattgttggagtgctctggaactctctttagaggactttcctgtatctacgctcacgcccttggtgatattttacttcaaataccaattatacacagacaatactcaaatgaatttcacaatcatatttccaattaaacacttaacatgttttatatatatatataaaatattatttgaatttaattatctttatcttcacatcaatacataataatctatcagcaaatcatgttggttctattttcaaaaatatccatagtctttcattcttcctagattcaataattcctttgcttgtctatttagttttctatatgtcattaatcttcctcatgctgacgtctttgctacatgaatatatacatatatatggtacacatacatatatattttatgcacacacacatacatatttatgctcaaggacctcctgccctgctatcagcctagagcttttcatatacctctacatcctcatttcctgaatcccatgccttccattcttgttgctgttgtctgtttactttctttttgctggaactatattactcaatagcttcctgatataggaagttaaagttttgaatccttgcaaatccagaaaatgtttgtattctttctttacaggcaaccgataatataacttagcatagaattctggattagaaataactttactcataatttggaaggtaccattcttagctttttagtttactataatgttgcagaatactgcagtgatattctgtattttctatgtgacttatttcattggtctctggaaatttttgtttcctttttatttttggaatttgaatgcttcatgagattgcaccttgatctgggtttttccaccagcatgtggtgagcctttttttttaactttttaatattttatttttaatcaatcaacacataatatttatacctattatgggatacagagagatatttcaatacatatgtaaaatgtgtgagtatcaaatcagtgtaattagcaaatccattaccaccaacctgtatcatttctttgtgttgggaacattcaaaatcctttcttctagctatttgaaaacatataataaattgttgttaactatagtcaccatacagtactataaaacacaggaatttattcttcttacctatctgtgattttgtatctgttaaccagcctctccctatccccttctccctgctatccttccaagactccagtaaccactattcgaccttctactttcatgagatcaactggtttagcttccacatatgagtcagaacaggtaatatttatctttctgtgccaggcttatttcacttaacataatgtcttccgggctaaacataatgccctctaggctaatccatgttgcttcaaaagacagagttttattccttttcatggctgaatagtatttcattatatatttatatatgtgatatatgatatatatatatatcaaattttctttatctattcctttgctaatgagcacttaggttgattctatatcttagctattgtaaatagtactgcaataaacatgggagtgcagatatctcttcaacgtactgatttcaaaacgtctggatatatgtacccagtagtgggattgctgaatcatatggtagttctctttttagtttttttaagtgaccttcatacttttttccataatggtatgctaatttacattcctaccaacagtgtataagaattcccttttctctgcatccttgtaagcatttgttattttttgtcatttttataacatattttaactgggaaaagataatattgtggcttttgtttgcatttgtctgatgattagcaatgttgagcattttttcgtgtacttgttggctatttgtatgtcttcttttgagaaatgtctgtccagaccatttgcacctgttttaattggattatttggggccattgagttgattttcttatatattctaggtattaaacatttcttggatgaataccttgcaagtatttttccattctgtaggtcgtctctccactttgttggtagtttcttttgctgcgaaagggcattttagtttgatgtaattccatttgcccagaccaatgtcctgaagcacgtctcctaggtttacttctagtattttcatagttttgggtcttacgttgaagagtttagtccattttgagtggatttttgtatatggtgagagacgggggtctattttcattcatttgcacatggatagccagtttccccagcaccatttattgaagaggatgtccttttcccactctttgtttttggtgactttgttgaaaacccgttggcagtaaataggtggatttatttctgggttctctattctgttccattggtttctgtgtctgttttacgacagtatcatgctgtatagctttgtagtaaattttgcagttaagtagtatgatatcctcagtcttgctctttttgaacaggtgactttgtctcaagattgatttgtctagctcagtggggtggctcacgcctgtaatcccagcactttgggaggctgagttggacagatcacttgaagtcaggagttcgagaccagcctgaccaacatggcgaaagactgtctctactaaaaattcaaaaattagcggagcatggtggcgggcacctgtaatctcagctactcaggaggctgatgcaggagaactacttgaacccaggaggtggaggttgcagtgagccaagactgtgccattgcactccagcctgggtgacagagagagaccccacctcaaaaaaaaaaaaattgctttgtctattctgggtctttatggttccatgggaatttaaagaattttttcttctatttctgtgaagaatatcattagtattttgataggaatcatattgaatctgtagattgcttttgataatacagtcatttttataatattagttcctctaatccatgatcatgggatgcctttccattttcttatgtgtcctctttaatttctattataagttttatagttttccttgtacagaacttttaccctttggttacatttattcctcagtatttttgtttttttagctatcgtaagtgagatttcatttttacctagtttgtgcttgttgtataggaatgctactaatttttatatattgatttgatatcctgcaactttattcgtttagtttatcacttctaagagttttttggtggagtgcttagtttttattacatataagatcctgtcatctgtaaaccagaactagttgacttcctcctctccaatttgtattcctgttatttctgtctcttgcctaattgctctggctaggaatttctagttctaggttgaataaagagtagtgaaagtgggcatcaccatcatgttccagttcctagaagaaaagttttcaccttttctccgtttaataagatgttggttgtaggtttgtcatatatggcctttattattgaggtacatttcttccatactaatttgctgacagtttttagcataaagggatgttgaatttcatcaaatgctgtttctgtcttttgagatggtcatatggtttgtccttcattctgttgatatacttttatttatcccatttattcaatttgctcatattgaatcattcctacatccttggtataaatcacacttgatcctggtatgtaatatttttgatgtgctgttggattcggtctgccagtattttattgatgatctttgcaactatggtcatcaggaatattggcctgtagtttttgctgttgcatatttggttttgctatcagggtaatgctggccttataaaattagtttagaagaatttcctctccttcaattttttggaatagtttaagaaaaaatggtattagttcttctattaaagtttggtagatttcagcagtgaagccattgatcctggacttttctttgttgggagactcttaattactgaatcaatctcattacttgtgagtgttctgttcagtgttctattcctccttggttcaattttggccagttgtatgtatccacaaatttatccatttcttctaggtttttcaatttgttggcatatagttattcataatagtctccaatgatcaactgtatttttgtggtttcagttgtagtgtctcctttttcatttctgattttatttgagtcttttttctttttttctcagtctagctaacggtttgtcaatattatctttcaaaatatcaactttttgttttgttgagcttttgtattgtttttggtctcaattttatatccttcttctctgatcttttttatttctatattgtgccttgcagaggacctttctagttaaatacatttgggaacttttgagcttcctggatctgggtatctatgtctgtcccaagacttaggaagttttaagttagtatttcattaataggtttttattaccctttttgtcatcttgtctttctaagctcccacagtatgaatagctgtttgcttaatggtgtcccacaagtcctgtaggctttctttattctttcttattctgttttctttttctttctgtctgcttgagttatttcaatagacctgtctttgagttcataaatcatttttttctgcttgatctagcctgttgtcaaaactcttgattgtatttttatttcattaactaaattgctcagctccaatatttctgtttggttcatttttatgataccaatttcttgttgaatttctgatttagatcatgaattcttttcctgatttttttcagttgcatatctgtattttcttctatcttgctgagtttccttaacatcattattttgaactccttttctggcattttgaaaatctcttttactttggggtctgttactagaggattattgtgttcctttggtagtgtcatgttttcttgctttttcatgtttcttgtgttcctacattgatacctgcacatctggtaaagtaattgcttcttttaatgttatggactagcgcttatagggaaagatttactcctgtagataagttctagagtgttaagtagagggtgataacttgggtcctgagtgggcacagtagtgtagtctctgtgaagtttcttcaactgtaatccatgtcagtaatgtttgtgaatgcttcactgacctaacctgtgggagtttgtggcagcagtgacatgactttactggaatcaggcttattgagtgagttatcaggatggaggcatgtttgtgcatgtgatgggtcacctagcttaggaactggcttgctttgggtgaagccgtgggctgtttctcaggccgggggcatgagtgttcagtggatcagctggttctggaactggttcaccaggagtgaggctgttgggtcgtttctcagtttaggggcataggcacatgttggtttgccagccattaagccttttaaaactatggtttcatgtctggaaaatgtgtattttatactaattctttattaacttattcctttaattttttttccttttggtgtatttctgaaaatttgttttcatctcattattattgttagcctttctgatgtattttcttatctttctcttctaatcttttagttgagatttttttccagcctttttttttttttttggatatagaatcttagtatattgtctaggctggactcaaactcctgggctctaacaatacttctacctaagcctcctgagtagctgggactacaagcacatgccactatgcctggctgtatatttttaatatttaagaattctttctttcaccaattgtttattcttttaggcttttttttgtttctatattttttaatgaatgcaacttttatcttctggggataacagagatattttattaaattgttattagttgatgatttcttccatctctaattccctgcattgtttgtttcctcatctggattatcatttttcatcctcctcctttatttttgtttctgtcattcacattgtatattttgcacatttgatgaattttgccatctgctttattctgtagagaaatggtaaaacatttccaaaatggcctttactcatgtttatgagcagcaatacagctttactttgcagaggttaaaagctcaaatattagttctagagttcttatctttgtagtatttttctgccagtttcctctttatggaaaataactctggctcccggctttctttaaactgtgtagaaggggagttgtggtggtaaaggggagaggcagtgtatacagactttcacttaatcctttcatgtctaccttgtgcctcttccaataacaagttgttgatgttccaatataatggagctggttaatttcaattattcttgacaataagactgatgtcactgtggagtaggattagtttggctggctgagtggggttgaaaaggggacctgaaaatctaaatactttctatgtggaatacctctaattcatgattctcaaccttggcactatggctattctgggctgggtaatttgttgtgagggatggatatgtgcattgcaggatgtttagcagaatccctggctacatatcagtatactacatgccagtagaactcctcccctcactgggacaaccagaaagttcctctggggacaaaatcttccttagctgagaaccattgtttaactttagacctgtgtgtgtcctcttacttctctcaatgtttcattatcttcaagtcttaaggctctcaaagattctataggaaaaatcagttttcatgttttaggaatccaattcagctagcactcaagctgtaacttctctgattattcaagaatgttgtcaatatttatttctatttcttaatttcattttctgtcttcaaaatttttgtaaaatgtatttcttccctattgatttctctgctggcctcattaaaattatgggttatattttttaaaattcctatttttttaattgaagtatcaagaaaaagaggaaaaggcacatgcttgatctgaactttatcaaaaattggtaattgttttcatctcttactattaactcttttttaaatcgatcctcttgctttaggaatccaaatcagcctgcactcgtactgcagtttctctgattagtcaagaacgttgccaatatttatttatatttcttcatttcatttttcgtctttgaaatttttgaaaaatatatttctccattattgttttctctgctggtctcattaaaattatgggttttacttgttaaaattgctgttattttaaagtagtgagaaaaagaggaaaatacatgtgcttaatctaaattttaccaaaaattttatattttagtaaatgtattcagatgcatatttttctgacaatgggcagtcttagttaacacctgtatcctttttcttgagcaagaaaataaatttattataatttttacttattctgccctagtattcctcatggataaatcgtgtcttaattttattaatctttgaatgcatcaattctaataagttggatcctttgtcagaaagcagaatgtgtacaatatacttatcccttagttttgtcttcctgggaactggctcttgatcacaataggatatatacctacagatcagcttcattataatttaatttactgtatttggcagcaacatcttctagtggtaacctagaccgagatgaaatattccatttcaattgacagttataaagctacagaccatagatttcagttatttgagtagttactacattaaaacacatctttttttcccttcctttgctcccaaccacatgtgcagcaaccagtatgtttctaaattttgctcctgtttataatgctatttcttaagcttctaaacatcgcagtgtgcatttcacctctgctaatctccatccaaattctgctatgttttggagtttgtaagaaagtgtagtgctgatgaggggattgaagtttcaggattccaattttggctgcttaacaggaacagttgaaggatggcatgaggtttttgatccatggttttccatttccctggtatagtaagcataggtatcactgccaaacttctttggagctctatgttatttgggatgagagcttggagctatgttaaacagctgaataaatgtttcccaatgcagctctgtctatgatgcagctcctgaaaattccctctgaatgttgtcaactagttttctcttaaattgagtttatagttgttttgtcaggtccaaatgtctttttgagactttactttgactgaacattgtgatagaatttatcctcctgcttgaaatgataaaaatatggacaaaatgtattaaataattgtttgctagatgttggacatcaggcaatgaggacaatgtttgctgagaaataggaaataaattatgtgaatcttacaattgacccggattactgcttacagagtatttctagaccacgacttagggagagaaatcccagatggagctcagagagttctccaaattgaagagatatagccaagtgtttcaggaattcaaagtagttagagtttgcagagagcagatagaggaacacagagataatttcacagatctacagagcatcttccttaagaattcactttactacggttcactgcatgtatgaggctgcagaaagcacaactttcaattattaaaagtaacaataattaacactcatgtaatgctgggtatgtgcctatttccactagctgaactggcgagaaaatttatgattcgtgggatatttgataagagtacacaaaagggtctagcctcaacagtggagaatagccctaggctgataactacttcaataccacctaataaatcttaagagcaagactcaaaaggaactgtttccaagtaatttaactgcatccaagaacaaaacacaaatatatttgtaagaacactgaaatatgtagtacctaacaagaaaaaattcacagtctctggcaccaaatcaaagattatcaggcatgtaaagaagcaggaaagtacaacttataatgaggatgtaaatgcatcaatcaaaattgatccagaattgtgagaaatgttagaattatcaggccagtatgttgaaacagatattacaactctacatagtttaaaagctacataaaaatatggaaggtactaaataaccccacagatcaaaattccagagaaaaacctacactgtatggaatgaaaatacactggatataattgattatacattaaacataaaacatttatgttatatataaaaaattagtgaacttgaagtcatagcaatataacctatccaaaatgaaacagagttgaaagagcatttgtaaaaatgaaaacagcatttgtgagctgtgggacaacttttagaggcttggtatatgtgtaattggagtccctaaaggaatggtggggtggaggtgggaatataaaaaatattcaaataatttatggctgaaaaattccaagtacagtacactgaaaaccataaagccacaaacccatgaatctcaagaaaactaaaaaataagtaacatgaaggaaatcacaaaaggcatattataattgaattgctcaaagctagtgataaatttttaatgataaaataaaatactacagcagccagaggaaaaagacgtgttaaatacaaaggcaaaacagtaagaatgacaacagatttcctatccaaaataatgcaaagaagaagacagtggggcaacattcttataactatgaaagaaaataaatagtgcacttatgattctatatctagtaaagatatctaagatgaaggtgaaataaaaactatttgcaatacatataatgaaagagttcatcacacagaaacctatactataagacacattaaaaagaagtccttcagtaggaaataaaatggtatcatatggaaatatggatctgcacaaagaaacaaagagcacccaaaatggcaactgcattggtaaatacggagggtatttttctaatgatttaattttctttaaatatagttgacagtttaaaaaataataataatatagtaaaagttttataacatgtgtaagtaaaatgtttggcagtaataacacaataattaggagggggaaaaggaagtacccttgacccttgaacgacatgggagttaggggcactgattccctgcacagtcaaaaattcaagtttaattttgactctccaaaagcttaactactaatggcctaccattgaccaaaaaccttactgataacatgaacagtcaattaacatttattttgtatatattatttactgtattcttaccataaagtaatctagagaaaagagaatctttaggacaatcataagaaagagaaaatgtatttactatttgttaagtgaaagtggatcataaagatctttgtcctcttcatcttcactttgagtaagatgaggaggaggaataagaggaagaggagagattggtcttgtggcctcatggctggcagaggtggaagaagattcttttataagtagactcatgcagtgataacccatgttgttcaagggacaattgtataccgttgtaagatccttatactctatttgaagtagtctgtcacttaaagctaggctgtgataaagatgtaggataaaaaccactaaaatcataaaacaaagagttataactaataaaccaacatggagataatttgaatcataaagaaatataaaataacacaaaacaggcaaaaaaaaaaaaaaggaaaaaagaaatcccaagcagatgggacaaataggaaatatcaagataatagatttaaacataatcatatcaataataatgctaaatttacatattctaaatactccacttaaaatatacagattggaagattggttaaaaaaggaaaaagtacaacttaactatatgctgcttacagaaaagatatttaagtataagacacaactaggttaaaagtaaatgttggaaaagataaatcttgtgaacactaatcataagaaatctagggtgactttattaatatgagaaaacatgaatttttagaaattttgtccaagataaaatattgcccaggatgaagaaagtaatttcattttgcaaaaggagtcattttgtcaataggacataacaattcttaatatttctgtaccaacagcagagcttcaaaatgcacagagcaaaaactaacgtaactgaaggagaaagtaaaatccacatttgtcggcaaaaatttcaatacccttctctcaataattaatagaacaaactgacaggaaataagtaaatctatagattagaacaacactgtcaaccaacttgacccaatggccagttatggaacattcaacccaacagagcagcaaactacacctacttttcaggcctacacaaaacatctaccaaaataaatcaaattctgaaccataacacaagcctcaatagatttaaaagaattcaaatcatataaagtacattatggggctgcagttaaattaaattagaaatcaataacaaaataacctggaattactctaaatatttggaaactaactaacaaaattctaaataatccaagattagaagaggaaacccaaagaggaattaagaagtattttgaactgaatgaaaatgaaaacacagcataacaaaattgtgagatacccaatatggcaggacttagtagtatattaatagcactaaatgcctatgctaggaaaggatgaagatttcaaagaaatatcttctactttacaaaactagcaaaagaagggaagacccaagccaggctaatgaaagctatttctgagtttctaactgcatctcatggggatgatcatttcttttctctgctcttgtggctgaaagcatgttaaggccaaaattgtgattcaggcaagacccaaatttataagaccaagattgcattttaagccataaagagcaggagaatctccatggcttgaactgtgaatagatatttgtttgttatcagagatagtaattgtactgctttatctgtatttccttccatgttagtaaaagaaagctcagaagtagttgatcacatgatcatagagaataaactacatttctcagtctccttggcagctaggtgtagaaatgtggtttaagttctggtcaatgatattttatctattaacgtttgctgtttaagttagtggctaaaaacaataaaaattgcgtatttatttaggattctatggtttggctcagtgctggtgtgcactggcttgtccaacctcttctgggctctctcatttgtctgtgattagctagctggtcaagcagcagttagataggaagacctcactctcatatgtggtggttggcaagctggctgttcactgggacagtaggagcaattattagctggggcacctcagttctctgccatccaacctctaatattccagcaggatagcatgagcttgctcacaaggtgatctcagagttccaagcccagcaagaaagaatgaactctaaatttgcaggcattttaaattgtctgtttgaatcatatttgcaagcattatatgtgctagtatttggccgaagaaaaccaataggtcaatctagagttattgtggaaggatcgtaccaaagagtgtcttagtgtatttttaaaggaaaggggaatgcctttctctctttctacttcttggtggacagcaattggttttagagtatgagtagatttgtattttctcacattaaaaagggagaatctacaactgtggaatctatagaagtaaactgggtattttcagttgaatcttgggaaactgactaaagttaacatttttaaaaataataatgctttattttatttttaaactacattttaagatatagttaatatacagaaattataatctatatgtgttacagagagattaatgaaatgggagtaaacttgttattttattaatttgtggcagagttcatatagaaagaattgtttttattgacaaaaatatctcgataagacttaggttttggcaagaatcaaggcaatattatacacttttgagatgtctgtgaaaaagtgaccatgtaaagtcaggtgtatagaaaaaagtgaatatgctttatagcagagcaaggaggaagaagagagaagccacagaagatggtagataattggagtgcaagatggtaggtaattggagtgccaatgaaaatctctagctatagggaaactaaagggatattatgaattgcaaagtaatgatttaattcctcttttaccccgaatctttaataaggtttaacgactacaatttgtttgtttgttttgaacaagacttcttgaaattgaggcattagctgagtttcacctctgggtgacatagggcagtgctggcagaagccagaaagacttcaaaatggaagaagcagaagtgtagggtcagggcgactacgaaatgatcaatacgcatagaattcttataaacttaaggaggacttctgtcattcagggatggaattagggtcataggctgccttatctagatttcaaaaggcaaggacgctccagatgatacatgcattacatgtaaataagaatacaacaaggccaggtgcagtggctcaggtctgtaatcccagcaatttgggaggccgaggcggacagatcacctgaggtcaggagttcaggaccagcctgaccaacatggtgaaactgtgtctctactaaaaagataaaaaattagccgtgcctggtggcccagctactggggaggctgaaacaagagagtcacttgaacctgggaggcggaggttgcagtgagccgagatcgcaccattgtactccaaatttgcaggcatttttaaatgtctgtttcaatcatttttcaagagttaaactccatctcaaaaaaaaaaaaaagaaaaaataacaaaacatataaaagataaaggttttgcacttttatttctctttaccttttgcacacttccttgctctttgaaaaagtattgtttacatgtaatgtttaagattattctttgacggaaacatcacatatgtccaatgccttaaggtgtttactatctctttggagaacaggactgatcctgtaaagtaccagcaaagactcaggcctgagttatgggttgatgtacttgaagtgttacaagtatgtacccacacgcctattggattttcatggtatgcctatatgttacacatatccaccaataaatgccatctatttttgtaggctgaatcaaatctctgtcttgagtaatgattttgtatcctttggactagatctgaataagactgagaaacagccaggcacaagaaggcaattcattgttctcactcatctttctaaacctatatgcatctttgatattgaggttcattattagctacaactacatttggtttgcatataaccatttatttttcagtcttagatattttcatatcaattgtcttaattatccttaaataaagcttccagtgagtctctatttcttggatgaggacaattgaggcagtgatagttctttaaaaattatttaatttctaagtccttcactatatcttgtaactgaatcccaacctagatatttttaaatatccttgaaattaaatataaatcaaataatatctttccacatgtaggttacttccctctatggtaactctgcctccaaatgtgaagagctggattcaatccaagtgaaagaaaatcagtggggaaaatgtcagggactataaaagagatttgaagtctgtacccacattgctgtgttagagtcctgagttattaaatttctcatatttatttgacattttatatacatatgtccacttatgaagagtttagttcttatctttctttaatcaacacagtattaactatgcatgtagtagatgaacactgtattttatgtatttgcattcttttcaaaccagatgcttaaagaataaaatgacacagtgttttagctgttattttgctttaaaatgctttaaaacaagaaacatttttggaatttcttatcacaatataaatcagctaagtatatttaatgtggtgaaatgaatcataaataggctgaaatagtcctaaaaggggagttgggtaagaaaaaaatgtattaggatcaatatcaataggcataaataattctattaacaaataacattaaacattgttacactgtttatgggatgatatcattatatcattatagaaagattctcccttaatttaaatacctagcatgtacaaaacaagtttaaatcaatgagacagtaaacaagaggaataaaatagagaggtgggctgggtgcagtgattcacgcctgtaatcccagcactttgggaggccgaggcgggcggatcacgaggtcaagagatcaagaccaatatggtgaaacctcgcctctgctaaacttacaaaaattagctgagcgtggtggcgggcgcctgtagtcccagctactcggaaggctgaggcaggagaatggtgtgaacccagaaggcggagcttgcagtgagccgagattgagccactgcactccagcctgggtgacagagcgagactccatctcaaaaaaaaaaaaaaaaaaaaaaaaaaggggaagtggtgtcctaaagactaaattaactgctgactattttctattttcagtctctacatatttatatttttatttctttatatagcattgaatggttaattccccatttcccttttattcttatacgactaacttctatgggttttattttcattcagttctgtatattccccctgctgaagcctcccatgttgtgtgtcaagaggaaaaatatcttattaccttcttgtctgttgaacatttagttttcttctccctccctccctgtcttgtacctaatgagcaaattatctaaaaatagatacgttcatcattctacaaaatgttgtatcttctctagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattggtacgtgtaacgcaaaagtttacagtcacatctctattaccatctggaataaaattctctatttgatttcttaactgaagagtaaagcaaatttctttgctcaagacaggctggaaaaaaaaacaatttggatgaaattaactgtttaaaatgattaaattaataattctatcaaactgcagcttgaagcttagtttaatcaaccctttagaagtttctttattctgtagatgcattaattcccatggtcccatactaataagtcatagaaaaatataatttgcttactgcatagatgtttcttttagaaaattagcactttttcaaaatgttttacacttaatgagttctaagcaaatcatttccatgctagttttcttaatagaccaaaataaatggattttttcaaaatattctgtgctacagggtcctttgtgataaatctttccatttttttctgttatatttctttgaactgttcctatgaaatgcaaaataagtcaacataattctacagatcatgtatattgctagggttacttacaaagggctacataattttaattttgtaattcagcaccaagttgattataataaacagctgccttcggtgttatttatcatttttttatacaagacgtgcttttttgtttgttactcccacaggtatttttcggaaattagatttgattatagcaatttattacatccaacatttttgaggggaaccaccgccacataaggacaaaatttatcaagtgcctaaaatgcactatgttcataatgcactttgaaattttgatatatgagaatattatgagaggaaagtttcctgatgaagtgagccctgtattgtaactgaatatgtcttggttcctataggaagtttaaaaaagacctttgcctttctattgtcattcaagacaccaagtcatccatggtttttctaacactgacctgaaccttacaatagtaaaaatatgcctggcagtgattacacacactcctctctctctctctctctcacacacacacacgaatgcttacatgtacacatgcatatgtacatatcattctgaatactattttcatttctgtgatatacctctaaatctaattctttatcttttatttatgtaagtgtacatcatgctacacaattcagctagacaagcgtttcaatttaataaagagaatgtaggtgtgtttagtggcattacacgagatttctctggtttaaagaaacattacatgaaaatctgtaccataatttacctatatgcatctcaagcatacagaaactaattttttagaaagaaagaataacgtgtaaagagaagtacatatttgtatgtgctatccatgatgctgaaggaattctaagaccctgaattcaatttgtatggcatcctttgttctttaatgtgagatatattttaaactcaagatgtgaaaacaaaagttaaagcaagacctttaaagacagtgaaataattacttctttgtatcaatggaatctttcttgtgatggttagattccagagcttgaggaagggaaaaatcaaaattaatttagaatgtataatgccatccctactatttgcctgttttgttgattgatccagatggttttctgcaggaaacataaatatatattttgtgaagactaaattacttcagtattataaataattattatttctagtgttatttctgcaaatgtagtactttttataaaaacaaaaacttgatatgcatatatatttactttcctaatgggatcagcaagtaactttattcaatttcaccttgttaatatgaaaaaaaaagaagcccagaaaatacaagtgtatgttgtatacgcttcagaaagcaaactgttagagttaacaaaactgttaaatcttactaatgattctatcaccagtaaaatacattagcaccaataattttattaaagtaggtcattcatctagaataaaaagggagaagaatgtgaattaaatgccaagtgtgctaactcgcctgtacttgttaacaccgaatgtgatgccctgtaggccttcctgagtatcgttaggaatagattacctgtcaggaatatgtatggcatattcaaataagcactgtgcatatttttaaaactgatatgatatgaatccatgtagaccaattttaatagttcaaaatgagtcataattcttgttaacaatacagttatttttaaaatttgcagcaatagtggtccttttttattttccttattgaaattaaatgatatgccttaggtgagtcattcatcactgttaaagaacttgccttcattggagttcttgaatttttatccatatatatacatatatattatgtatttccttccagtttaggaaatgcttttctacatatgagttcctgagtatgtttttgactcttattttaagattaatttttaaattgcaattatagcttgaaataaatgtttcagttgattcaacccatgcagtgagttatttaaattcatggatatttggaaactatctaaaggaagtattttgcatctaaacatttactattctaatttttttatttctttgccttgtaatacccttttatcttttagaataaccttacttgtcagagatttaagtttaggtgataaaacatttttcttcattcgtaaaatgtatatgtgtactcctttaaatagaagtaatataaaaaacagaatttacttagtgtttaaagaggtatgttctgagtcacacaagatgacaagcaatgtgattgctttatgagccaaggagagcatgatttatattaattgaaaatgataaaatagaggagcatacaaaaggattaaaccaaaaattgccctggataagttttatttatattaattacttaaatgtgtggattcagaaataagtgtatatgctgttttcacaaaaatagttatcagctgacatttttttcttttttcccagcttcacgaaggtataattaaataaaaattgtatatatttatggcagacaacatgatgttttgatatatgtacacattataaaatgattaattccagctaattaatgtatccatcacctcatgtacttatcatgtttttggggtgagaacatttaagatctaatctcttagcaattttcaagtatacaatacattattattaagtatagtcaccatgctgtacaatagagctccagaacttattcattctgtctagctgaaactttgtactcagcttaaccttttattaaacatctttagagatttcttatctttagaaaaacaactaatttgttatatgtaattctactataattttaaatgagcacatttgttaaaatagtttttaagatttgttaaagagaaaaagagctccagcatatgtaacagaaacaacatttgcattaagcatttttctttgcattaagtaataattaaaaatttatgaagttcatcgcaaacagttgtatattaaagctaaattaaatattgtcattgaattttgagagtaagattggccccctatggcattgcttgtgagaaaacactcaatattttgtgttcgtatcatctgcagtagcattgtttgtgtctcgtctatcttgaatgaaatcattttcccatcctcaccttttaaatatattttatctttagggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtaagaaagaaatgtattacattttcagtgcacaatgacattccttttgttaacttaggtaacttctccctgtttctggtttgtggcttctacaaattttatttccaaaatcattactgtatttatatcattatccaacacatatataactatttaacttattcaaaattatctgcatatttatgttactattttgagaggatactttagataaaactcagccgatcggatttatttcataattgagactcaatttctacacttgaagtaaatctcctttttaacagttttttaaaaatcagatcaacaagagtcaattttattttccagagaaaggaaaatttgagttgaatatccatacaatgccaaatattcaaatgatgaactaaatctctgaataaagctggctaaatgtttttgctgaagaggctatatgttctagttttatatagaaatacctagaattgtttccacatgccatcaaattaataaaataggccactgtttaatctcattatatacaaacttatctttccatctctttcccaattgggagagggatagaccccatctatggctctccttacatttaagattttaactaaaatactataccttctttacaataaattcattatgatatgatgataaatataagtacttatccgttgtttaacagctgtgctaattgttgtcctgtcagccaatattagctctgagttatatgggtctataaaaatgagcatgataccaactcaaaagtgtgatttgcttgccagagaaggagtagaacaaaagttctgttaacatagcaaagaatccagcctaggataattgggccatgcttttcctttggcattggtcagtgtgtaagatcaaagagacaagaaggaattgatgaagagttcattctttttgtgatgtaagtattaaaaaacaacttgaactggtttaaacataaatggagactatattataactagatactccataaaaacctaaggagaaggaccactgcagtcaggactcaggaattagaatgcttccactgatacatattcatttgtctctctctctctctctctctctctctctctctctctctctctctctcagaaggggactttacctctctctttctctacatgggtatatggccaccctatgtcccctgaaattgtttataattctaccaccagccacaacagagcgatttattagctacctcttagttataatttctagaggaaaattcgaattgactcagttttgtttggttggttacctctgagccaattcattgtggccaggggtgtcacgtacttataaaatgagtatagcttttagggaccatttcatcaggtagaagcaaggtggtaagtatcccagaagacaggaagattatggagacctgggcagacagcctaaatgacagatacagcacattcactctttttaccttcaggttaatcctttcaaatttgcaatcaattaactttttgatatcctaagatgagatgtttttttctcttttagtgtttatcaatatctctaattttggcaacaaagtcctttgtctcctacacagtcaaataaccatgatttatacatccttctttctaagtaaaccaaaacaagctaatagatcaaatgttatatccttttgagtaattatcaattgttaaaatttactgttccagtctaactttaattgtatgtataatacaagtcacatgttttaaacaatttttctgattttggaaaaactctgaaatcatagttacaaacatttgttccctttggtccttccaatgaaagacccaatccatcatctcaatactttgtacacctaccagatatctaaatgatgaactaaaattgttagaaaacctttgtttttctggttgttttgcatatcattgcagaaaaagccatggataatttaatctacaccatgcataagactgtctcatttgttcccttcctaggatgaagaaatactgacttcattgctctttcctttatctttgtggctctcattgtggtgatctctttgttcccaactctaagcccttttctcccacccaaatctatggctctttcctgtctaccctatatagtattggcagaataattcccctaaagcacttaattcattatgtcattctcctgtagggttaccaaaaatgggttttattttgcttatcatttgagtccaatctgggcaaacctttatgagtttttatcttccggtcgcagtctagacacctagctttgcttcctgatattccctttctcccatcttcttcagtcactgcagccacttcactggagctacacatgtcacatgcagagccgatttcaatctacctgatgctttggttcattctcctttcccgacatggaatgcagtataatcctccttttcaatgttagttggcatcctctgactagttttactactcaacatactgcctaaaattctccatcactcagtgaacaacaaagttgacatgaagcatcagtgttttaagaggtggtttaactcaaacctatagaaaacttgaaaataaggtgtttttgaaaatgtgctcaagcttctattgtcttcatgttcaatttattatatgaccttgaagagaggtttatgttcaagaaataataatacagatctcattgtaattaccccataattatgcttcttttttctgaagaccatatggacctataaatgaagtcaatgagttaagagtagggagcattaaacatggtgaaaatatttttatttactgaaaaaattcaacagcgtattgtaaaatatttagtagaaaatgtaccagactgagaaaacatatttggagctccatttcttcagcttactgactctctaaaggcattcccctgtccttctctacagggaacttccatattttcttccaactgtccatttctagccaggggtaagcagatttatctttaagctgttacctgagtggagcctgtatcagttctactcatatcctattgatcagagctgctttgtatatccatacctcactgcaaaagaggctggcaaatagatgctctatctgaatatcaaggtatatatttaaaacttggggcctcttttattataaggagtaagaaagaaattgatccttgaagacagccttggctatactaggaatgtcctacacctaaaaaaattagctggcagaacattagtcaacttccaaatagatgcttttaatgaccatgagttttgtacttttattgatagatcccattattatcattttttaaaaaaatcagccaaagttaatgaaggcctcttgagtcctgaggaaatatatgcacaaaatcccttcttgggatcttcgactgtttcttacatgctttgccttatagactcactgctattctagtcactcttccttccaaggacatgctacagtttatagtggccctgctgagttattgacccaggatattaacctggttatgaaaagctagaatgatcaagctacagatttggattattatattttgttgaacagtgcagttattttcatatagataaacatttctcttactgagaaatcattttcttctgggtactgttgagttcttaatttaatcagagaacattttatgtgtagtagcaaacggtactttcagtgagcttaaattttgatggggaaactgacagaataatttgcaaataaatatatgatatgaatttaaatagtgatgatttttggatctgtggctctactcaattatgtttctttcttgctaagagtttaagatattatcgaggttaccaaatagactatttatttagcacttttatatcagtgtttagtttccagaaaggtgaactgggtagccatgtttatattgtacaagtgaagtcacattgatattttattgcaatggaaacagtaagtggtttaaaaggaggaatggtgaagtgaaagaaattatcaacctgtttctttttatattattatctaaaactagtcatttttctgtttttctcttttgcattttttctcatttaagatcataagtgcctgttttaaaaagcagcccaatgagatgaccttgttaaaactcctgattatttctcagtatcgtcaattaaatgaaccccttattgtgtgcccacaatgtacaaggaattatatatacatatatatatattttttttttctttttttttcttttgagatggagtctagctctgtcacccaggctagagggctagagttcagtggcgcagtctcggctcactgccagctctgcctcccaggttcatgtcattctcctgcctcagcctcccgagcagctgggactacaggcctggctaattttttgtatttttttttttttttaaagcagagacggggtttcaccgtgttagccaggatggtctcgatctcctgacttcgtgatctgcctgcctaggcctcccaaagtgaggaattatattattattgtagttatgcaagttgaataaggtaatccttgccctcaagatattgaaactttaacaagggaaataagacatttgcacaagtaaataaaatacgataatactttaaatgtgatcattgtttttcagtattagtgttgatgcccattctacatcttcctctaaagaaaagaagacaatttgcaataaacctttggaaaggagttttgttgcgtctgtacttaggcaaatcgtgactaagaagttattctcctaatggccgcacatggtggctcatgcctgtaaccccagcactgagaggctgaggcgggtggatcacctgaggtcaagagtttgagaccagcctgagcaacatggtgaaactccatctctactgaagatacaaaattagctgggcatggtggcacatgcctgtaatcccagctacttgggagactgaggcaggagaatcgcttgaacctgggaggcacagattgcagtgagcagagatggcgccattgcactcctgcctgggcaacaagagccaaactccgtctcaaaaaaaaaaaaccaaaaagacaaatatataccagataaagtcctccaaaaaaagagccaggaaaagagaaaggagaccaggagggggttgcatgaagaaaatttagtattattatccagtattgccattgtttaacataatttgagttttaatcaaaatttacatttgcataatttaaaaaaccaaataaaatgtaaagagccctgccttatcattttcctaggaatttccgtgcttagagaaaacaccttcaactcctttagatgtttattctgggctttcatgtctgtaattctgggttttacatatatttcaccttgatttttaaaatgtagatattatctattgtcttcctcctatagaagatgaatgtttagctcctttcacctcctgcttagcaatccctttatttggttaaatcagtattcagagatttctttattatgactatataaatttactgtacagctatgccatataatatgatttgactatattttctttgctcaaaaaatttgtcttccttagtttttcaggactctctttggcatttctaggaaacaaaactctccaagggaactctgttcaagaaatctatcaggttttgttttttcccactagatatatgagtgggaagttcaggctggttgatctttagttctgttgcacagctatatccaagggctaacatttgctgctatactagggatttccttcccctgtctcctatgttggatcctccatttcctgaatcctacacgttctctcttcttggtttatttgtgtatttggtagagcacatgttctagtagcttctgaaaaagaatacaaggagggaagtaatttgaggagaaaattttgaatatctgaagtgtctttattgtctacaagtgtctaaacataaagaacgatttgaaattttactattatatgaaaacttttcattaaaaaaatttaaatggttgtaccattagctgttagcaatgttaatcagattctttcttcttttctacttttttttttttttttaacgacctggaagtttttaccatctctatatccctgggcactcagtggacccttttgcctatcagtgatggctcttatgttctgagaaaatctgcaaacacattcatagcaacatctagactcatgttcgaccaaacaattggacaccaagcctagccaagttgatgcataaaatcaacaatcacaagcaacctttcacataatgcctgtttacatacttgttgagtccagactttctttagtttaacttctaaaggaaaagcttactgcatcttcctgaagtgtaagagggacaacttcctggttggggaaggtatttagcacaccttatatctgacttcggaaatctctggggctttcaattccaaacctttctgtctagagttacacaacttgaataaattagcttattgtcgggctctccactgcaagagcttagctttttcttataggtatctataattgattgtcatttttctccttctctctttttttttttttttttgtttatttcatctctggggatttcaggagggaaacattattcaatctaccatgttttactgacaatgttcccctagtgtttttgaggttttaatcttttcagaccaaatctttgcagacatccttgagccctctcttttccccacaacctttgtctcatctaataaaaccaattctgctgattttaccttcaagtatatccagaatttgaccacttcttgccacccttacttacaccagccaggtccaagccaccttcctctgttcctggactattcaagtagcctcctactcccctttatctttcttccatcacttctcaacagacagccaaagtgatgctgttcaaacttgagtaacatcccatcactccaccttccatttgcttttcaccatagctaataagaaacaaagttgatattctttaataatcctcatggtctataatgtccatgaactctctgacctcatttccacaagtcttcagatcatttcttcctctccagccaacaagcctcattgctgtccttcacaactgttcaatgctctatctcaggcaggtataaaagtacctccatagcagtgctccctatatattttctgaattaatggataattatatttcaaaaatacctcagtggcattctcctgtttttaggtgtgagcctagcaaaggtctgtggtgtttttttcacaacacttacgaaaagcgttgtgttcaaccttgcaaatgaggaaaaataacagtgacctaagtatcatatattttttaacaaaacaagatatagtctgcacatattcatagcccacgaaaagagcaatgtgtgctttggggtggacatttttttattttttattttttattttttttgttttgcttcagaaattccactttaatgtttttttttttcctggttttatggtctcttacagtaaaacttgcattgaaaagagaaacccttatcctgaagtatctttatcataaacagatgtttgcagtagccagccctgcaatgtgcacagtaaaatgtgctgctacaatctgaagctttcatttacttatttaaacatgtctgagagacctagatcatataccacaggggcagacagcatgctggtgtgtgagcagtggggcatggagggagaaggatggggtaggaagggatgagtagcaagcttaaggacttctgcctccctttcatctgtgattgcaaatactgctgacccatagtagatgactgcacatagattcttgtcccactttcctaaaaaacattattaaggaaggtgcatgtaatgaaacctcatgtattattaacctaaccttactacgaatgtacaaggaataggtttaattcaagtaaaatttataggcaatttgttaaagcagcagtgcacattagaaggtacattagagacacattggttttaatatgccattcaataacttgaacagaggttaaaaatgctgcttaacctccattaagtattttaaaaatgctttaatttaaaattatttggagtgtgtgtacatatatgaatgtacacatatccacactaataaatataacactaaatatgttttcccagttccctttttcagtgctggatgaccttataatgttcagcagtaggcacttaatcagaggccaggccgaggaaggcagggaaggatgtcaacgcatcccgagccagtgacccacccttgtccttgagaactagaggcagagagtgcatattgaagactctgtagctttggaataaaacaaaggctaatttataatgaaaacagcttcctatgacatgttttgtactaatagggcagtgcctcctgcttccccctagtatttacttttggttttcttttacaattcataaaacaaagtatcttgtttcattaagtagcacatcatatttattaagtaatgagctcataaactagaattgtgtacaagaccctgccaatggaattggaatcagatgctgatgttccattaaaaatcaatgcatcaaagttgatatccaattatgccacatttcctagtgtttggtgagacaactttctaggttaacatgtttttcacagagagacctgaatctaaaagtaagaacctcttccttgataaatcatcaggaaggaatcttgtcacaggaaatacagaccacaatcttaggtacatctggaaaacaaaaaaaagtaaaagacactgataagaaaaatttctctgtcatagaaaacttgctaattgacaattacaaagatgataatagataatgtttactgagagtccgctgtgtgccaggctctgtgataaggttttgcctgcaaactttcatttaatatgcacaatatttctaagatggaggtgctgggattattctcattttaatctaattgggggaatgaaatctaattaagtagaagagccatttataagtccaggtccatctgactccagaatgtatactctgaaagagtggaactttttctttttctttcttttttttttttttttttttaagacggagtcttgctctgtcgcccaggctggagtgcagtggcacgatctcagctcactgcaagctaagagtggaactttttctaaataactaactcaatatttatcttacacattcacacaacaaatatttgagggtgagttagataaatactgtttatttcatccactttcaagcatacctcaactcatgattctggcttactgcttcacattctgggatacctcatttgttgttcaaaacccaagtagtaggcataaaatgaaaattaacagagtcctgggaaaccacagagttcaaataatgatgaggtaaattgaaggggtctagaaatggaattatctccgagaacttagttggagaaattctggagatggttggaatggcacaggagacaggctttagagcatgcatttgataaacactgaatgggaacagagaatataagttttgctgtggattttgaatatgcatacacatacatatattaattataatctccaagatgtaatcagagttgtcattatttgggttatttgttgttattggatttgattcttagagaatatgttaatgagggcctttcatgggtattcacataaatagaaaaattggattatttatgaaacagaaaattccaataatgttttcccttacatgagcatattattatgtcctttgtttaagagctaagatatagttttagggtgacattttctttctgcagctctgttccatctgttgctgtgacgagcactatattttaaatttattgtgtctgatccatatacactcctctctagactccctgataggacaggccactctgaccaaccactctcatgactcacagatttatgtttaccattttccttttcagtgttaaagggatcatctcatattttagaggatagaagatatttatccatctatccacccattcatccattcagctatctatccatttcattcatacatctgtttttcaataaacatctattgagtaaattaccagagactatgttggtgttaaggtatacaatcacaaatatactaagacattgtgatttagtaggggaaactgactcacatgtaaatgtatcacaatgtgatgagagccatattagaaatatacaatatagagaagtagtaaagtgaaggaaatgattaattcttgaaggatgaggggtcttaggaacttagagaaaatgatttctgaactgacttttaaaaggaaataggaatcagcaagctgctcaagaagggagtagcagcccagaaaaaaaaaataacagcagaacatttaaagcatacctaatttaattgaaaaacccttaaaaattgttttaaaaaagagaaattataccttgggatgaataatattaatatttatgtattcacttgatcaagtctagaagtaattttagcatgattttatataaaactaccaaatggaggaaaattattattgttttaatttgaaaactaccatcatcaactatactgaaatatagtttacaaacaatacaacaatattgaaaatattgattcataaagccattaccaagatagtcttttgttgcatggatataggtgagccacccatccctccccaggctcttgtgtaactattatgtccattttctgccttaaggtgagagtagtttcttctaaatgtcttacaattagtgcttagccccagcattgccctcctttcttgaataaagcctagaggttacacttcttttctttctccctctcaagaccttggcaaagcctagttgttcatggtcctcaggagagacattgctgggaaatgggctcttcttttatgcccaggacaagtactgtgctatgcaaatagccgctgcaggagataataccagctgccttgctaataactttgaactctgtagattcttctcctaggcaaagccacactattttacaatatgggtgactctttgttttagctggatgatacatttttttccacttgagatttgtcatgtctaaaaccaagggtcagctaaataatatgggaaaataataaactagcgagctgatttggaccatgtatatgtgaactctcagcactacgtaatgcaaggtaataatgttgtcctaatgaccatgcttaagaatgtggtacaaaatcattcatggaatgaaatctcaatatgatcagttacaatgctacagatatataaagatttggaacatgaagaagagctaacaaaggggtatcagaaatgcattacattaaagtaaattgaggtcagttataattaagccacattcaggagttgatgtttaagtggaagggaagggaaaagattgttttctatagttggaagtcataaaaggaggtaatggtctagaattaggcacattcaggtaaggcaagaggtaatctttaagcaggaagttacctgagtcatcctaattagaactgcttaaaaataggacagctaaaatactggtgggattaacctttataatcaggctcctgagaggaggaggggaattaaccccaaggcaaattcccatgcagtcttttcctggaagccctaccttcactttcagtctccctaggtgctttagcatctttttagttcttctctgcttgtacttctgatttttctgtgacattctttattccccaaaacttggactacccaatttctgcaccaaaatgctatcccctacttgtacttacaggtttatctaatacatcatttcttctaaaaatcgcccttaatttttccaaattctctgtggcttggagctattgcagtaagtctaaattaattctacttgtaagtatctgtgctaatgggtaatttatccaaattggagagctgttagcacattcatgatgccatcatcatggatttaagggcctagataccttcacaggaagaaaaatacaaagaatcacaaccacagtggccttgaatttaaatggaagccttctgaatttgactttgatcatgtgatgaatcaggtacaagaatatatactaattgtcatggccatgctctatttctggatatgtatatataagggaaattgctgtcaggtggtacaaataaacaaatagcgtaacctggctgtaaattatgataaaaatgatagtattagttgatttccgccaactgaatggcacatattttgagctctttcttttcctctcattgagcacaatgttttctattttgctgcccttgaaactttgtaagacagaatgtataggatctaggggaaggaaaaaaacccaattgttggtaactataagaaaatggcttgttttcaacaagagcctggaatgagttttagagtatcctaattactttttgctgttccctatataatagataagagaatagattcactttttgctcatgctctccttctttcaatatcattgctattttatgaactttaaattagtgtcatgacaattgtacaattcatttttatttgctgtaactgtattcattagaatccttctgtgatccttctaccccattgtttcagtaaaattctttgcagcattttgcacgggcttgtgtgtgtacccatgggtctgtgcatgtgtgtatatgtatatgtacacatacatgaacacacacatcacacaacactaagaaccatttctccctcatatgcctgctccacattcaactgcctgataactttctaattctataacagttaacttccatctcctgggtctgaagagattttaagtaatttgaataaacttttgaatcatatttgtatttctttcctttttccataagaaaaaaaatatgagttttagaggtaagctaaaatctctaaattctgcaggctttttttgtgtgtgtactacttgcagggctcacagcctgtttaataattgaactcatttttatttgttcatcgaatgtgtttggaatgcctactatgtgccaagcagtgtactggctgctagggagacaatgatgaatgaagcagatgggttttctgcccttatggaagttagattttggtggaaatgagattgattataattttcatgaacacttaggaaacaaacaggatgctatgcatttgtaacaggtatacctagcctggcctagggaaagttgcctgaggaagtcacgagacctgacttacatgagtgaactgagcaacagagataggtcaaaatcatcccagcagacagaacggcccatgaaaaggcctttaggtctcaagaagaggaacaaatatgactgcaatggactgagcggggggatgagccatgagctaaagctagagacgtagctgggacctgactgtaggattgaaagctgagtgagagatttggatttatttcctaaagggaataggaagtcatcaggtagtttcaaatagagaagtgaaatgtccaaactgcactttggaaaaagactgctacgaagaatagattggaacaggacaagagggatgcaattagaagagatggcctccgggactgggtggtctgggtgtaaacctgggttttgctatccattaactctaccattttaggaaagtgtgttaaccttctcaatcttctgttttccaattgacagaatagatgtaataataattcatgcattatttgcatttctatgacaactaaatgagatgctcaagataaagcccctacagtagcatctagtttgaagtattagttataaaaaaagtggttggtgactttatctgggaggtcgtagcggggatgaagagtggaaggtttaaaattgttaggaggcaacatccataggacttggtaattagcaaaatatagggggtcagagaagtggaggatgcaagcttttgttttagtaaaatacagaattagtttaatttgaatttcagataactttttttagtctgagcaaatgctgcatgggctgcacctttgctaaaaaatttcattatttgttagaaattcaaatgtaactggcttcctatattttataagtctgccctaccaaaggtacctcagtgttctaggcaaagcaactgaatgactggtaatatctgttggaatggagctgattagaggaggtcaagttttttgtagaaatattgaaatattgcatggtagattttaaatacattgaattgtaggacctgggaggcacccaagtccaatgtagataatttactcagtttttctttggtcataattgacacactgaaggacagatataaccacatttgtattgggaattagtgccttggtagagtattctgtttttctgtgtaatcaattattatgctttaaataaaagagtggataaaaagtatatataaaacttttaatttctttatttctaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaaggtacatctttataagctttaataatttaactctttctttagcaacagttaactttttttggcagttgcaaagcaataacttctgtaaaaagtattttttttgcccggcttggtggctcacacctgtaatcccagcactttgagagaccaaggcaggcggatcacgaggtccgaggtcaagaggtcgatatcatcctggccaacacggtgaaaccccgtctttactaaaactacaaaaattagctgggcaaggtggcatgcacctgtagtcccaactactcagaagtctgaggcagaagaatcgcttgaaccgggaggggtaggttgcagtgagccgagatcgcgccactgtactccagcctgggagacagggcaagactctgtctcaaaaaaaaaaagtgtttttttgttattgatatgttttttgttccgtgacatccacatttacttaatgtatgctaatctttgaatatttcctagagtgggttgctatatattgatagatgtggcccatcctagcatctgggaatgttgaatgagataaaatatattttctctcaaaaagctgagagtctggatgtggagaaagacaggaaaagacatatctgaagaagaaaatacacatactcatactttctctctctctctctctctctctctgtctctctgtgtatatatattatatatatatattatatatatatatatatatatatatatgggatatatgtatgtgctttgttcttcattgcccttgaatttattgcatatttattagttcattgcatctatttatattttccttgcgtttctaatttagctttaaagactggcagatgagaaacatagctttgtattctgtgatatgatttttttcagtatgtaaagtatattatgaaagtaaatcatttttcaaagttacactctctttaatattctacttcttattctctgggtatctgtggccatttgccttcactcatttgtgtttattgctgtatttttgaagatgtgctataatgccaattctgtgtctgtgtgtgtgtgtgtgtgtgagagagagagagagagagagagattatgagcttgtctaaagttcagactaaatctatgaattctttgaagctcctatccctgagaagctagtagtgtgtgctgaactcagaaagcatgtaataaaatgagtcaaatctgtctctcaatatgtgtatatttataaatctaattgctaattatttcagggtttgtgattatctgggctcttttaaactcattgcccccctgctgcctgccttttggctgttccactcctcattaacacctccattagagggtggacaggtgacagggtaattactgaaaaagaacttaaactagttcattttgactttcttttaaaatttgatatgatttttaaaaactacaaaaatcatttaaaattttattaaaataatttttgttttcttgacatacatgcatatattttaatctgtgacgctctacttctatcaccgtagaaatgttaccttgatggtctgagaccattgtgactcttttctacagatgttattataaatcatctaaatgagtatacaaagcgcatggtacagtaaatagtaaataaaaagcactgtcaggattttgatagtaaaataggagccagttactgcacatactagctcctagatgtaatttttttgaaataatattctacagattccccagttggaactcttgggctggtttgtttcactcctggccacctctgtctttttcatagttctgaccacatttaccaggagaaaaatatcttccccaacccactgtcctccttgcaacactcattcccatcagtgccattttgtgacattcaattacccatttttgttctactcatcccctttgtcagtcttcccagggttatcagcaaaacgcctgctcagtgacctggggatgtctgattgtctcagctttttcacttaactttttttctttaagtgagatctgattcccttcattacactgcttcctctaccctacaatgttcttaaattcgtggctgagccttttaccccattctgttcctctcccattatctacccatctcactctcactccccaccttactttagtccaggaacaagaattgcttaataagtactgttccatcacctgtcactctgcagtaggcctgactagcactggagctagattccctgggttagaaggtggatttaaatgtttacataaattgataaggaataggaaggaccaaagaagtgggtataagctacatttttagaagataccgaagttacaataaagaaagaattcagtctaggcactatggctaactcatgtaatcccagcactttgggaggctaaggtgaccagatcccttgagtccaggagtttaagaccagcctgggcaacatggcaaaaccccatctctgtaaaaaataaaaagttagccaggtgtagtggctcttgcctgtagtcccagctacttgggaggctgatgtgggaggactgcttgagactggaaggtcgaggctgcagtgagtcaagattgtgccactgcactccagcctgggcaacagagcgagaccctgtctcagaaaaaaaaaagcaaaaaagagagagagaaagcagacttcagattcgcaaaaagaatgaggggcaggttggagtctagaaaatagagctaaagtatgagaagctgagtagatttctaaaaatatgaatgattcagattaagtgtggggttttttttttggacagagtctcacactctgtcgcctaggctggagtgcagtggcgtgatctcggctcacttcaacctctgcctcccaggttcaaaagattctcctgcctcagcctcctgagtagctgggattacaggtgcatgccaccatgcctggctaatttttttgtatttttagtggagacagggtttcaccatgttggtcaggctggtcttagactcctgaactcgtgatccgcccacctcggcctcccaaagtgctgggattacaggcttgagccgagtgtgtgttttaaacaaaaagatccacaagttttatataaatgagtttggatatctttacatattagttggctcctgttatattgatgggggtggtgagattacctttttaaaattacaaattgtccttggaaatggtcgcacttttcttccatccctgtattagtccgttttcatgctgctgataaagacatacctgagactgggcaatttacaaaagaaagaagtttacgggacttacaattccacatggcttgggagacctcacaattgcagtggaaggtgaaagacacgtctcacatggtggcagagagaagaaagcttgtgcagggaaactcccctttttaaaaccatcagatatcgtgagacttatttactctcatgagaacagcaggggaaagaccctaccccataattcaatcacctctcactgtgttactcccacaacacatgggaattgtgggagttacaattcaagatgagatttgggtggggacacagccaaaccatatcaatcccctttgttcttatctttccagttccaggttttccttttcagagggattctatttttctcccttttctaactcctgccattattttaaactactttgacatgtactgatgcagttctttggcctcttcattcattccccactccagcaacccatttccatggctacaccctggattttgtgatcacttataatttctctatttctcaaatcttcctaatcccatgaatgctattctatggatatatcacatctttccaattccaattcaccctggaagcctcacataacctgctccttaacttctcttaatctttatcccattatccctccttaatcctcttttgatcaaccccatccctaacttcactgtcttctacttctagcctgaggcaaaacctttttaattatgacccttttgagtacctgattgtgggctcccttctgctgtactgtggggtcagctccagagacgatcaccctacacctgccctgatctgtgaggacgtggggaaagatcatgtgcctatgctgatctgaagcactaccatgtatgtacttcttatcaatttactttctttccccctttaaactcctaccagtctcctcagttttaattccatgctcttgcccttgcagataatctggccctctgctcatagacaaaataaagccagatatatgtatctccagattatcttttctccacctccagcttgtctacattgtcacacatttttaattttttatctagtcttagaagaaaatcctgtgtatttttgcctaaaaataacctgttcccagtccttgatatgatcccttcctgttttcctactcttgttcctccattccatgatctttgctccatcaaatcctccctttattttaactcaaacatctctctataggtaatatcataactgcctacaaaaatgctattcattctacaaactccttcctttgattctgccctgctttatgagccctgaaagttattgtctaatctctcactcttcattcacttactaacatttaaaaagagcactatgattcaagaaaacatgatttaaaaaataaaagatcagattttttttcttcttcattttgtttctttctcattcattctttattcaccatgtgtggtacatacatgttagcagaacatacaagttagcagaacttgcaacatgcagacattcaagaactagttatgtgactattaaattctcatccaaatcaaagacaaggtctataaagagatataataaacaaaaatgggttaaggaaaagacagaatgagggaacaggtttcactggtgggaaaaagggaggggtcagtggtgctttccacttgagtccagtgagaaggtcttatttgatcccttgaagggtgacatgtgtctcctgcagttggagagaccagtgcattgatatctatcttagacctggcaaatctaactgagaagagacagtctacccaggtttggataggtaagctagaagacagtgccctgcatatcttagactcccagagttcatcatgacaaggaagactacgtatttctcatgaccagatgaagaccacaaggaagaaagacagggtaaggttgtcttagtctgtgctcaaagtaccacttagaagataaaggggcctgtgtagaataaaggacaagattactgtggactacaggttaataagcaaccagtcgaaaagaaaatgcatctgactgcactaaaacaaaaggtgagagatacctaatggtgagaaagatcaatgaagaagtcaggaatgtaccactgtcagtgataagtcagttttatgtatatgcaggaccagagacaatagactgctttgggtggttctagtccaagtgagtttctacccttcctgcagcctctacatgagggaggaggctaaccaagctaccttctctgattatagacttgctgcctttatcatgtcctagcttgatgaaaggaagagaagtatgttcttgaaaatgtctgttctttaaataaagattggaatgttgactaatatacaggattagactttctattttctgaattgaatttgtattttgcaatgtaaagtaactgtaggacattctattgcctgagaaagaccagaaaagccaagtgactaactcattttatatccacatggaacatgggggaattagctccatattatatgtttaaagggtcagtgaaagacaaaaataaaactgatttatgattgcttctcatgacttatggtttctcaatgtgctggtcatttcattgttcccatttatttcttaaaattacctcttcctttggtttccaagattctacttctcttatttgttttctaactctttttttggctactcctttttaatatgtcctttcaatttccacaactgtgtccctgatttcaaccactacatacatgttaatggctttcaaacacatgatcacccattcagatgcctgccacgcactctaggcctgtagccagctgtctctctgagttttacgcttgcaagtccctcgtgcatttcatttttaatatagtcagcacagaactaaccattacttcctcatctccacccaaataaaaataagtcttatgccatctcatgctatcatcatcttggtgaaaaagacgtaaaacttcaaataattattcaagtccaaacttcccaagtttgagtggggcttagattcttctcaggtttggcagaattggctctgttgttgagtagaatgagtctacaggctactgctggaaagtgctatggaaagcaagagctactgtatataatgcagcttctctaaaaagaatagaaagaataaagcttcccatggccatatgggacccaaggagatcagcaggatttgtctcttactaaatcagtcgtgtggaatgctggtaacttgacttgaccctcctatcccactgatgaattcagctgtctcttttcacttcaacattgataatcattacacaggaaatcctgtagcacagaagggcatggagaaggatattttaaaatgtgacaatgagaattgcttgagtttggacttttgttcaacattgaaaagagataaaagtgggttctttttaatgtttttccattcctcttttgaatgataccgttcttgaatctttttttgacttctggttgttattgtatatacaccaacattggctatattgaaaatgtgtaacaattgactaagatatatgggattccatcaagtataagaaatttttgttttttaaaggaaaaaattcacatgtaatgtaaatatatacagatatgcagtataggaaaacagctatgtcctaatgttaaaacaatgtttttgaaaacaaagtagattcaaaatcatttgaatctactttgaaatctaggcactgtggtaggttattacaaatagaaatgtttacatttataaaaattacattccaattataacaaatggaaattaaaacattaattttcaaaatatacagtagattataagtaacttattattatgaaaggggaagatacaagtatcatattatttcttcatcaacttggaaaataacctcacttccttatctgcctggttcacatattccttaccttcttcatgctctatttgttggatatagcaaggtttgctatattgttttctcttggtttatttgctacacagttttttgtattcccaagggcaaaataaataaaataaaatagacctcggccctaaactacacaaccaacaacaaaaatccaggcaacacaacaatgactttttgtgaccaagctggaaaatcatttgcctgtttccatctaagtggtttattcttcaaaagttactgaccagaaaaagggggcatgtattttaaaaagctgatcctagtgcaaacattactccatttacctctgacacataaagcaaacatgatttaatcagtatcgaaaacaatgaagcaaaaaaaatctgcccactgaaaaatcaataatgcaaaaaagtatatagtgtttgtctaacccaaaaacaatgagacaaaaatgggccatatttaattcatctcagttggtagtggagacccatatttgacaccctgcacttactggcactgtcctcaagttgacctgtgactatgactactctcccccatagcccccaggactgctccagttcatctggtaccccacagttttcttacataacaaccacacatcacaacccccaaaagtttcttccctaatgatataccctctctatattctatgttaccttgttttaagccttaaggagttagtggtatcactatttgtcccatttactagctgacacacactgaagttgtccatagagggtaggacaccaaggctggttagggagaataaaggctcagacttctggagcataaaatacagggaagttcttctatgcccagattatttttggttttactgcaaatgttctacatttcagcactaggttatagatttggtccagtaatcttttcacaggcctttatccgattgatctcaattggtcttttctctgagaaccaggtcaatgacttcagatgaaagcagataacttccttgtcaactgatttccttttatggtgtgataatggaaaaattagggagtgtgcctcatagattccctctcctcagtgactctttgtcagacagctggctgtcatctggggtgacagggtaaatgggccacaagcctgtcatcatctggcagccaaggcagggctttctcacaaggcagtggcagatttccaagaaagaaagcagaagcatgcaaagacacttgaggcccgaaccgtcaggatgttacttttaccttattctactggccaaagcaaggcacgaggcttaaccatgtttggaagtggtggggaataaacagactctccttttgatgagtagaactaattatacagttagctgcaaaggacatgcacagagggaaaggtgaagagttgtgatttttgcaatctcctatggctgccaaactatatattctctcttagtatagatgatatatgatctgataagaagtatcagtttttatatattagtagcatttattcaacgtgatgtaataggaataacatgcaactggacatcaggatatccaggtttcagttttgtcttttccactagaccagatacagtagcttcctattattggtggaataaattatctcaaactcagtggcttaaaacaacatgaatttttattatcttatagttctggaaatcagaggctctaaatgagtttcactaggctaaaatcaggcctgtgtttcttatggagattctaggaaaaaaaaaaacatttccttgattttcccagcttttagaggcaacctacaatcttttttttttttttttttctgagatggagttttgctcttgttgcccaggctggagtgcaatggtgcaatctcggctcaccacaacctccgcctcctgggttcaaatgattctcctgcctcagcctcccgagtagctgtgattacaagcatgcagcaccacccccagctaattttgtatttttaatagagacagggtttctccatgttggtcaggctggtttcaaactcccaacctcaggtgatctgcccgccttggcctcccaaagtgctgggattacaggcgtgagccaccgcacccatcgtacattctttagctcatggctccttccttcattttcaaagccagcagagcagtgtttccttggacctctgcttatgtccttacatgttttctctctgactcttaccctcctgccttcctttataaggaccgtagattacattgggcattcttggataatccaggataatctccccatctcaaaatccttaaccacatctgcaaaattccttttaccaagtaaggtaacattcacaagtttggaggattagaacttggatattgttggcgtgggcataatatgacctgctctaccagagttcagcaatctatagcctgggggtcagccacatgtttatgtaaatagagttttattagagcacaccaatgttaattctttacatattttctgtggttgctttcctgctacagcagcagagttgagttacaatagagctcatatggcctgcaaagcctaaaatatttactatctcatcctttatagataaagattgctgaccttgtaactagatttactgtcaccttggacaaattagtctcactaagcataatagaatcataactttatagactgggaaagaaccttaaaagtaattttggttaaactctaccctatacatttctctgcgtaaatcaccttttcagaaaaactggtgaatggccattcagcttctgctccaaaacatggaactaaaaggagctcactgtctcatgaagtagctcatgtttatttcaaacagctgtaattcttcaacaaatagaaatatattatttatattgaccaaaaagttgcagtcttttgactttcttgcctagtcttatttatgccttctgagaccatagagaataagtgaaatctctcttctatctgtgagcactttaaaaatttgattctgctatcatatctgaaagttatttagttatttgcataaatatgtggagtgtcaacaaaggagaaagagacagtgttctcagatcagaaccttgctgagcaagctgcctggacttagctgtcactattgcatggatgcaagggagtcactgcccctggtccagcttttatgagtttctctatttgtgcctgggaaattcaccaaagagggtggggttgcacactgttaacgtctccctttcagatgaggcactcgtatttccttgttcaataagccatgtaaatatggctttcagttcacacagcgtggatgcccaagcctcaaatccctctcctataattctgattccatctccaagagaattcagatgctgttagtagtctgtaactaaagcgaaactaagaagctcaatgaaaccacagctcctctgttaatcggggaaaaccaaactcctctagagggcactgtagcactcaccgaattctgtgaactgagaacactggtttaagagaatctgaacagataccagctcttaaagaaaactgtccattccctgggagtgaggttagccagggggacagagttaagccaataaaaaggggctcaaaagagctaacttgttactagagctacaaaccatgtttggattaatctccggtgtcctatcctaagtctaaagcttccctggtgctttattcactattaattcctgtatccgacaatatttactgaatccttactgtgtgctagcctttgtgttagggactgatggaaaaaactaagacaaaaacaaacaaaaaaactctgccgaatttctccaatttgccttgaagtctcattctcttttgtttattaataatccttatctaaaatcccttagcaattggagatctctttctccttcgttctttatgttgaatgatgtcttcatcatccccattagcaagttagaagaccgggagtaactttatacctatcctcccttctcttttcaattcggcctcccattctaccaattttacttaacatttctcaggtctatcctactcatttccattgctccttgccactgccccaaggtagcattatcttacttctgctcacctttccaggtttatctatcaccatttctcattatgaatttacatccaggagtactgaggtgcttgcaatttcataccctcttctgctttttcttttttttctctatttttgcccctccccgacttccctggcttatttctactcatcttttaacgttcagcccaagcatctcctccaagacttctacttaaaattacccttcccatcccttcttctgctaccagactagttaagttgccccttttctggacctttagagtctggatacatctttattaatgctgtttccgttttttcttgcatacgagattgtgagctccttgaggaccggggcaattctataagattcatctctacatccttgatgtttattccagtcctggaacatagctggccctcaatgaatgttatttatgtcaatcaatatttaaatcaatttgatagtacccatgagctgaggccccatagagaggaggggtgtacaaagagaaatgtcaataaattgacctatatatcttgggatatatctctgggcctcctacagcagttctccctcagatgatgaattttctgacaatgatgtgcattactgaaacatattcctttcattaatagttaggtttcaacagtaataattaggataaccatttctctcactgtttccacaactggaagaaattcctaagaaaggaaggtatatgaaatttgtgatgtaggagacagaggccaacttctttcccattgtaaccagcaaatactgagttatgtaagggtccaaagagaactatcatagcaaagtgctggcagagattagtgatgctttactcctgttttgtttaccataatgaactggtcaataaacatcacaaattgtttatctatataaatcttgacagattactctttatgaaatccatttagcaagcgaggttttcccataaggatgaaaaatgaagattttaaacagattgcgggagaagctctggctgtaccaagagagtcagtgtaataaaggtttctttatattaatattacaaaaaccatttatcctggcaaaatcaatattgcaattcatcttagtttggtgtttctctttctaagcttaaaatgtcttttcctttattatgtataattttgttttaataaatgtgaaatatatttcatttaggaggtactcttgaggagggataacttataaaatgacatcaaatttgtagcttatttgctaaagagtcttggaagtgtttaaaattatatttgagtggctgagaaatctaaaggaatcattttgcttaatccttaattacaaaattatccctgtgtcctttggggtaaaaacaaactacaattttcagaaaagtcttcgcttgtgaacttcatttaggaaaaattctctcttactgaagtcaagtgattataacaagtcagataagttgactataacaatggcttggataagagactataaaatcaagaatagacacatttaattgctcaaaacattgcgtgctttggctggaagaaaatagaactacatcaaggaacggaattatgttatacattggaagctattactctaaatgtactgtatgtaaaataagtgtgattgtctcatgagtgaatggtaataaaaactgaaatactcaagagacacttattcatgagtggtgcagttacacatacatatatacacacacacacacacacatacattgagagaagcttttctcttattgtttatgctcactaatattatattaaaagcctataaacaatagactctacataatagcctataaagaaattaagagcaaatcaagtatttttgcatctataattccattttaattataatacataattttcttcagctctaaaacttaacctaaacaaaacatctatttgaaatggaattctgatgtaatgtgtatagataaaagacctaatatagttgtttgaagggggaaaatgtccttttatcatgaccataaaaacggcaaactacagtacagtggttttcaagaaaaactgtactttatttattcccaaggggatattagtccataaaacaaatttgcagcttatttggcagtcttagcttttatcagcctttttaagggtgttgaatgattacccaagagatcacactgtaaaaatggcagtggggaaaagtaactccatccgttcagcatctttattagaatatataggtgaatccatttgatgttgttttaaacgtaccacaaggagagtaccttttaaatggtgagtggtcttcttacatgtgctgttttgcttctctaatacctcatggcaccaacgttgcttatcctaattagtgccattggcataggctacatgtttgaataattcactgtgaagaaacaagttttagtttctatcatggcaaaatgccactactggtatttttacaagcaactttgggtccaagaaatttaagttgcactaaagttatcttactatatttatgtcattagcatcttttcataaatcagaataatgctgtattctccaaccattatggataactaagtttagttcataaaacagaaaatgaaatataacccatattaaggcatcaaaaatatttgaacctgtctttctcaagcaattttcttagtgaaatttagtcttcatcgaactaactatagaattttaagatttttagggagagcaatgatttacccctgattttctatttcgcaattggagagtcacttgaaaagataattttatgggtacctaatctaaatgtttagctgacaggaacactgcttttgtaaaagcaaaatttacagcattcttaattgaacaactggattcaaactaatccataagatatattgtgggatgtaaaaaagcaatataatatctttttttgctattaattagtttataaagagaaagctttatacgggttttaccaggaacagtagttttataaagatcttttctattttcctttattttatgttgattctttgtttgtttagctcaagcattcttttcaatatattggctaaaacaagccgtcttactctacaatgctattggtaggtgtaacttatactatgaattattaatcaaaacactattctctttgatggtttatttgccttgttttcagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaagtaagtgaactctggttcagtgctggtgtgtgaagcagcatcatacaggggactgcatctcattgttttctttctccatttagaacccatcagaaaggcttagtacaatgtgaagaacgtaggtaagagatggaaaaaaatacactgaatgaaatatgtctgcttttccttgattagacaattggaaatggtaatataattatgttcatggtgggaaatttacaatagttttttggagtgaaatcaacaatgaagtgattaaagtcctaggttttcccagaccaagggtcttcccaggacacaagacttttaatggtaaaatcaggactatattggttaaaccaaaacagttggtcaccgacacaaagacatttccaggtaagttatttttttttgacaaataaagggtgaattcttgtttattatatgtttgatattcttccatcccccaaattttgtgggcagtattataccattagttgtttatcgatattgtaataattagtatcattcgtcacgcatattattcatcccataattcatgtttctttctactttaagtttcactcatttaaatatctctcacatttatatttttaattccttaaagcctaagattacatgtaagtatcttttgacttttcaacatcgcttttcagtaccttgaattgacctcacaaggtcacctgcagttctacaatttcataacatattgaccgttttcctatatttacttcaagatcatacatccttaccctttccagaatccctaagaaatgcctgctgggaacatgtggtaggagccctctacaacatattgtgctatgcatattctccttggggtgtcctgagactgtcatgagtcacaatgataggaaacgccacaagtcatgacagatcatcacaaaccagcatgcctggaactctgctatctacatttaaggggggagggagaaagataagtaatgggatattggactccacaacaactgtactagattttgaggtaatggaaagcaggatatagctagtgattaagaagacgtattcatattttgtacctgtgtagtttctcttcagcatcccgcatttcatcagtccctctggatttcagtataagtaaaactgtaggtatttatgcttcttttgggaaagaactgtcataattcctttcatgtataaatacagtctaaacataaatctggacttcattggccacttaattactatgtgtcatttattgattagcaatacaattgattgctttgtatgcaacaaaaattctagcatattccttttggatatgagttatggatcgtcatttataatggaattacgatacctaatcttagtgatttctgattggttctgccactaattttgtgacaatattggcacctgctctactttttgctacctattccttcttgcatttgagacatagtctgggaattatctctcaggcaaaactggatagtcatgtcactggaaagctagcctacaactcttagtagtggtagacatttaattttatgttttattaactggacattctttccaagtgtttctgatttgttagaatttttaaaaactctcacattcctaatgattcttccctggacatattccttttggttttttatctctttaaaattatgatatatcatactgagcacagttcttcaactcttgtggttgttgctgcttctgttttaggtttttatttaacaaaatttttgaaacactgtgtaaagttggaagctcagcatcagcagaggcaatttattagaaacaaatgagacaactttcctgccttcagaggaggtcaaaacatagctagagtgatggacactgataataggaggggagcagaaaaatgtaaatggtgggatgaggatgaagggtcccagccttctctcctgttccagcttgattttcacatggtacttgtgtttgatcctagcagaagccagccagaacaattggcttcacaaagatatgatgaaattgaaaggaatgtagtgctatctattgctgacacagtgaactacctctgactagtatttgtctctgtatccaacagatgtcaagaaatattttcatttaaaattaaaatttctcatggtaccccaccccctacacagtttgggaactgcaggattataaccctcattatatcttctaggggccactagcaataatttagtaatatcatctgtgatttttatttttggtgggctgtcagggtgggaatcctaggatgtaatttccaaaatgcaagaggattgaatgaaaataaagtagttagaccttttcttatagtaaatttcccttttgggtgattcacttctttcctttaaatattggtatcatgctttcaaaatgatagtcattcttcttgataggaagcaaaacaagaattaacataaattaaatagtcctattttctgtatgctttcctagcgaatgatattctagttagttcaaccatctatgaacctaactaaaattatacacatacacacacacacgtatacaattagccacttattgtttgatagtgtttgtcttcttgacactattctcattgttatttattcatctttatatccacattttttctttatctctccttgccagagagcctcttctagctctccttttattaacagctttattaaagtataatttacatattatatatttaacaattttaagtatatggtttgatggattttagtaaatttagacttgtgcaatcattactataatccaattgtagaacacttctgtcatttcaaaaagttcctttgtgcccatttccagtcaatcatgactcccacctctagccccaaacaactagttatagggtctttgatgagataattttgcctttcccatgagttttatataaatgaaattatacaacatttagactttttgcaatgtataggcttttgtatctagcttcatcttaacaaaatgtttttgaggttcagtcatattgttgcatgtctcagtagattcttttaattgctgagtagtattttatggatacactatattttgtttatccattgatcagttgacatttagattgttttcagcattggtctactatgaataatgcatccatgaacatacagttacaagtctctgtgtggacatgcatctttatatctctttatatcctgagaataaaaaggctggtttgtataccaaatatatttttaatgttttaggaaactgccaaattattttccaacatggctgtattattttacatttacattagcaacttataagagatccagttactctatggtctcagcaacatttggcattgactctatttcattatagccattcagtgagtgtgtagtagtatcttgttgtgattttagtttgcatttttcctgctgactaatgttgaacaacttttcatgtgtattgtcattcatgtgatttttggcaaagtatctttgaaatattttgcccgtgttttagttgttagtcctcttactgagttaaagaattccttattaatttgggataaaacttgcaaatagtcctctcattctgtggatttgtttttcattttttttattggtatactttaaaaagcaaaagcttttacttttcatgaagtcaatttaccaagcttttcctttatgggtcatgtttttgtgtcctatctaagaaattttggattgactcaatgtgaaaaaaaaaaattctccatttttatcttacagttttatacttaaacatttacatttagatccatgaaataatttgaattagttttgtacatggtatgagttaagcatctaagttctttatttcatttttattttttgacacataggtatccaaatgttccattaacatttgttgaaattgccatcctttccccattgaattacccaagcatctatgcaaaaatgcagttgaccccatagctaacatcatattcaataatgaaagactgagatctaagatcagacataatacagaaatgcccacatattagccagagcaggtaatcaagaaaaagtaagtaaaagtctcccaaattagaaagttgattttctttacttgtagatgatatgattctatatgtggaaaatccaaacaaattcacaagaaagctactagagctagtaaacaaattcagcaatgttctatgttacaagatcaacacacaaaattagttgtgtttctataagccagcaatgaataatttgaaaaagaaattaataaagcaatttcacttataatgcatcaaaaatttaaccaaggagatgaagacttgtacattatctgttttctgtgtttccaggaaacctatagtataattgcgcaatgttatttctatgcactgttccttttatgcttagccatgtgctctccagtgtctcatgagtttcatgcaggatctgtgtgtgatcacttttctattaggatgctaagatagaagtaattttcccattagtatatattatctgtggtaataaatatattacttattgccaaataagccatttataattcttgggatgtaagaatcaaggatgccttccagcacactggagggtagaggaaataaaggtgatatttattgaacaattactttatacacatatacacacacacacacccctacatacatatgtgcatgcacacacacacacacacacacacaaacacacacacaccttatcttcaaaataaccctgacggggagacattatcattctcttaatataaatgagaaaaggttcagagagtccaatcaatatttgactataatcatacaactaccaaagttccaaagctggagattcaagctggtggttcccaaagagatggatctagtcacaatattatactctcatcccataaaagagagtctggcatatgcaaagaccattcttggcaattttgatgagtgaatatgtgaacattttttaggaattctacttcaagcacataaaggttcaagttctctcatgctcaagatttaataatattattctcaaaagtgttggtaagtcatctaaaccttctggcttatgaaaatttcaacttaaataccaaagaggtactatttatttatgctgtggagtcagacaagattgtggttgacatggtcatagcaagtaatcagcttaaatgtttggaaagagcctctgtgtgtgaagaacttttgttgccaaggatattttcatgtaatgcaaatcattttctacaccctttgacatgggagtgaaacatctatctctctttcattttcattcatccccaaagcattttgctgccttagaaaatcatctgaaggtcagttttgattgctctaactctgaaatctgttgtgttcctgatagcatgcagagttttagatgaaatcactaatattcactaaaaaatgttaaattaccatgaattgcaaggttctttgagagtgctgtaaatgaggcagttgatgatatttgtggctccaccaagaacaacaggatttaaaaccctaaattaaaatccactgaaagggtcaaatgcattttcagtgttcaaccgatcaaagtgaccatatcaaatatggaaaattcatgaattcaaaaatgtaaggtgttattcggaaataattcttttctcatgtgtcattatgagattgttgctactcttttcctatgtctaaataggcatatagactgttggaatgttaatagaacaatgcaaattccaaagaagaaaaagacaaaaggagggcaatgagcatgtatctagtttgaatattttaaaacatatgatgtaaatattatatgccttaggatcagactttgtctttaggaagcctattcatagtacatggaattttatatattttacattcagtgctgtgcagaataaaacaacattttccccctctgttctcacaccaccatcaacatagttgaacaagcaattctgcagcattaatatcctacaatccagttcaactcttgcgctatatacctggaagtagtggcagattccacgggtgaggggtcagtccccaaggctgcccccaacttctaacaccaatcacaagctccaggttattttgcctgtgcttgtaacccactggctataaattggggctcctatgactccctccttgggttcaattactttggcagctcagctcaaaataaggaagcacttatttttactgatttatgatacaggatattgcaaagatacagatgaagcaatgcataggacaagatacgtggaaaggggagctgagcttccatgtcctccctaggtgtcacaccctccaggaacttccacgtgttaaactacatggagctctccctgtacccccaccaccccccaccaccccaaacaccctttttgttgttgttgttttagacagagtctcgctctgtcgccaggctggaatgcagtggcgatcttggctcactgcaacttccgactcccgggttcaaacgattcttccgcctgagcctgccgagtagctgggattacaggtgtgtgccaccatgcccagctaatttttgtatttttagtagagacggggtttcaccatgttggccaggatggtcttgatctcctgacctcgtgatccgcccgcctcgaccctttatagcaacttcattggataggcatgactgaagcatggatgtggcagactaccacaattactacttgagaccatcactacaacagttactactgttactatttgagactgtcattacaagactgaatgaaggaggatgaacgcagaaatgaaaacttaaaacaaaaataactattttacaggaagggtaacatggggaagaagaagaggggtccctgcttcttgtgagcaagggcagctgcctgagcttcttcagcccttcatatttattgggtagaaagagcagggaggaggagggcatgattggtcagctgcttgattgatcacagggtcatattattactaacaggcttcagatttgcctaataacaagaaacacttgtgcctgggtcatgactgccctcagcattccttccgggtgcagacgcagtttgtcagcttgccaacatcctgctttcatgagaacagtttgctgtttactcatatagcctccagtggtatacttagttgatcacgaccctcattcttttggccttcaacacatggacaactatgtagaaatgtgatttaaaaaaaaaaaggagtatgatttcatactaatcgactgagtggggaaaccctgcaaggctgcctattcagagtcttcttggcctctctctgcagtattcattcctccagggcatggggcaggactccttctaaaatgagggtctcatgacccacagtcagacaaggtaggtcagagaatttccttatggccggctctaagacagaaaggtggaggaacattagagtatatttttagtttccctggcctgccttggggagaaaaaggaacaggtagaagcagaacagaacagagacagaccctattttctgaggcctacttctgaagcctaaatctccccaatattgtaacaaaagactgtccttcacctgtatcactcttaaattgttctgaagctgcttcaggacccttggataaaagaccaatacttcaacaaaagataggcttattgtgttagtcaccaaggaaatagcaaaggctatggaagttatgagccaggaaccatggacaaaaacgtgtgtgtgtgtgtatggtgtataaatatcaaagtgctcttgaaatcctgtcttaaaatgtaataatttgattatattatatcttttagacagagttcatatattatatctattaaaaagagttcatcactcatgggtcctggtgaattagcaatagctctggggtggaagtctttgcttagtttgcagaataacttcactttactgttccctacttttccactttgctctgtcctccaagattctatgtggtttgcatcagcagcctccattgccctctggccatcagttagttgatttcagctgctaagagggacccaccaaacatctggagggcaggtggaaaaggaagtcaggatatttaattccccgctccctgtgtccatgtagaagcagcctcaagctaactgcatccctccatgagtggtcatagctcctgtcaggtgatgctcttcatacagtcatttctgtccctgagttctgtccccatttaagctagagatagtgtgcagagaagagttaacatagcaagcctgactgcttatttttagaaagacctgcttacaaagttggcctttggctgacatctggatccccactatccccagaactgataagagaggaccactgcacttaaacatttgtacaaagtacggtttatgcttaacacctgctttccttgtgggggtcttaaatttgggtaaatgccagatagaggctgctcataggaacagcccccaataaaaaccctgtgcactgagtttctaaggagcttccctgattggcaacacatcacacatattttcataatgcattgctgggggaattaggcccattctatctctactggaagagaattcttggaagcttgtgcttggtttcccctggacttcattgatatgccttttccctttgttgatgaattctgtaacatttcactgtaataaattttagccatgagtaggactatatgatgagtcctgagtcttcctagtgaatcattagacccagggttcagggttggcttgagaaaccctgacataaatagcaaaagagctctgcagttctgtacctgagagtactggaccatctcttttgcccacccttttgaaagtggttcctttattgagctctccccaagttactttttttgagtgtgctttcttttactgaggcttctagtgactgtagatatttcatataaaaatattaattatttgatggattcttttctgtaccttacatttacatatttcttaacaaaaagatgaatggtttaaaagtaaggtaacacagcaacctgtacccttgacatcttatttaaggagaatgtttgattaggttgtgcttctttaaatggatgggggattgtgcatcttgtttaaactagaaaatagtacgtaaactggtggttgattgtccctaaaaatatttagctgttgtttttctcctttatctttgcgtattctggtgaaaaaaaagaaaattcactctcaaaagcagggagactaagaaaaatttacagtgacagaacacaatgttttcatggtatatatttatattatagaaaacatcacttaagtagtgagatgaatgttcttatttcttatgtgcctgataagcaattgtattacatcttaaaaacacctctaacaggtgatggtacattcatatagtatattcaaatcgtttcttgataatatttagattatttaacatccatagctatttatatcaccaaatattattctttcttttacactgtgctctctgaagcaagataaagcattgtgcttaatggaatggaaagcttcctctcaaaaacccaaagattatgctacttaaatttcaagtttcaatggaacttatgtcaacttttaaattaactatgtaaaaaataaatgttgtgcatccttggatggtttctcaaaaaaaaaaaaaaaaggcaaagaaagaaatgcttaatgtaaactatggtggttttttacccccaactatatttatgccagctgctttgacctaaaaagtttttttatgcttatagataaaaagctttgttttagagaactcatgaaccctttgtttattaatgtcttggtaaaccacatgtcttcttgataaagcaatcctgaatcagaaagacctctttgctggatatcttacttcagtttgcttttctgtttattgattgctttgctaataaatgctctcttcattgtaatttagctccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtgagtttaagggtttggtaatagaaataaatattctgagaattgacacattagttaagttctttgacattgaggataaatgctgttgtggtttcctctgtctggcacagagtgtttcaaacagagataaaattacaaatttcactagtaatcaaagaaatacaataaaaatgagatgcttattatctgataaatactaatgcttatcacattctcaaagatgaaaaaaaaatgaccccatcaagaattgatgggaatgtggggaagctggaacttttataaactgctgaggtgtctgtgtgagttcattagtacaacttttcatgtacaataatttgttaaaatctatgaaaaaatctttccttttaacataacatttgacttagcaaacttattttaggaagtttatctcaagtgaacagtcattaagtagacacacaagatgtccatacctattctatttgtaacatcaaaatattgaaaatgattcagatgttcaacaatgtttcaggaaattatagtatatggcataacagaatcctggtacattgttaaataaattataggctatgatagcatataaactgataccttagttcacatatcaataaatggaaaatgttcatgacatattgtttaaggcaggggtccccaatccccaggctgtggacaggtactggtctgtgacctgttaggaacaggaccacacagcaggaggtgagcagcaggccggcgacattactgcctgagccctgcctcctgtcagttctgtggcggcatgagattctcataggaacaggaatcctattgcgaactgtgcatgcgagggatctaggttgcacgctccttatgataatctaataataaatataatgcgcttgaatcatgccaaaaccatccctcctcaccttcccatcctgggtccatggaaaaactgttttccatgaaaccagtccctggggccaaaaaagttggggaccactggtttaaagtaaataaagttattaaaataatctgagaattataccattttaatttacaaatactggaagacataataaatagatctagttttctctaattgtaaatattatagaaaatgtatcaaatatttctattataatgaattcaagttttttaattctcaggttaaagaactattaaatctggcagtggagtactaacactcaagcaaatagtgtaatttaatacacacattgctgtttccgcagagatagaacacagcaacataaacttttgaaagagaaaggatataaacaagccatcaagcctatctttgcctttgtaacttttatgaagattttaaaggagcttatagaaatcaaattattagaattcattgactttaaaaaacatttactcagatgttttagatacagtttccctaaagacagaatgaaaaaaataggaatttttacattattccagctctatcttctctgatttttgcttctagccatgtttagctacacactagtttaagaaacctcggaacagcaattccaattcaagtttctattttgttctcttcatttaatacacagttttccaaattctactttaaccatgcttaattagttggagaactgtttaaagctctgtcgaaacactgaaattccataaccttccttaaaatggttaggaggatgccttgttttaacattttaattgactttaaaactcctgcatcgcatagagttttattttgtatgcattatactgggtttcattttgcacctaattcatataactggaatttagtttcttatgtccacccctttgtcttggctctacatgtctcttcagtattccaagtcttctttaaagttaatggaaactctgaacttcatgatgcagattgcaaagggaaatgaacatctgtctacatctgccatgttggcaaagtatcctgaaaacctgctactagaatgtttattttcttccaaatatcagcatgatccaggtgtcctgaaacttaaacttttgtgacagagaaagagaggagttataaaaatattgaaaatgattttgaagatgacagtaccactgattatttctgaagttgtgaattagggtcaccctactttccatacagcttaatgcaatagcaaaattaaacttaaaactatcaatgatattattcaagccagaggcatgatttccatagtaacatattgtgatctattttatagaacatcacatgttagtacaacattggctgtttttgacgattgcactaataaggaatccaaataacattttcttacataataaatgtgtattcattcactaatcagacatttatataatcctattaaacaaggtatcatttcctaaaaccatatttttcattaaaaaatgccacttctggcatttcttgacaatcactgtaattaatgatgtgaaaattatctgcatgatggcatttgaacagtaagaacaattggttaacactgtcagaactttgtatcattctaacaatagcctcatgtttattactctatttctagtgcgtggctagcatgtgtaacatgtaaaggaaacactacttatattcagctggatgaacacaaatctttgggttaaataaaggcattaggaattataggtggagaatcattgaacttttcaaagaaaattaatagtgttgtcttccaagcaagtttgatagtttgtttgagacctttatagaattcttttttagaatggaaactttttctagctggcctaatgtactatgggattctctaagacatattttccttcttaggatcatgatatactggtgtaccatctttaaagctttcaaattgttattataatagcatgcaaataatgaataattttaaagattgtgaataattaactttaaaaaacaaggtatatctttacgttttatttaaggtagaggtcaagctagcgcttcgagaatcatacataatcagccctaacagtatctctattgtagcccccttctgggttgctcataggtatcttacgtgtcataggaaggaagtgaacagttattggaggaaatagcactcttctgttagtgttgcaggtttagggagtggacagtaactcatactgttttttggtgttgttcctatttgagtttggaatcaaaggagcactagacatagtaggcagatcaaatttaaaaataaaaacgatcttcattactgatgaaagtcagattagagactatatcctttttcctgcaggaagacaaattagaagagagaaaaatcaatgggctgatctgcacataatttgctccctacaccctgactccccagattcacagtcagatgagttgttcctcatttgggatggcatgaatggggagatagcccttaaatgtcactttagagaaatccttccacaggaactagaggatgattatttttacatgtaacaatgacttctatcacctacagatattatcgtagtttaagcttagaattttagacaaccaaatattttaatgagccctgggatttcatttctacccttattcatttccatctttaaaattataatttataatctcatactacatcaagggatcaatgtaacaagtggtaagatgattcagttagctctgagaggaataaatgaagaaatataagatatagagacaggatgagaaaacagaagagaagatgacaggcaactgtttttataaggctcttaatattcttaatgcggtagtttccccttatccatggttttgttttctgcagtttgttactcatggtcaacaatgttccaaaaataggtgagtctacagtacaataagatgttttgagagagagagaaagaccatattcacataactattattggggtatattgttataattgttctattttattttcagttattgttgttaatctcttactctgcctaacataaattaaactttatcatagatatgtatgtataggaaaaagaacagtatatatacacacatatatatgtatgtatatatatgtgtatatgtgtatatatatacatatatgtatgtgtgtgtatatatatatagtttaatactatttgttgttttaggaatccactggagatcttggaatgtatctcctgtggataagaggggactactatattctttcctggaacaatagatcaaatatgtatagaaaaatcattcatgtgtttaataaaattttgttcagtgcttattccagaccagaaactgtatcagtcattagaaatacaaagatgaaaggaatagttctccttactgagtggggagacatataagtaaaccaaagtaacaatagaatatataaatgttgaagcagagtaaacttggggtgttaaggaagcacacggtggcttgggaggtgtaggaaatgtaaccatgcctgtggtggcaatgatgtgatggagaaccactgaaagtttcccagtaaagaaagaatataagctgaattagccagatactgtagttgaggaagcgtgatggtcatgaaataaattttgtattaaaagaaaataaggtatattcagcaatcatgggcagttccatgtagctttggtaagtggtacaatgggggagtgctacaaaccaggagggtatcagccaagatcacaaatcagtgctgagccaaggactgtaaatgtttctctgaaaatgcagaagtctgtagtaacagcaaattttcaaattcagtgttaaagatccgtaccccaaccaaggagagcaactaccttgagataagcactcttttaacctgagtattatttttttgttatggatcattaatggatatcctattcataccctttcaaatgcttttatatctttcacactataaattgccttatatgatattcctacacaaatgcatatttccatcccaattctatctgattctaatttcttattaagtagactgctcttgtataatacattctgatctattaggattatattccacttttcagatgctacaaacattcagcaagtactgtacttcttttaattgtcatcaggttataagtcttccaacttccagtttaagcttatgccagacaatcttttggaatattcagcactgaaatttatttttttcttttaggttttggcttttggcatgctaaattattttccatcgttgttctagccttcagtgatttttcaaattttgttaatgttttcaacaaccttattgtgggataagggtaactttaatctaatctagtaaatatttattgaaataacaatgagccacagctgcacgctctctagaaagtctgaatctcagccctaggggacttttccaaatatgatccttctttgggtgctctgccttagcactaaggatggtgactttcccctgtctcttctattcctatattctttagagttttctgtaccacttagaaagtaaaaccaggcgacctctggtacccatggtacaactgaaaacagccaccagagagagaactgtctcaccttcctcggctctatcagggtcatctctgataagacagtggccctcacctgagtcagtgcccaaggtgccccccacaacaccagcggaggcctcctccactgagcagtcggaccccagagtgctctgtaggagctgtagactgggaagaagggccgggtgtggtggctcatggctgtcatcccaacactttgggaagctgaggtgggcggattgcttgagcccaggggttcaagaccaacctaggcaaaatggtgcaaccctatctctacaaaaaatacaaaaattagccgggcgtggtggtgggcacctgtagtcccagctattctatttgggagactgaggcaggagaatcgcttgaacccgggaggcagaagttgcagtgagccgagattgtgccactgcactccagcctgggtgacaaagtcagaccctgtcttcaaaaaaaaaaaaaaaagaaaaaagactgggaatgcctaggtttacacgatgggttatcactccaaagatttgtgtcttttgtggccaatggcagatccaggaaagaaatgaaagttgccgatggggataggctgggggagagcaatacagatgtgtatgggaaaccccaacccatatatattgtaaatagatggactaggctaaacattgttgctgtttcagtcttctgcaaactcagcttttccacaataaagctctatctcctgtcggaaggaaggaaggaaggaaggaaggaaggaaggaaggaagtaagagagggagggagggagggagggagggaggaagggagggagtgagggagggatggggggaggggaaggggaaggggaagcacatgaatatgctgggaccttcatattgctatagggcacccctgcttaatggaaccctcctcgcatctccaatgcaaacagccccatggcggagcaggcagcagccactctggtatttgtgtgtttcgcagtcctacagtgtgtttcctgtccttagagaacaaggatttccagccatgtgcctaatcacctccactccctatcttattttttaaaaacctctttgtagctgcttctctttgccctcacaatccttcatgcatagaagtcctgcttatctaaaacttctgttgtgtaaattcctcattgctgataacaaatgtctccaaaatttagcagcttaaaacaataaacatttataatttctgtaggtcagaaaataagaaaattttccattcaagatgttggccaggtgacagatttaccccttggtggtagtttactgacccttagtctggtgtgtttagtgtttaacaagcaaaccagttacatagaggaaacatagttacttttctgttttggagaaccgcaaggactttctcttagaccttctaacaaaaggacactatgaaaagcaaaagaagaactaaaacaaacatctaaacattctttattatgaatgatactttcttatactcaataataaaagcaatcaaccggtatttacattatttcaattttaaaaatatgaaatgtatccttaatcaaaagagtagattggtatagtttatgtaattaaataatatgataggaaagcagttagcaatgattcttcaccaacttgtgaaatgtaactttgttttttttttttcttttcatttcaggtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggtaagaatccaaggctgagattcccctttttggtcaagacatgaatgagaatctattgtaattgtgcaattaggaatttggcagttgtattcctttttataactgcacaatataataattgagaaacagtttctaaagatataagatagtatttgtcctggttagtggaacaagtgtatttcttctaatctaataacaaattccattcaattaaattgccccttaaaaggctaatattatctttgctcttaatgacatctgccataacacaaatgatgtttataatttgaaactcacttatgaaatgcattatatttgactgtgtcacaagttagggcacccacaagcagtacatttttctcttctaagcaagaaaaagatataaaatgatacaaaaaatatgtatataagctaactgactccattaagttaatttttgcattcatgcatttgaacccttggttatataggccagacacacattcacagatttttaatcatttatatcatgtacatattatagcaaaatctttctttagatttgtaaagttatttggtaaaactgggtagagattgactataacatttatgcaaacagggcttatgttaaacaagttaaattaaaacctccaaatttgaaaggatacagactggagctataatgatcaaattccccaaaagaactggccattcttaacagaaattgtgaatatcaattctgaaaaagattgaatttacctatgataaagtgtagttattttttgtctatgtgttatccattttggtttgttttcctcatgagtatgcctttaatagtattttatacattcatctatatagcagtttgttgtcttctatgtacctgtcatctagattactaaactactaaatcactacattttgaatgctaaagaaattgacagtaatctaattagaaagacaatgaatatccagcactctttaactgacctgtccctaccctacccctaaagtaacccctttgtctgatgagttacgtaggttcactatttaatttctctaggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcaggtaaagatcaatgttttaaattctacttttaaaacctctgaatgcaaatgtttcctcaaattaaagtcaaagtactgtgaaagtacattttgaaaagcaagaattagaaacttccatagaccaaggaaaattttcatatatatggatttgttacataaacaactcaaggtcataaagtacttgcagcaagttctagggggcaaaagtaaatgctttagttattaattcatggggcgaaaatggcttaactatagttatagtcttctgggaatgtttgtcaaaaatagcatttggtttccactcctgaagtggattggacacatgtctcatcttgctccatatacagcctaatttatgttcaatgaaagagataactgtcaccaattccacaaatttgtctttgtttttatttatctttccaaaataaatagtttagatactagattgtacataatgacagaatcgtggacatcaaaatctataattcacaagtgtgcttgtaagcagttggcatgatgataaggaaggaggacaacatatctaaattttctggattatcttcattaaggcaaaaatttttaatcctccactttattttttatattaaaacacttcaaatttcatgagcctttaagaaaaaaaatacacttttgttatgtgtttaatctgtagatatcaaagaaacccaaaccctgatctaaacttgacctgttaggaatatggaggatgagggtagctttaggttgatgtccaagggaatcatttcatgaataaaatacgcattgtgcttgagcatctcttaatgactaccagccatcttggacaaataatagagccatgatagcacaagtgatgaggcatggcattctggaaggggaaaatcaaggtcagaaatgaaaagtaatgggtgaaactgcaatactggtccctcgtaatcttatgggtcactagctaatgaaagtgcaatgagttcctttgataatacacctttggttagcacatttaaaatccctgtaaagagctcaggagtggcaggggggaaagggaaatgcatgtgtatgtaacctgaacatttcaagaaaaatttaacaaaaactttgagacattcattggggttatttagaatgctttaggtttacctctttctgaagaataatattcagccagctgcattggattggctcaatgacatatttccctacatgggaaatccagtacatcaccatgcatttttctgaactttttgaactgagatgttctatttttgtgacgttttttagatactcgtaagacttataatttcctatctatccactttcctatctttatgaacatgagcaaattcctatgagatttttattttgcaagtagaaagtagctggtaatatgaagatggagaatatactttcagataacattttaaaaagtgaataccttttacatataccagcatattcttggactttttcaaagcagaatattttaaaaggtaaaggtatttcagaaactaaatgaatgtgtgaattcaatttaaaaatatatagggacgacattcattgttttgatgttattgttattgttctcattgatagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacaggtattgttatttttaactaatgtcctttcagaattggcttagggcttcatttggacattttttgagtttgcagaattctgtgacagaattctccctctatattgattaaacagggcattttttcttaatataatattatgtgtacaagcctccctctttgtatgtcacttgtatttttccagtataatcatatattgaaactaagttggtataatttatttcataagacttgttttttttccatttatcatgtatccttaaatattttacatgaagttgactttcattaactgtgtactatcatgttatttggacacacaataattatttaaccagtccacactcagttgatattgtattgtattaattcttttggaaatataaataacattgataaaacttcttatatgtacatttcatatacatttctacttcaaaaatctgaagaattgaatttatcacagcttataacaaaatgaattatgaatatgttcaaagttttgaatatacagtcatatattgccttctagtaattcatcccccagctagcagtagtgagaataattatcatagctaaaagttactgaggctttactgtgtacgtgaactaattcatctgatacatacagcaatcctagaggataggaggctcttgttctctccagtttacagttgtggctgatatacctctctgcccattttaccagcatccaggtggccaatagcagaagctgatggaaggatgtcaaccgaacaagttcttctgtgtatttggctgttcagtgcctcctctgagagagatgctcttctctgggcattagcataagataaaaagatctttacactttatacctactcccatagatctagccacatttttctttccatgaattcctagttcctgatccttccatctttttttttcatgcccttggccaatatttccaagccactgccatattgtccaggtacattttaccttgagacacgtctctttccacacaacatgggtgaccaggtgaactgcctgaagttctgcccactaagaggatttcttcgctctgctgtttcacagggtcatctctgacaagggttttagagcaacagctaccatttagacttgcagccacataccaagacatcctatctgtaaactaaattctgctttttttccacattctttcagctcttaagggacctcccatgggtcataggtatgagctgaggttgagccaccagtataagaatggtggatgtcatgggggcctgaaccacctgcttgcacaatgtattacggcttttggctctgcttatacccaatctcagacatccacttccattttatgatgaatttctgttgggcccttctaacctcaagacttggctgagacaattccaagattataaaaaagtagctctagctgcatggctatttggtgttccatgaccagatgttctgtttttactgaagcctgaaagcatgctagggccatttagcaaatggtatatagtttccattacatgttatgcctttgttccaagctcttggggtctatctgccctgtgattctctttctatgtgtgccttgcaacattttttcccacaatgcttacctctagtgctgtaaaaattactacatgttatgtcccaagtggctcatctgcctgtaccacaggctggacctggtgcagagccctttccgcctctgggatgcactcaaaactggcagcattccatattactcagtaaatttctcagaacagtattctcaaatgtggaatatgctcccttcagaatgtgaagaggtcaactagacattttgtttccttcttagtggtggtagaagcaaggtgcaataatttgtcctttattttggaggggatatcctagcatgtctcaggccacttgaactcctaaaaacttcactgatatggtagattccttaatcttcataatattgctgtctcactttctagaacacatatgtcttacctctgcatacctaccatttcttgtttgtctgattcatttaatatgatgctatcgatataaagaatactgtcaaggtggcatttatagtttgtcttaaattggtgattaatcaccctcagatttcctttgtctttcttcagtgcattgatggcgaccagcaagatccatgcattgtccttataattactagtttccccagagtagtccttgtaattactaattccaccaaaccagtgaattaccttctactggtaactcatcgcagttcaccactaatggaagtttaagcattgcaccactagggcatgctgtggactgttagtactctacctgctgtctatgatgagatcattgtaaaccagcaagtggatgatggagctccaaaatatcattttagagtctccttcctagggccagtcctgttacgactatcttagggcaaattcccccggaagcagactcttggtagaggactgagtacaggaggtttattgggggaactctttcagaaacaacaaatgtgaagtgataaagtatgtaggattgagcagcaaagaagctgaactgtgatgcaatagtggaagcagcctcagcggattccgtgggtagttctggagctgaaatgaccctcttagcttatctcaaattaagctaggaagtcagacctttgtaccctagagtatttgtgtcctcgggctggtgtaacaaattaacataaactgagtgtcttaaaacaacggaaatttaggtgttagtacagccaggtcccccacaggctctaggagacaattcttctcttctacctacctgtggctcctggtgttccttggcttgtggcaacataactctaatatctgctgcctctgtcttcacaagtcctactctgtgtctctgtctcctctgggtctgtgtgtccgtctcatttctcccataaaaataccagtcattggattttaagctaacctgaaatccaggatgacaactaattaattacatctgcaaagaccttatttccaaacaaggtcttattctgaatttttgggagacactatacaatccactactaataggtttgccatttttttctaagcctttttaggagaccagaacccatgtacaacacacaattttattttctatactgatgaaaaagaagagccaataaataatttatgattacttatttttcattaatctgtctacgtgttcactcatttgcaattatctcatgatgaatacacaactggcataatatatatattttgacttaaacaggttagtctaccgatctggtataccatgggatttaaggtaaagttagttgtaactttcatgtggtctttgccatgttgtatctcatttatactcaatgttttattttgttgtttttactattctctggctttataaactattctttctttgtaaaacacagttttgatttatctattacttatattatagtagttgttgttctaagaaaaaaataaggtgagaaatattatttataaaatacagccttagaagtcaacctgtttgttcatattccacatctcccaattattagctgtatcacacgtctctctgcttctggttttattcatctgtgaaatgggaaaaccatttttgctcacctacctgcttaaagagcctgataaatattgacacattattattagtgattattattaatggtgtggaactacattatactttataaactagctatcatttaatggggcaggaaaataaatatttttattattgttgttgttatttaaaaggctgttccttatggctgaactggaataaggacatagatatatcaccttattctcttttttatttttatttctttgagacagagtctcgctctgtcacccaggcttgagtgcagtggcgcaatctcagttcactgcaatcttctcttcctgggttcaagcaattcttgtgcttcagccttccaagtagctgggactacaggtgtgtgccactacacctgactaattttttttttaatttttatttttagtagagacagggttttgccatctttgccaggttggtcttgaacccctagcctcaagtgatccacccgcctcggtctcccaaaatactgggattacaggcatgagccactgcactgggcctaccttattctcttttgaactctctctcctgtgcaaatattctctgttcaaggaaatgaaatcaaaagtagcagaacaaagtccaattttttaccttctcaatgattaaatttgtatctgaactgacctgagtatgtcttgttataatctttgtaaataaatagccaaaattcccagggaaaatctactataaaaataactagtaagaaacctttgcctaagaatgagacaggggggatacgtaaaagtggtgatgatgtaggattcattgtgggggatcaagctgctgtagaatttttcctacccctttgaagacttatttcatgaaaaactttcaattagatagattttataagacttataaattgactctatgtacatgataaagacaaagtctatccaagtgataattttatgctgcaagttctggggccaataatgtatttttaaaataatgtaatttataataatcatctgtaaagaaggaaaagccttttcaaaataaatattagtgtagatttcttctttcttattttatttcatcgtgggttcttgctacaaagaatattttgcttaaaaaatagttgtacttcctaaattaaataagaaatagcttcatgtactttatcctaaaaacaataccattttctaaaaatttacattgaaatctaccaggattattctaaaagggatgaatattacagcaatattcataagtttaactcagttcaaggtttattttacttagaaaattttaaatcacatttcacagaaaagtttgtatcttcattatatcaataatgattttaaaattagaaaaataaagaattacttggtatttgatgtttttcttatttcaaaatgtaattgcaaggaaatggttttaaagttttaaatttaaattattcctagagttttagaatctttaaaaacacctttatttctgaatgttattgaaacactgtattctacattccaatctcactgctttttagaacaactcatgtaacttacgaaattttaaagtcaacacctaggcaaatattccaaatgaattttattttacccctaaagagaaagtctctagaaaactactccaaatgttactgaactttacatttatctgtatttatatttatggaagattattttatatgactatgtatcagtagccctaagaaaattagttttgtactcatagttactgtcatactctctgttttaatgacttttattttctgaatataatttctagtggcctttgtacctacaacctaaacaaatttacatggttgcttttgatcacttcaaattataatgacagaaccaactctcaatgttaattgtttaataatttatttatggactgtgagtttcctgtcagtcttctttgctcaaatctgctattttcatttgaaattatatgataaagataatatttcaaataacgtaactgtttgatctaatctttatatgtttgtttatataagaaagatgattgagaattgacttaacgtggatgctcagtaatatgcttaatgtttaattttttcccctttttcttctgtgactttttttcataaagaaaatgatagtatcgatttaacatagcaacggcatttctttctgtcctagcaccatcaaatagcttgggtattactgctctgggttacttttggccaagccccatggctttgtttggactttatcatgataacaatgacaatgtcaccgtctttatctctaccattggtgacaataaccataccaccatgctgctttatgaggcaataacttggttttctcatttatccactcaggaactggattattacctcataaaacagtgtgattgtacaataatcaattaaatcctggcttgtcgagactcttcagaaaaaaaaaaaaaaacccttttcctaatggtggttggcaataattccctctgtctgaattcatggaactttgactgccaaggttatattttcacactgattacctattatctttctttctttctttctttcttttttgccttgaagctgttgcacactgctaaatcccaagaactatcttacactgtagaaggactgaaaccttataggatatatgagtttactattactctctgcaattcagttggttgtgtgaccagtgcttcgggagcaggacaaactttagcagcaggtaagcaagttttaatggatatgaaaaatctgttgcctatcaagaaaaaaaacttataatattcaacaccttctctacttgagactttatatttgtcttctcctccctcactaactctgattgcttcttacctcaacagttttaaacaacaacaaccaaaacgtaacttaaagaggtacctaggagctacgagttacagctgtgtcataataagaaatataattagtggtagagtgactccactctacaactagaaatatatagaatatacaactagaaacatatacaaatatatagaactagaaatacatagaaatgtaattagttgtagcgtgactccagggcttaactaccaacctgtgtcctagcagtgtcctgacaattgtgagaaacaatcaggaagcttcttatgaggacgttaggatacctcttccctcagtccagacattttttgtaggcttggctctactcactcctgatccatgggaacatctagaaattactgtgtggcctggtgttatatttggctttcatgaaataggtaaatgtttatctattgttttattaagaagaagctcttaagttaataaaatttaaataaaagaattgttattaagtataatctgagtagaaatggtttgtataatttgtgcttgcttcattcaggactaactggattcatacaaacctgattacatgtattagtaagacttataaaacccaattatttagcattaatatattttcaaatcagtgtttttctgattctagataaaagcttagtttcctggttatctttaaagaaatgtccatgtgtaaggaggttaagacactctagatgaattacagatattacgaaaattcatgtttacctgtaaaaacatttcctagacctcctccccaaatcccttcatcctattattaataggtccaattatgtagggttttttttctggttctggaaaaaattgcttagctcaaatgatctcatccaagtaatttatttttttcaaaattttcattaatgcaaacaactctgaaattctaagaaattatggtttactaaatttataactgaacactttgtatttttatgtattttatagatgtgcatttcagatgcatgaatacattgatggagtacctagcttgtacaaaacactcttctcctataaaactatctgtttttgtatactgtattattaaaggtttactgaatgctgaatatggacagcagaggaggactctatctcctttaaatgatacaatttcagactagaagacaaaaattaaaataagaatcagtcttacaagttggagaaagtaaaaatggagacaacggagggtgaagactgggtgtgttatagtaggggacatagggatcccaagcacgtggccatgcaaaactggaatcacatcctctcagggttgcaaaacatgtaaaaataatctagtgttactatatagccagtatcaatatattctttgtaatattcccccaagtgttcatctaacccatgtctgataccttcagtgttacggaaactactacgtctcagacaaagctataccatctttagatacctcttttagaatgtgatttcttagattggtcaaaaatatctcctagtaacttctactcaacattcttattctacttccttgggggctgtcgttaacctaatttatcatccttccaataacattttcaataacattatatccacccaagtcttttctcctttaggctgcatatcatggtggttcccatctgaacctcatatgcaatagtgtctagagctgttattagtataattcttgtagatgagatctagtctgccttttcatagatataagcaaactaaagaacctgaagagagacatgcccgtccctagaaactagctggatcatggagatgggaatagaagagcaggaaacatgtctacagaatagaatctgcctgccctatgcattagtggtaacatctgtgctaatagtatcctcgttggttgcagtggcaaaatcctgttgcgtaaaagatgatgtacctgggtgctctgtgcagctctcattttagttactggtgaggcgattaaaacgactcctgtccactggcaggattgtgaagtaaaactaactagtcagagccctctgaatcctctctctattttttttatccttgaaaaatagaactggaaacttatattcgctaaaagtcatgtgacgtgaaagttagttgacttacaaaaataagagtttattcatatatgtgaggggaaaaaaatggttagccaaaatgccagggtttcaatccgggctctgccattgactagctgtgtgaccttatataaattatctaacctctgtgccttagttttccaatttataaataagcataacttatttgtagggttctgatgaggattagaattagttaatacatgtaaaatatttaaagcagtgcccatcacagttcattctcaataaaaatttattgtcatgatttttatcataatattatagaagacttttgttagtcacagtataaatgttatggaatttctaatgttatcaaaatcaaggagagtttattttacaactttgattttctaacattattataaaatataaaatggagagttctaaaactaaggattgtattgtgaaaataaaacttagaaaggcttaaaatctgaaagcattatttattatttctgtaagaagtatgtcattcagaattattatgcacatttcaaaactttgctcaaaaacagcaaatttcacatttgttggttgcaatatagagttaataatgtgccataaatgtattattactacattttattgtgaatgctcaattcagaaccatctcttgagggcttactatttaaagcactgtggaggattctaagataattatactcagcatttgggttaaggagttgagatccaacaggtaggattaacaccatggcgacatgtgctaagggctgtgagaaaggtgaaaaaaatgctatgggaaggtagaaaatgagataaatgattttgatttgggagactgagtagatacctcattaaatgctatttcagataaactataaaagaatggtaaagactttcgcagatatttactgagcacatacaatgtgctagtttctgttttaggggctggcactgttccaagtactgatgtaatgaaagcagagatttatgaagacttccctggtggtagagtacacaatagattagaagagggagtgtaataagtgtctggtagacttttttaaaaaggcaataagagagtaaatcagacgagtagaagtgaagattgaaagaagggaatggagtgacttcaaggaagacagacctggaagttaagcagtgggaaggatggacaatgatagcaaatattgcagcccatggtggtgccattaaataaaaggggaaagatgaacaaagaacagatgggagaaataaactcgtgagtttatttgatcatttgatagaaacacatccatgccaattataaccatccaggagcagaaattgcaaatctggggcttaaaaatgatgcagattttgtattcatctgcatatagatgggagctaatgctataggttataatcaattagtgaaagcagagaaaatgcaaaatggaagcccaaagaaaacaccttagtgaatattctatctgggaagaaagaagaaaggaagagtgaagtgaacagaggtatggtcagaattaggaaaagaactgagaggaagcagtatcagaaaagtcaagggaagagagaattctagaaggagaatattgtctgcagtgtcatatggtatagggaaagcaagagaaatgtgacctaaaatggatgcgaggtcactggtgactctctggggattaccctaattagcatggttgaagcagaagctggaacatgaaggattgagcagcggcaggaggagatatagtggtaaatttcaaatgtgtttttttttttttattctttgctaaaatttttcttctacccaattttcattcttcaaaaaattgtattaccttttgtttccatataaaatcctttcttttctaaagaaaaatttattttagtgtttgtttttttctggaaaaaatgtttattttctaattccttaatatattttgttagaactatctgattcttcacctgcccagcagaaaaagaaagtctcttatatgacaaaagtatggaaaaataatttttacttacagttgggtttattataaaatacatcatttttagggttgttcagatcagtgaaaataaacttatttgcttttatttgaataccaggaaaaaattataaatccatcattctttttgcctccttccttattcagtagatgaatgtgtatttctaaatgtttttccaaaacaaaacatctgaatagaaagtatagacattaaatcatagaaatacactgcagacctataataaagccagttctttagaatggtcaacaattttgctataggagagtaataaaagttgacttgcaactttactgttcatcctgctctgttttttctactattaacattgcaatttggagagtatatattattccaatgaactccaatggatttgtgggaaatttaactcttatgtctaatagctcatatgagctcattatcagacatcaatggaaacgagtgaccattcaaaaattttgaaaaagagcaccacaaattagaagtagtaattagccttttggaagcatttgaatcatgaaaagatatgttgcccccttaaatctcggtctcaaaaatcagaaagatacttgtgaagatttatcttgctgtttcattaaaaagcttgagaattataattggctctctcttgttttaaacattttttcaattaaatatatgattagaatgggtacatttcatccagagtattgcactgctgcttctttagtttcaatgcctgtgacaaagtctgagaactgatttgagagaggtgttctctcaggagcagctgcatctctctccattgcaaaatcttcaagcagtgttattaatggctttggagttgcttctgggtgtatgaaggtaatgagttgatgaactgggccctcttaaaatccttgttacacttttctttaagattctccttttaatctgagaaatttgtgcatttccacccattgcaaattgagtttagtttaaacccttcttatgagaaattacttttggagatccattcctgaagggacaatgtgatatttcccttgcctgtcataaattgacctccatactacaagcttagaagtgcccatctcgcataaaacaagtaattggtgtgcattaaattttctttctgaatgcaaagtaaaatgtataggctgtttgctgctgggttgaaaacacacattgttttgcattcgggtacataagtcttttccttgtgaataggagccagagtgattaaacaagcactcttaatatgttaatttataattttaattacaacaatcttgtatatatagtcattagtgaatactaatataaatatttttctacctttttattcataatgcataaaccaatcacccagttacttctctgaggttgcctgtttttgtttcataatacaatctttgttcttagttatgaatgcattttgttcattcctgtcttcaataatccctcattaagctagtcactttctgctccatgctaaaaaggaaaaattatcatgcaaatgtggcatgccatattaaaaagcacattaccaaacacttttgttgctgtccttcaattagtttcccttctttgaatttaattccatttgttgttaaactactgacttgatgtatggactcatgaatctgaggctgctgccaagaaagtggggaaaaaaaatcaaagcctcttcgaagagctgcagaggcgagctgaaatgaatttgcttcacctttgacaagaacacttgaacagcattggaatcctctgatgattcaacttggctaattatccaattatttatttcaagaataaaggcaccattttacaattaaggaagtgtaaagtagtctgagaaatttggtaatgacagatgacttaagtaacttctaagataaacagtatctgtgcaaaacttgtcccaccaattgttttcaggcagcagttggtgtgtcttagcatcagtgaaatcctgagtacactgaaggttttttgtttgtttgttttgctctttcaacagaaattattttacacttgtaaccaacatgtcaaatttccatggctcttaagcaatgtttaagttatatttctcttgattaaaagctttcggttcaaagcaatactttttaattgcctaatgatataagtcagttcttaggaaagaaccgcacatttaggagttcatttgcaatataactgaaaaattcattgcatggcagtaaaacaatttactgttaattacaaggagaagaatttgctgtagcatgctcgcagattgccatgaatcatgcagcactcctagagatttataacagatgtgtaaatgggatgaattagcagggtttaataacagagacacaaatcatgcagacttcaaggagctttaattgatatactagaatgtgacgggcatgaatcactcagccattcaacagcactgtaacatatggtcagctcaatatgccgcatcttaaatcggttggtgagtcgtaggttgtcccatatggtggaagcaatacatttttcatgattaaaaaaaagaatccattttttaaagaaatatgattgcaaagcatgttattgaacagtcttctgaatgccaaactgctttttttaaatgcttttttttttctttaacatggcagcttctcaaaataaataggggctactccttgtaataccagatcgctggaggcattatgagaaccaaatcggtgcttgttggcacactcgatccacagcaagcctatagaaaagcgcagctgatgattgctgtgattgtcagggaaatccttcaggctggggcaaaacaaacaaatgaaaggatgatgtcactttcagagaagttcaggaatgcccagctttgtaaattgaagaaaatgagttggatgagagatccctgcttagcagggtaagaaagtggctgtgataaataataccatgacccctaaggtaacaattggatgtaacattttatactaacttcttaattaaatgctcagtcctacaggggcatgtgaaaagaagcactggctggtcatcacatagatggtagcaccaattccaagtcattcttgaagaattatttcagtatctgcaaacaggtaccctggttgaagactggtaactggtagtgtgcaaacatgtttttattggaactgggatctggcagcttttggaaaagcttttgctgcattagtaaatctgacagacttgaaaaaggaatattgcagccttagaactgtggctgccagaatttaatgtcaacaattaaaatttattttgatccttacctagtgtttattactgtttgtatacacaacagaccttactaatacagagatgcactattagatggaattaccatctgttcagagtgaaatgctggcatctgtcttagatgctaaaactaaaatgatattatttctaacaaaacaaaattaactgctttttactcaccaactttaatttgtagtgtgtagttgtatccaaggaaaaggcttgattttgaactatgtgatgacctctgtggccaggtctatatttagatatgcgactttatcaggggctctactggcctttttggcatatgaaaatggcatgtagaaatcacactttcaatacacaattatagcttcataatatactatgtatcctataagtcattaaaacaacacaaccaagctatgtaaaaattgactgaatcagagagactctactatgcaaaatattttgacagatacgccctaaaaaactgcaaggaaagaaattaaataggcaaaaaatcatctgaacaaagttgctataggtcccacagtgacatctttaggaaaatacaaactgtatctttcttctctgttagactattttaaattttctcccacatggacatatataaaaaatttacattcagtgccccctccttttaatttaaagcctaagtatcctattaaaataggtctttagcttttggaagttagagaatttggaggatcaaggacaatggtagtttccatactgatgttagatcagtgacgctactttctgagaagccagacttctattctatatatcacaaaataataaattgtgtcacaccagcatttaatgcatgtacacagtgcattaactgtaactgtagtacatttatttgtgctgcaggagacttgaaaatgatgaagaaatcgatactttgctgtcagagaagcaagtgttacgatgcatttaagtagttaattgcataagccccataaaagcttcaagtttgggtagcaaggatgccataattacagtctgagcaactaccttttattagtggtggactttagggaatggtggttgctgtcatcattgctgctatatgtgcagtttagaaataatggatcctcttctctcttcatgtgtaggatggtagttttgtgcaaattattgtgatcgccagaacaataactggttaaggtagtgtttgttcaccatgttcactgaacttctctaaaagcagggttttctttatgtcacagaacacatagacaaatcatatttgtatgccatgctaaggtaaaggaacaaggtggctgagagctgaaggggataaaccagaggggctcctgctggcttcccaggagcaaaggggatcaggatgtctggtacccattcgtggcttatgaacttagaagtactgttttaaattattcaaccaaagaattttgaaactggaagaggtcctagacataatcaagcctgtcactctaacaattgaagtaaccgaagaatagagagacctaataatggattaaccaatgttccataatcagggtcttaaagagccaatctagagcctacattttctcctttccagatcttctagtaatatcctctcctgaaggtgacttgtcaacaaagaagaaagtggcaaaatatattttattctttcttccctggtcagataatagacagtcaacaagatgatgctgagtcacccctgagagtttcgggggaaaacttttcctctttaagacactgattggtgagcagctgattctgcagcagtctctctgcaacagagaaatcagggctcatgacctggacttcttgtttgcgtcctggtccagtgcccttttgcaagtgttctggcctagcagtgtttggcaaattgtatttcctggcatagttttgcatttctgcgaaaaagtcaaaatcatattctattgacagggtgcttattaagaatgtcttatgtagtctgctccccacccacccctgaaacatagaaaaattgtttattcttaaattcttgtcatcatcatagaaagctgatgatgctttaagatattgacacagccatacagtcttcataggcaaaaaatgaacagattccttaaaaacaaatgaacagattccattttaaagaccagtacctcagaagagctttgttcagcttttagttcttatcctatggtgctcaaaatgctacactacataaattttgcaagtctaaatgtattcatttggatatactactaattatgttataaagtaataaatgctgcataaagaatgcatattataacattttataaaaatatctatacatcgaatagatagacaagaaattagattacccctattaaaaaatacaagtgctattttaaaagtacaagaattttgtacttttattcaaatagacattttattcttagaaatgatggataatgaacattcattttaaactttgtatattatccttagaaataatgaatattgaagattcgttttaaactttacatttacaagaattttctgggtaaatacagatagattttgaatatagatgaattgtattccttaatcatacataatttgaaagatttgttcttgtaatgatagcaccttatatttgtatagaaacttgttttctaaaacataaagcaaatatgtatattgttgtagaagcaattgttgtcaatgtatgtcactgaaaatgtatcctcatgttgcagatgggaaagtgggagcagatataaagggatttttctaagatcacacagatttagacattaaaaagtgaaatataatttttaaaagtctaccaaatccctttcattattcagtgttgtctcttaacgaactgttttgtaaattaacaaatctttaaaagtcatatctacttttacctatagttccttttccttgaaaatctgacgaataattcatcattaccccaatctcttggtgattctatgtgcatgtatgtgtgtgtgtttaatggttcagaagtatctatttttcttcttattctacttgtgtgtatgtgagaccagtctagtttaattgattgacaatttcacttaattcccccttccagccttagaagaactctgaaaagaataactcagtaggatgttcaccctttcaaacaggcttagttgactcctccatgtgaaactgtaaaacacacctactggaatgttttttgttttgtttttcttttaagcaagagaataaaaaatgtactctagttctattcattctcaggaattgacttctaaaggacagtcccattgctagatggaataattcctctgggaatcaagaagtgctctactacttaaagtttaaatggtaaacattaactttaatggactctcaagaatttccctattgattagaatcactttgccaaattaaaaaaaaagtgtgctctaattttcaataattattacacaaaaacgacagagttgccagaattccttttgtttagttttgtttcctattactcttaatctatattcctgtttaagacgtaatttttggattatgctactgatgggggaaggaatttgatttctgtggtggtgctgagcttcaacattatctccattgagttgagtggttggagtaaagtagagatgtatcaactttcaaacaaatgggacctggagaaaggctgctttcaaacagcaatgaaattcttcagcttttaagaagcataggaggcatattcatacttcttctcaacatttagttaaaatggaaatcctatcctcaacacaccaaatatgtataatttgtgatgctctgtctacatctttggtgtccagtatggtagtcatgaatcatatgtggctatttaaattcaaaatacagttaattaaaattaagaaatttgacattcagtttctcattctcactagctacatttcaagtgctcaatagtcttattataaggctagtggttaccgtattaaacattacagtcctagaacatttccttcattggagaaagttctattggacagtactggtaaagtagtttttggctattggatattactaggctagtagtttatgaaactaaaaagttcaggtttctgtgtcccaaaaccctagggaatctagcaaatttcaatttaaacattatgtaattggttctccattgcttccctgagcccaggactaaaaaatctttggcagctttcctttcctagttgagattatagccaagaatggcctgctaaaatcttaatacaaatatgtaactctaaactctgaagagagactctgggtgaagaaatttctgaatggcttagccttttattttgttttggattattttgaagtgagatcataacttgtagaatgaaatctttgagaacctaccatttaactgatttttagcagaaaaaaatgctaagagaaattatgcatataattcacagattcatacatatataaaaataaaatatcacatgggctgcagtggcagaaaataaccagaattgttaattatccttctaacttgatgaactttttgctcagtgccttttcttttttactaaaagttaaaatagaaccaaaatgaattgtttctttttgaaaagctggccgaaggtctaaaaagtaacaaatactaattgttctaagctgctttacggtgaatttcctttcatggtttaagggcttcaattcttatatccacatcattttgatttatatttattgaaacaggcaatgactttgcgtctgtgtatggctgtgttaacacaggtgtaaattgaaagtccacagatgtagtttgggcccttaataaataggctcggtgattatgacatttgttcctttctccacattcacctctcaaatccagcagacatacttaaagggggaataaatctcagctcacaaactcaactgtttaagggaaaaaaaaatcaaaccaaaacaaaccttcattttcaataaatcagctgttaatctgaatgagcaagttgtagggaaaaccttaatctccgtgactcctagggtttcccaggaaccttcaaagaattgccagtgtcccaccacctgaaaggatggcaaggtcccagtgtatgcaagggcatgaggtcactactgctccaaggctaagcccactgctggtggtggggtcacttcagggccagggtgctctctaggaccaagaggctgaccaaagttagttgcctggaccgttgtgtgtaaactgctgaactcacaggcttgttattttgtgctgatgctctgtttaacattcagagtgctattgcttgtttgctttcatttagatcagtttttaagctttaaaaatagaaaatagcgtataaaaggagcttttttgaccaaagaagatatacagatggcaaatacacatatgaaaaatgttctatatcatatgtcataaagggaaatgcaaattaaaataagataccactacacacccattagaatggccaaaatctggaacactgacaacaccaaatgctgatgaggctgtacagtagaaggaatgctcattcattgccagtgggaatgcaaaatggtacagccactttggaagacagtttggcagtgtcttgaaaaccaaacatgctcttaccatatgatacagcaattgcacttcttggtatttactcaacggagttaaaaacacaaaaccctgatatataattagatgtacacatatatatgcacatcatagcagctttattcacaattgccaaaacttggaaacaaccaggatatttcatcagtagatgaatgaataaataaactgtgataaactatgctacatccagacaagggaatattatttagcattaaatgagctagcaaatgatgaaaagacatgaaggaaacttaaatgcatattactcagtgaaaggtcagtctacaaaggctacatgctttatgattccaactatatgactttctggaaaaggcaaaactacggagatgagtagttacctggggttggggggaaggagagatgaataggcagggcacagaggatgttttgggtagggaaaattttctgtgtaatagcataatgatggatgcatgccatcatacatttgtccaaacccagagaaggtaaacaccacgtgtgagccccaatggaaactatgtactttgaatgaaaatgatgtgtcaatgcagatttatctactgtagcaaatgaaccatttgggtgccggatgttgatattggaagagactgtgcatgggtggggagatatggtagaactctgtaccttcttctcaatttttctatgaacataaaacttctcttaaaaattaagtctactgggtgtagtggcacctgtctgtagtcccagctacttgggaggctgagacaggaagattgcttgagcccaggagttccaggctgtagtgagctatcattatgcctgtgcatagccactgcactccagcctgggcaacaatgtgagactccatctctaaaaaaaaaaataaataaaggttacccctggcacattgcctatggtgtagccgtgctccacaggagcaatcaaaaacaaaaataatgaaagtctttttaaaaatgactttctgatgtatttttacacaagcacaaagttttggcaaactcgtgttaatattccttcattacccattggttggcacggattatgctttgcctgtgtaaattacagcacggagttgatgcctctttaaggcaaggggctctgccctatgggtttagtgctagtcattggctgtaggtttcactgcgggatcctgtggctcctgggtgaggcagctcttactcagccaagggaagttctacgcagaagggggcagccatgagccatcagaaaccaacgggcacagaaactgggccattggggtacctgcttggtagagggactgtggttggggcaccacccagagtacagcagctactataatatataagatctattatttagctaaaaagaatagagaagttattttcaagaaaaaatttaatttgaaagttttgtgtgtagtatattggccatttaaattttgtttcactgcatttaagataaactctatattgtgttttcagttcctagagccatacagatacttgaaaccacaactgatttgatttgaagtgtgatatatacaaatacatatatacgtatatgtgaatatgtgtgtctagagacagaaaccaaattcttgaatataacaggtgttttctaatatttagcaccagcacaactgaggccacctctggttaaaggaatcaacagcacaacaatccatcttaagtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggtaagtgtgtttgacattgctttatttaggagacacgaagctccaaaatgttttctatattttcatatccctttacaatgaatttttattatacctacttagagaaatactaattcagccctttgatagcttttgcctgattgtttcagcatgtccatctttttagaattctggggaaaaaagtcaggtaagtgaaggaaaggaaaaataaaagatgaagatgaagaagcagccttattggatcaaagtatgtgctttgtatttgtctttttgtgaagtatgtgccaggacatgtttcttgaaatattattcactgtgttctctgagcaaatgagtttgcaaaatgccctcatgctattggagattctcagtatgcaccccgttactgaaactccaaaaagcattgtaagaaagctattcaactttgcttagctaatcatgcctaacagatatttgatgtaatgttttctttttctttctcttgctgtttccttcttctttttttcactgtgacaacttaatatctcatgttctatgaagaacattgtggggaaaactaatcccagggaaaagataacttctctaagccaggactatggtaaagcaagtgaggctcttgtttcggtcacaaaatttaaaggcactaaaaaactcagtgttaatgtaaattttaatgcaatatttttaaaaatgaaaatcaatgtgaaagcactataaaaatattatcaaaagcttaaataaagacagattgaactctgtaccagcacaatcctgcctcactggccttaccctcctcctggccttactagtaccgcaatattttggaagtcccatgacctctgtgacttacagcttctaatagcatgatttcaatatagctgtaaaaaaactctacttatggtacaccatttttccaatttttaaaaaaatttacaaagtataagatatatattattatgtaaactcataaagatgttcatttaatcatccatgagaaagtcattttggagcaaatagctagtctttaaaatattgcatatgtgaagacaatgaaatggaattcgagctataaaaatttgtattgttttatttttacttaaaatagtaaatagtttgcttttcattgagactggctgctgatgcaccttggtaatgaatcatgattatattctaactgagatatattgagattaatgcatgattaactactctctcagtacatcaaaatcattgcagagtattagaaattgaaccattgagctaaaaatgctcaacttctgctttatattcttaaaatggcaaaaaagaaaagaaaaaaaaggtaaggaaaaggaatacatgaataatagtaaaactcttttctcaaatgaaaatggaaactacctccctgatccaatatttggcttgagatgtgtttcttccaagaaatagcatccgtttccattcagctgggcatagctgctgcaaggatgtcagcttggatttgcaggctagccagcagacagatttttgatgggatcacctactgttgttgcagtgaaagatagaatggcccgtccaccgttaataaatttggtcatcctcgctatctcccttgctggccttatactctgaggtgcaagggctaggggcagatgcagtgtctgggaagttttccaaattcctctttaaaaaagttaggctgtaaacactggcctcactaagcaggatccttctgtctataacaaagcctccagctgcacagaaaatatgcttggagtacacaccatttgaaggacaaggcagggagatcacaattttggcttgaactactccctggagctttggtgattcctggagaatgagaagttcttctgtgttcaggcatgttctgggacattgctgatgccctttttagtggtagcttggctttacttttaagacccctttaacttttaatataaccatgtatatactaagttattggtttgatcctttggctgacttgccaggtttggctgaatgattttattgagttgtaccgaagcctaactaaatgtacccaattaatgagctaggacaggttttcaaaaccaactcaataactttctgtaaacttgcatctttcctaaatagagaggtaagcatataattagcatcttacattattcttactgatatattatcctatttaatccctctgcaaccctataaagtagctctttttaccctcgtagtacaggaggaaaagaggctccagtgagtgacttgcccattgtgccacagctattgaatttcagggtggaaacgtgaattggagccttccaaatttaaaggcaaggtctctgctacagggtggaaaggaacttttgtagactgttctttggaagtgatagaataggaagtatacaaaagtaagaaagagggataggaggtgaaataattatcacccaaatattccttatccgacactgctaaactttttggatttgtctttcagttagtttcagctcacaaacagcaagtagtgttggcattatttattcatttatttgtatccccaaagacatgtaggcatcaggtttttttttaatagcaattaaacccagagtgttactagaagctagatgtttaaaatataaataacattatgtgaaatgggctgaagtgttatgcgttaaaacagtgctttcaactcacattcctttatatttcattcagtttttatattctgaggcaaatttaatgagcaaatccttgaaacctctaatatgatgaattacattttaaaagttaataactttaagataaactaagatgtcctttgttttgaattattcaattcaaaatctcaaacttcaactaaaatgacttctgaatagaaatatcaattagtactcaaatacaaatataaggttgatgtacataattatacatattttatatatgaaaagataagttagattgtacccatcaatgacaggaattataaacgcattcataacacatttcatggccatgaacattatgttgcaagtctcagtaagaaatatctcattattgtagtacaagaaagggatctcttacacaacttatgcctctttcatatttgctttaaatatttttatcttacacaatagaaagagaataattcaagcatatgaatatatgtcctaaaatgttgtttaatattgtaaattaccaagcttaatactgtaaataaaccctgtcaatatctacctttgggcagaataaagaaccagataaagctattttgggacctatttttgcttccttttcttttctgatacaagtgttctt

SEQ ID NO: 12657 - DNA, 19998 bp, Human
tttccctttttataaaacaatgcctaagactatgtcaagttctaagactctgtactctgggctggggctacaggtaatcgagacacttactttcacctgcttcagactctgaagaggctagatcggagggatgaggccactgcactctggtggaggctggaggcccaaactaaggggtcacatgaagatgctctgtggtgaggctcaggcctgctggcttggggctgaggggcagttggtgtcctagagtccttggacctattgtgggtggtgaacactgaaagcgggggtatggctgcccagctttctgccaatctttcacccttaggcatcatccttctttctctccaggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatatttatctcgtctgcctactacatatacttgcgtgggaaggcttgtgaccgtctagttgagtgctagttgtctatgatgccctttcctgacatcgtctaccttatgaacttgaagtctgggtatgaggaaagggctacaggaatcctcactttggaggcagtggctttagtccttcacattgcctgaatgcagagccccaaagcccaggacagtgacaatgagtggagttgggtctgaagggtggtctagataggcctctcaggacaagggcaggtacctgttacttagagacaggcaggtttctctcagagtaactcttcactcccttcctaattccaaattctagaaattcgactcgtcttagtcaaatgtgtctgtgtgggtacagggtgaaaggtgaattgagtcagcatatcaccaacagctgcctgttgactactaacagggacccctgttatttggggcccaaggattttcaagtcccagcatatgcagttttcttgctaatttgggttctactgaattggctgtgtgttctgtggttgccctttgacttctctggatttgagtgccttattataaggtattaatattaatgacgggaggaagaaaggcacaagcgctgagaaactgcaaaggctgtgggattggggttaccagagggtgcagtgacaatggggtaggagtggggtgctagtcagaaagttcagagtaggggtggttggaggcagcgttgagaaggagcaagaagtgtcagggtggtgatggcgtcttagaagatctccaggttttgggagaagatgggtgtatgggttaccacaataggactagactaatacaagggttcagtctattgtgccacgttcttccaggaggataaactccggagccaatgaactggagccaagtgggagagtccgcctctaagggattaaagggtctcctttcactaatcgatctcgccctattcctttcgttgattggctgagaattccaatccgtcgaggaagcgtagcgttgcggccaattgacgtggcgttactaggcgtgtcgcatcactgaggcgggagccaggccgcaagcgaatttcctgattggctgtgatctgcgggttgctggggagaggcgcggagaggcgggcgagagtccgcagggcaggcgctgattggctgaggtgggagcagcttcccttccgatgattcggctcttctcggctcagtctcagcgaagcgtctgcgaccgtcgtttgagtcgtcgctgccgctgccgctgccactgccactgccacctcgcggatcaggagccagcgttgttcgcccgacgcctcgctgccggtgggaggaagcgagagggaagccgcttgcgggtttgtcgccgctgctcgcccaccgcctggaagagccgagccccggcccagtcggtcgcttgccaccgctcgtagccgttacccgcgggccgccacagccgccggccgggagaggcgcgcgccatggcttctggagccgagtgagtgtgcgcgcgccgttcgcttgctgcggcggcgcgcaccgggaccagccgcgcagggtaggcccggcggggcctggccgtgggcgcgtcagagaggtggagaccaggaaagagggaagggaagctagggggcgagtgaggggccgtggacccggcaggcccggctggggccagctgcgcacccgcgcgccccctaggcggggcttgcgttgggtccgggtcggagcctgggccggatcgtgctgtgtcatgcaggccccggcccgcccgattggctcccttagaacggacgtctgggcctggccaggtcttccggcccactccgccggggcggcgccccggggctttggggcgccagtctgccgtccggcctaccacccgccgaaagcctttggtccccggagagagcaggccccgcgagcccgaggccccagccgggcccggtgggcgtggactttgcgccatgtgaaggcctcaggagctctgccaccgaggcggagcccggggtcggggaaggcccgccgagctcagggaagctcacagccgcctttttggagccgggtcggcggggccggaggtgggcatcctctgtgtgtgacctgagtcgtgaaggactgttagggagagggcgagccctacctttcgcttctggtcttcttactttaggcctgttgttcatactagaaagtttgagccagttttccttaatgttatgactcgtgggtggggagaaaggaatttttctttaacattttaggttcttgctaaagttggaatctcagttcgtgttttgtgcgcctttccagatttccaggtttcgtggtgtgcagtttagagttgcactaactcttcaaaaacacaaacgtgcgcgcactcctttccccaaccagctatattgagaaattacccgggctctggggctttctgaccccacctccatccttaggaaagcgttagataaaacttggctacctcagcccattcaatttagaatagagagcttttagaggcaaaaaaaaaaaaaaaaaaaaaacacagccagcccaaggaaactctatgcaaattaccttccttccttgaagagattagttttttgaggtgtgttcctttttctcaagtttctgaattcggataaagtattactcagttgcttatttaaaagagtcacttattctgaaagtattcttttggtttatatgcagtcagcctcttattttcaaaagtaaaaatctaaaattcttggaacctggcatcatcagctgtttctaacctcttggtcaccttgatgactcttagctgaaacccttccaagtcccgtggagtcccctgtgcagttctggaaagggattgacttatacagaagacaatggaggattgccccaaagagtgtccagaactgctgttggcccatggtcaggccaaattcagtcttttagagattaccacatctgatctcagtaggtagatggggaattagaggctttaccttaagaaaagggcataccactcatctccagagccagagtccgggatggtaggcagaatggaggttttcctaggatacagctttgagattaaaatacaaactattgaccgggcacagtggctcaggcctgtaatcccagcattttgggaggccgaggcaggcagatcacttgaggtcaggagtttgagaccagcccgggcaacatggagaaaccccatctctattaaaatgcaaaaagtagccaggcatggtgatggtgcacacctgtagtcccagccactctggaggctgagacaggagaatcacttgaacccagggaggcagagattgcagtgagggagatcgcgccactgcactccagcctgggcaacagagggagactccgtttcaaaaaataaaaaactatggtgactagaggcatctggcgttttatttttctccagtcccagttctataagtcaagcaagaagatgggcagtccctggaagagtattttgatgggacaggagtgggagagctcgtgggtttacattgctctcaactgtcacattgagcatgcttggcctctagtgtgttgataagcattggaagagtctgcctactcagcagcattgtgcctggagtggcagacttttggaatgggggaagcaaatttgagcagaggaaactgtcgttagaaactagtttagaggcagtggttaaaaatgcagcctatgtgtgagggttagcagaaggcctaccattttgttagatgaatggggtttgtttttctcttgggtgtatcaggacccaaagatgtaagaaccccatggcttcctagctgagcacagcatttttctttgtctcttgcaaattgtgaggatatttccaatgggaatactattttgtcttgttttgttgacttcagtatccccagcccttagaacaatgcctggtacataatagagactcatgaatttgttgaatgaagaaattcgttttaaaaatttattttctttgcttccttcattgtctggccttcctactttggttaatgcttatgttttcctgagccttactaacacgaggccgctcttaaaaaagagagagcgctgggtgctgtggctcacgcctgtaatcccagtactttgggaggccgaggtgggcagatcacctgaggtcaggagttcgagaccagcctgaccaccatggtgaaaccccatctctagtaaaaatgcaaaattagccagttgtggtggcgcatgcctgtaatcccagctactcgggaggctgaggcaggagaatcacttgaacccgggaggtggaggttgcagttagctgagatcgcagcattgcattccagcctggacaacaaaagcgaaactccatctcaaaaaaaaaaaaaaaaaaaaaaaaagggagagggagcttgctgagtctagtaagtgacagctggaaacgggctaggtaataagttggtgtcactgtctggtgaatgatcctagcttctaggaaataacactgagtgtagacccagtcgactttgatttgggtgagagggatttggatttgccccatgtctcagcatttcttggttttgattttttgagccaactttatggaattgtgtacttttgcagatattactgtgaagttccttttgaccttgagcctctttctggcggtttgatgtctgttagtgttttttccaaatatgatggtctttatgcttggcattcctttggtactatggaatgccctggcatcagtaggtttagcctataaggagggtagcaccaatgattctgcttcgttgtccccaggcttgcttggtagaacttaaggcctccctgagcctcaagggaggttgtctggcttacttaattccctggaaagttagcttatgctttactctatactgttaatcatggtgaccattaataccatgtgccaggtattatgttaagcattttacattcattatctcccttaagacaataagcctctgagataagtattatattccttcttttatagaggaggacatcaaagttcagaggttaggtaacttgcccaagatcacaattaagcagtggcataattggaattcagacccaatgggtctgactatagagttcctgctcttaaccactcttctgtaagtctaagactatttttatttctctaacaactattcagcctccatttctattatgtcttcttcttaggccattattttctgaccctggggcaggatcactcacttggggccttatagctgggacactgacgctcaaaataccaggagctgctggaatgggtattgtaatatgtatggtagatactgctcctcgtgaccttggctgcctttccttcatctgagctttctggtctagggacagcttcatctattcactgtttctttcctaagtatgagttttagagactggcgaggcgcttggggcaggagtatctactgactccatttcctccttctagttcaaaaggtgatgacctatcaacagccattctcaaacagaagaaccgtcccaatcggttaattgttgatgaagccatcaatgaggacaacagtgtggtgtccttgtcccaggtaagctgtggccacagactagtctttccttactgcacttacttgagggattttcccaggtttcttttctcatttttcttgcagtgactgcagatagagtggggtttactgggaatcccaatctccagggctgctgcttactccccgtcagcccaatgacccaaaggccttaactttctttcctcagcccaagatggatgaattgcagttgttccgaggtgacacagtgttgctgaaaggaaagaagagacgagaagctgtttgcatcgtcctttctgatgatacttgttctgatgagaagattcggatgaatagagttgttcggaataaccttcgtgtacgcctaggggatgtcatcaggtgtgtgtggggtttttggcttcacagggatgggaggccagagatagcctgcattacaggcaggacccatgtattacaggcaggaccaagttcttggcacctgtcgatgcaggaagcctcctggtcatgggaagacttatgcttcagggttgtctttaggttttggttctgcctccctgggacttcaaaatccatttctgcaggtcccttgagacaaattggcgttcctgtaactttcttgatggctttattttttcctactagaggtgtaatttatcatacttatatcctggcttaggataccactcgagggtgtgtatgtatatgccaaataatctcctcactactctcactagtatgtctaattgatggcttgtgttggggttggaatgaggtgggggtatgggcatggaaggtgagctgctagcaggtcttttaagcccctaagttaacccgggagagaggaatagttggagccagacctgggatagctctcaatgtgagtgattttgcttgttcttgcataattttaggcaagaggttaccccatcttggagtcatctctagccactcctacccaaccaaccatcacctggccaggatcatctcaggcttttgattcttttgaatggagtctaagtttcatgtagctttcttcttgggagtgcttagtcacttcctcaaggtgttctgaccacctggctgagataattttgtttttttcacttctgtttcactgaccctgacaattgttagcttaagaccttcccttgtaatattgggtcaccagtattagctagaaggggatcatccttggatatctccctgaagaccctgcatgtctttgtggggtttctaaatgtgtggctcttgattttggctcactgattaggagtgagtggggctgttccttcgccctcacttccaccctgttctccttcctctcttcgcctaaagccatcctgccttttctttttcacttactatcagctatctgtgccaggcccttttggacacccagtgcttgggcccgaagtgtggttggtaatatggagtctgcttgtcatcctcagcatccagccatgccctgatgtgaagtacggcaaacgtatccatgtgctgcccattgatgacacagtggaaggcattactggtaatctcttcgaggtataccttaagccgtacttcctggaagcgtatcgacccatccggaaaggtgagagctaattctgagcttaaggattattgactgtagggaataaaccttggaacatctttatctcattttctttttcttttttttttttttaaatcttttatgcttttcccctgtatttatttattcattttttaagagatggggtcagctgggcaccgtggctcacacctataatcccagcaatttgggaggctgaggcgggtggatcacttgaggccaggagtttgagaccagcctggccaacatggcgaaaccccatcgtgggcacctgtaatcccagctacctgggaggctgaggcatgagaattgcttgaacccaagaggtggaggttgcagtgagccaagattgggccacagtactgcagcctgggtgacagagcaagactctgtctcaaaaaaaaaaaaaagagacagggtctcactatgatgcccaggctggtctcaaactgctgggctcaagtgatccatctgccatggcctcccaaagtgctgggattacaggcatgagccatcaagcctagtctcattttcttttcttttttttttgagacagagtgtcgcgctgtcccccaggctggagcgcagtggtgcaatctcggctcactgcaacctccgcctcctgggttcaagcaattctcctgcctcagcctcccaagtagctgggattacaggcgtctgccaccacgcccggctaatttttgtgtttttagtagagacggggtttcaccatgttggtcaggctcgtctcgaactcttgacctcaggtgagccactgtgcccggccgctagactcattttcatatatttgtatacacacacatgcaaaccctgcacacatattcatatgtcttaccctctttttttcctccatccttcctttgctccatctctccccttctctgttccaggagagtaagctatctttatggatctctgaaggagaaagtggtccattttggctgggtcagggtccagagtgcacagttctaccattggtggttgtagtgaaaacttgggctacctatatggcagaagtcagaacttgatgggcttctgacatgtcaggttttgttcactgacctcttgtcagagggactcttcacagtttacctttctcatcttgcctgctgcttattaagacaggtggggtggagttggggagaggtagggcaatatctaatgaagggcactatctaatgagcttggcattttgaccccagggtctgatgagttctcactttgtcttgtagttgacacctctaactgtgcttgtactgtttgctctcgcaggagacatttttcttgtccgtggtgggatgcgtgctgtggagttcaaagtggtggaaacagatcctagcccttattgcattgttgctccagacacagtgatccactgcgaaggggagcctatcaaacgagaggtgagttttctccctgattccagtatccgattttatgattactcagtgtggcatcatgtggtaactgtcaggactgggtgctcggccggctgcggtggctgacacctgtaatcccagtactttgggagactgagatgggcagatcacttgaggtcaggtgttcaagaccagcctgggcaacatggtgaaatcccatctctactaaaaatacaaaaattagccaggcatggtggtacacatctgtaatcccagctactcaggaggctgaggcaggagaatcggttgaacccaggagtcggaggttgcagtgagctgagattgtgccactgcactccagcctgggtgacagagtgagactctgtctcaaaaaagaaaaagactgggtgttctttggagaactaaccatctttcagggatgagaaacctgccagctattcatttctgggcctaattgtttctcggatttacctaatgccaggaatttcaaaaaactagactgaacccaaaatatataagtgattgaaatcatttttgaagtaaagctgatggtggcttcaggcctctgcccattcccagggtttccagcttcagattttagagaccccttctcagtaagactacgagtaatgtgagaggcaaggactgtgctagaaatctttgccttgggatttttgtagttgttctttgaggccggatccctttagaggagaatcttttttaaatttaatttaatttttaatgagatggagtcttgctgtattgcccaggaactcctggactcaagcattcctcccacctctgcctcccaaagtgctgggattacagatgtgagccaccatgccgggttgagaatcttcttatacggtaggtttttgcacactaggtagtggaatgatttagagaaactcagcttttgctgatataatattcttgccttctcctttctttatctcctccatattcaggatgaggaagagtccttgaatgaagtagggtatgatgacattggtggctgcaggaagcagctagctcagataaaggagatggtggaactgcccctgagacatcctgccctctttaaggcaattggtgtgaaggtgagcatcctgggctctggaatcaagtctaaagtggtgccaatgtctaatcctgtcccaatgtctaatcctgggactgttttcatgcatggctttcattattgccttggattagaggggcaataacgtatcctttagtttacctaaggctctaaattcattagagctgatggtctaaaaccagagtaggctaatcaaattgtctgttgtgtgcgtgtgcgcacaaaacacacacacatatatatatgggtttttctttacaactcttagaatataaaagccattcttgtatcaatggaccctgtaaaaacaaatctcaccatagtttgccagcctgtctagagcaatgtcacccagtagaagtaaggaagttaaggaaattttcagagtgttaaagggttctgagtctaaaacatttgagaactactggtctagagtgtagcttctcaatcttttcctagtgggaaagtgtttccatggaacacactgaagatgaagttactcattttcctagtgggtggcacacaaataatttcattttctatgtggacagtttacatgttctgcttgtggatgaggccatagaaagggtagtgttgaagaagaaaaatgatgattgtaaggaacagcattccagtgtgataaattctggagggcatgattactggagtgagtgatcctctggcaatgaagaaaatagaccctgctctcttaaatggcttagctagtctttggcccttggtctgtctaaaattgagcccttagtgtaatggcctcttgcctttccctagtcatgtatcttcaaacgcatttggactacagtttctctgcccttagtctcctatgcaagttgcaatcataaatgttgcccactttctagcagtattttccctgctagtaatagaaatgagtgtggcctaaagtaattgtcttcttagcatttactgcggagggcttattcttaatattgtcagggttgaagcctgattctcaccctctctggagcgctagtcaagccattttagggtttgggagaaggtgggaacctaatcacactctgcattggtccacagcctcctagaggaatcctgctttacggacctcctggaacaggaaagaccctgattgctcgagctgtagcaaatgagactggagccttcttcttcttgatcaatggtaagatatttggttcatcttatgtctagctagacccaattttgaactgggcttatgagctggagcacttatgaacacatcctttttgcacccatgccctccttcatgtttatagcatatttcttatgctggggtatgttacagacagaagagcaataaagggaagatattttacattggtgctccctgtcctgccccctttgagaaagattgtggacagactgcagagcgggagcaagctagaatgagaaatcaaagggtgaatggttagtgatttgagagggtttggggcaaatgaactttgatcactggctcttggagaatgctgtttagtggtgtgccatctggtgtgccatctctcctgctctagccagaggtcctagagcatttgctgtcacctttacagttcaactgtgagaagagtatagtgagtccctgggcttctctccagccttgcctggtggctgtcctgggataatggctggtagaggatgtgagaagtaggcagaggttaccaccttctcacccaggacctgtctctgggccaaacaagcaagataactgatttttgggaggaattgggaaagactatcattttgttattgtctccattctgtatcctttcaggtcctgagatcatgagcaaattggctggtgagtctgagagcaaccttcgtaaagcctttgaggaggctgagaagaatgctcctgccatcatcttcattgatgagctagatgccatcgctcccaaaagagagaaagtaggagcttacctgaggggatagaggggggttgaaaggccctgacttcacttctgaccagacatcctgttctggcagactcatggcgaggtggagcggcgcattgtatcacagttgttgaccctcatggatggcctaaagcagagggcacatgtgattgttatggcagcaaccaacagacccaacagcattgacccagctctacggcgatttggtaaggactccagatacttttgaccccgtccttgcttaggtcctacttctctccttcatctaagtcacctaatcctcttgaagcccttcacagtgattgggtccaggggtctttttcctttaccctacgtcctgtctagagtgaccaaccaccctggttttcctgagactgaaaggtttcccagagcttgagacttttttagtgctggcattaggacaatcctgtgctggctgagatggttggtcaccctaggcctgtctcttacctctggactagagatgagccctgtttactgtttgtgtactgtcccacaggtcgctttgacagggaggtagatattggaattcctgatgctacaggacgcttagagattcttcagatccataccaagaacatgaagctggcagatgatgtggacctggaacaggtgaagtgatgatgatggctgaccaggcgttacagtgtctctaggcagttgctgggaactggctagagacataaggttaagatgtgaggagatgggttttgatttctggacaggggaaaggaagtaatctgagattgaatccaggaaatgggagttggcatttttcatagttgacgctgcatttagagtaaatcagaattgttggagcagccttatttctaggtcccaagtccagaattaagtacttaaaacccagcccataaaggtattgatagtatatattcaaggaaatgagaggacccagggatagcagtcaggggaaggattctattgtctctgagcctcctgcagcagctgggtctttgaggcagcatagtaagtagatctttctctgcaggtagccaatgagactcacgggcatgtgggtgctgacttagcagccctgtgctcagaggctgctctgcaagccatccgcaagaagatggatctcattgacctagaggatgagaccattgatgccgaggtcatgaactctctagcagttactatggatgacttccgggtaaggaccacacccgtgcctcaggtacacacatacgtgctttgacccctcccttggtaagtctcatccccagttttccctccttttctagtgggccttgagccagagtaacccatcagcactgcgggaaaccgtggtagaggtgccacaggtaacctgggaagacatcgggggcctagaggatgtcaaacgtgagctacaggagctggtccaggtagggcaacttggtccagggtgagtcactgtctcagtacattgtaattgatctgggtgatctcagggtgtcaacacatttgctgcaagagttgtgagagcacgacttaggaacctactgttcttaggtttgaggcactaaggagtcttcttctagagaacctggatctgataccattgggtacaccatgaaataatggaggggatgcttctgtttagttaggtttctttcaaaatgtggaggtagccttgaaccctctttccttttcctcctagtatcctgtggagcacccagacaaattcctgaagtttggcatgacaccttccaagggagttctgttctatggacctcctggctgtgggaaaactttgttggccaaagccattgctaatgaatgccaggccaacttcatctccatcaagggtcctgagctgctcaccatgtggtttggggagtctgaggccaatgtcagagaaatctttgacaaggtgagctgcaataggctgaactatgtattgatttgcctgagggcaaggaatagaggctgtttttctttaagagggttgaaatattcttagtgctggctgctcaactgcacagtaagtcacttgattttctttctgaggtctgagagacctagtgttattttttttttctctctctctctcttgagacagggtctggctctgttgcccaggttggagggcagtggtacagtcatggctcactgtaaccttgaaacctgggcttaagcaattctcctacttcagcctcctgagtagctgggactataggcatgcgtcaccacatctggctaattttttattttttgtagagacaaagtctcagtatgttgcccatgctggtttcggatttctggcctcaagtgatcctcccaccttggcctcccaaagtgctgggaatacaggtgtgagccaccacgtttgcctagagacatctagttttgttagtgcttgaatcaatccattcctcctacaggcccgccaagctgccccctgtgtgctattctttgatgagctggattcgattgccaaggctcgtggaggtaacattggagatggtggtggggctgctgaccgagtcatcaaccagatcctgacagaaatggatggcatgtccacaaaaaaaaatgtgttcatcattggcgctaccaaccggcctgacatcattgatcctgccatcctcagacctggccgtcttgatcagctcatctacatcccacttcctgatgagaagtcccgtgttgccatcctcaaggctaacctgcgcaagtccccagttgccaaggcaggtgcaagatcatgggctgtgggagacttgcatgagtcctcaggctggtacggagtgctctttagtttctggacaagattccactggggttagggttggtctaaagggaaggtagaatttttgaggatatcaagataatctagaatcaggaataaaatggggtggccaaagaaggggcaaactgtagttgggagtgctcgggtagcccaaagatctgcgtatctcgagaggagaggctaaatgctaaggtacctctgctgctgcttttaggatgtggacttggagttcctggctaaaatgactaatggcttctctggagctgacctgacagagatttgccagcgtgcttgcaagctggccatccgtgaatccatcgagagtgagattaggcgagaacgagagaggcagacaaacccatcagccatggtgagtctgcatcctttccccagatgtgccaatcatggagagccaggcagcagccaccaccatgccctggagttgagagtagaagctgttggaaagatcatctaactgagaagaattttaatagggcatcaaagataaagaatgctgaggtgaatccattcaatttggaataaggccgagaagagatggtcaggctccattctcagtctgaaccaagctccatgagggaaatcaaagtatgagagtgcagcaaacacagcaaggttttttttgttttttgttttttgttttttttttgagacgaagtctcactctgttgcccagactggagtgcagtggcacgatcttggctcactgcaacttctgcctcccaggttcaagcgattctcctgcctcagcctcccgagtagctgggactacaggcacatgccaccatgtccggctagttttttgtattttttttttagtagaaacgtggtttcaccacgttagccaggatggtctcgatctcctgaccttgtgatgtgcccacctcggcctcccaaagtgctgggattacaggcgtgaaccacagagcaaggttttgagctgagatgagactcatatacttatccctgatggttggggaagggatagggtccacagacctcccaaaatgaaaaggcaaattcatgtgtttgtaagttccataaaggtaagatctctgtcatctcacttgttttccactatgtcttgtgttacccttaattaattcattaagttccaaacatgggacttaatgagcaaataaatggctttctttcccttttgaagggtctgtgacatcccttctctctcccataaaagcttaacaactactgatgaactaatcctaggaggtagtcacataagtcacagaaattggcctctcaatggaagagataggttttgagctgggctgtgaagagagtagaatttgaataaagggaataagcagcccaaataatgtgctctagtagtaggattgcaatcattgggaaaccctgggtagatttaagagtatatatgtcactggaagtgagaccgctaggtaggatgtaatccaaatgtggtaagcactgaaagccattggcatttccttttaaagtattaaggtttattaaggtatgatataaatacaataaaattcactctttctatataccatttccatgctttatgacaagtgtgtgtaagttctataactactaccacagttgagacttaaaatttctactatctcaaaaagtttccttagccacttcagtcaacatctcccctccttaagccccatcactgatgtgatttctgtccctacagttttcccttttccagagtgcattgacaagtttttaagcagagcagtgactcaattttaggaagcatggcctagcatcttacctcaggttggattggaagggcaaggagaccaataaactgcagtaatgggaggcctgggatgaaatccaggctgggctttaactagccctagtgatctgtgtttaccaactataggaggtagaagaggatgatccagtgcctgagatccgtcgagatcactttgaagaagccatgcgctttgcgcgccgttctgtcagtgacaatgacattcggaagtatgagatgtttgcccagacccttcagcagagtcggggctttggcagcttcaggtaagttggttgggagcattagacagtgcttaagttactttggggacctacaccaaaagggatgggagtcctaaggaagctagaggggtagttgtggaaatcttacacaggccctgtcctaaccctcttttttggctttgctcttgtacacagattcccttcagggaaccagggtggagctggccccagtcagggcagtggaggcggcacaggtggcagtgtatacacagaagacaatgatgatgacctgtatggctaagtggtggtggccagcgtgcagtgagctggcctgcctggaccttgttccctgggggtgggggcgcttgcccaggagagggaccaggggtgcgcccacagcctgctccattctccagtctgaacagttcagctacagtctgactctggacagggggtttctgttgcaaaaatacaaaacaaaagcgataaaataaaagcgattttcatttggtaggcggagagtgaattaccaacagggaattgggccttgggcctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgctggatgtttatatagagagtaggttgatttattttacatgcttttgagttaatgttggaaaactaatcacaagcagtttctaaaccaaaaaatgacatgttgtaaaaggacaataaacgttgggtcaaaatggagcctgagtcctgggccctgtgcctgcttcttttcctgggaacagccttgggctacccaccactcccaaggcattcttccaaatgtgaaatcctggaagtaagattgcaccttcttcctctcctgatcaacatcggtatgatgtctcctgttgcctcaccctttgtctgcagtatcactggataggactggtggaaagggagcagcctgacagagctccaaatgtggagaatatggcatccctccacctatatttgatgtggacggtaaggctaggcctgcaggatcccttatcctgaccaaagactgtgttggggtgccatttgaaaatcgcagggttgcaaaagaatacaatcttacttgcaggtggatattctctatactctcttttaatgcatctaaaaatcccaaacatcccctggttggtgatcacttacagttgtgtccacctttattttatgtactttgattaaaaaaaaaaaactttttgttaatataaaattttagtattgaatttttttttttttccaaacagaaaatagactatcctcttcaacagtaatcacttagtgcttctagggtcagtacagtgatgccttacccagagagagagtagtgcagagaaaataaattactaaattaaatatatgttgattggctttgggacataatctcaaaagacagtcctgaacaccgtaattttgaataaaatactgtaatctccaaagatcaaaatccctaaagtctaaaattctgaaaatcacaatcccaaaaggtcaaaatcccaaaatacaattctggaagaaatactaaacattcttcgaaaatttacttacatttttaaaagcgtatttatttgagaaacaacacaacagaacgtttcataggccactgcacgataaaatagggaatagtaacatttttgcaagataaacactcaggtataccaatgacagttgcacggatataacggtgatgagcagatgaaacattcataaagaaataggtcaaaaagtgaaatgtataaatgctttgtcactatgcttggtaattgtgggcacctagctttatataactggtcatctgtaatactgtgacagaaaacctaagtcttgatgagatggttcaaaaactgttgcgttaccactgcattgtctcccaaagagacgaggtcttgagaaattttatccttcacaaatgcacgtgtacaaaaaacagatgtctcttcgtttattgaggaactttcaacatttttatgcacacatataatgcttacacacagagtcaacattgcggtcatggagtcaaatttttaatgtccaaggcaccagaagaaaaatctgtcctaggctgggcatggtggctcatgcctgtaatcccagcactttgggatgctgaggcgggcagatcacctgaggtcgggagctcaagaccagcctgaccaaaatggagaaaccccatctctactacaaatacaaaattagccaggcgtggtggcgcttgcctgtactcccagctacttgggaggctgaggcagagaatagcttgaacccgggaggcggaggttgtcgtgagctgagatggagccattgcactccagcctgggcaacaagagcaaaactcaatcttaaaaaagaagaaaaatctatcctacctcttagagaccaatttgccttctgtatttgttctctctgggcccccgcctgttggatggtacccaccaacattgaaggcagatcttccccactcagtccactcagacttacaaactaatccccggaaacaacctcacagacacacccagataatgctttaccaggtttctaaatactccttaatccagtaaaattgacacctaaaattaagtccacaattctgctcattggcaacttggcacccttatgtgtctaaaccatacttaagacaataacaaggtaatacttctgtataacatgatgcaactgtcttgtttacaatgaaaaacatactaatcctttcccc

SEQ ID NO: 12658 - DNA, 4524 bp, Human
caaaggtcctgggtcagtgaagcctgtgaaacaaagttgggaccagagtgtctctacggttgagggctgggcttatttgctctctaagtataattgtaagagcaaatagaaacacctatcctctctgagcttaaaaggatcaaaaagctctgacagtgtcagtggtagggctagttcaggggctgcagtagtgctggtgcccacaggtggaaccttctcctgccctgattcccaaggactggtgctctcggaggggtctgggaggtatatttctctttcacaaatacgtgcacaacacatgaatgagctactggatgagggaataaatgaatgaatgagtgaaaaaagcttcctttctcctctccaggagttagcaatcactggttagttccccactgcccaccagcctgtgcagaggagggaggagcaacaggtcatagatgtggttgcagctgttactggacagagtggtcaagacatcctgtgtctgcagaggccctccccagccctcacctggacagtggagctgttggccagagaggcagtgggaagaagggtggggctcccagagtcgacccagcgggctgaaactggtgcagtctgcgcctcaccaggcagagaatggatgtggggcagcttgacaccgagcaggggctcatctgagcctcaggggtggttgctctatcaaagtgtttgcaagtaaacagtcccagtgcacacccagctgctcagtgccacctcgtgcacccagggccacttcagccttgatcacaggcctgcacaggttccaggggaggagacactccagctttttgagggagggtgagcatgtgggatcagagactttaagtccaaatttccccttaatttttttttaaatcttgcaggtagtatgcaaacatacatttaatgtattatttttattctcattttttttttgaggcagggtctccctctgttggccaggctggagggcagtggcgagatcttggcttgctgcagcctcaactcaacctcccaagctcaagtgattttcccacctcagcctcccaagtagttgggactgcaggtgcctgtccgccatgaccagctaatttttaaattttttttgtagagatggggttttgccatgttgctcaggctagactcgaactcctgagctcaagtgatcctcccaccttggcctcccaaagtgctgggattataggtgtgagacactgcatccggctcccaaatttcccctttttataaggacaccagttgtactgaccggggccccacctctatgacctcatctaaccttcattaactccttaaaggccctatctccaaatacaggcacactgggggttagggcttcaacctatggatttgggggatgcaattcagtctatcacagtgccaagctgcacctgctcggtgagccagaacaggggtggggaaggcaccaggccctggtgcttctttcccatgcctgagtcactctacttggttctaggagggagaggagcatgggctgaaggcagtgctgcaacatggaaggggcagaacatcccaacccgctctgggcccccagtgtcttctgctgtacaaagcaggtgttttcaccccccgaggatgtgtcctcccttcctggctcaccaagcatttaaatgtagacagaaaatttatttatctggggtgcggtttcctcagggggaagttgaggtcacgacccctgaggtaccttaacccaaaggcctccagggcactggccccagagtctccagcaggtgcttcctccctgaatgcttccatatggcaagatcagagccacaaatgctgccccgacgctgttccggtaaccgacgttgcagacccaagaaagtctgggatggtagtggccaggaacggggtgtgccacggccccacctctcagagcagggaggaggatgctgggccagcccttggggaccccaggcaccgtggccacaggagtcagagctctgcatgtctgcaccatgtcctgggctcctgtcctgctcatgctgtttgtctactgcacaggtgagggaacccccagatcccaaagactcctgccccttccttcatcctgccctgcccccacggcccacatgcatctgtgtcaccaggttgtggtcctcagccggtgctgcatcagccgccggccatgtcctcggcccttggaaccacaatccgcctcacctgcaccctgaggaacgaccatgacatcggtgtgtacagcgtctactggtaccagcagaggccgggccaccctcccaggttcctgctgagatatttctcacaatcagacaagagccagggcccccaggtcccccctcgcttctctggatccaaagatgtggccaggaacagggggtatttgagcatctctgagctgcagcctgaggacgaggctatgtattactgtgctatgggggcccgcagctcggagaaggaggagagggagagggagtgggaggaagaaatggaacccactgcagccaggacacgtgtcccttgaactgaagacagcaggggcacgcatccccttggagagactgtcatggaagagggtggagccgccgcccgaagcgccgaggaggctgagccactcagcatctcctggtcctgcagtgttgctgtaaatccccattggagactgcattagggaattaaagctgcttgtcactttttgctgagtttggtctgactgttgtgcgacttcgtagtaccagccttgggcaaaggcccggggccccgggagactggcagatcactgtggtgagcactcacctgagtccttacttttgtgggccatgggaggcaaggggttgaccgaagcaccctggaggggcatccatgcccaggacaggaccctctggtgtcatctgattctgcccagcggttacagggcaaacaagcttagaaagcacctggtctgggcctccagggagaacaggagccaggtaataggcctagagtgggttctccaccttggtcctatcgacgttttgggctggacagttcttggttgtggggctgtcctgcggattgttgaatggtgagtggttatctgtggcctctacccaccagatgccccttcccagttgtgacaaacaaaaatgtctccagacattgccaaatgtccccaggtggtaaactcacactgattgtgaaccactggtctagatgagcaagtaaatgcatttacttatttgtacaagagagtggcaggtgtcggcaaacatgttctttttttcctttttttagggataaagtcttgctctgtggtccaggctggagtgcagtggtgcaatcatagctcaccgcagcttcaaactcccaggctcaagtgattgtcctgtctcagcctcctgagcagctgagactacaggcgtgcatcaccatgcttggctatttatttagttttatttttggagagatgaatgtctcactatgttgctcaagctgatctcaaactcctgagctcgagtgatccccctgcttgggcctcctaaagtgctgggattagaggcgtgagccactgcacccagcccattttctataaagagccaggtggtaaatatttttggctttgtgggctatgcgatctctgtcacaactgttcaattctgtcctagtagcaagaaagcagccacagacaaacatgtcaacaaagaggcgtggctgtgttcttataaagctgtatttacagaaacagatggggctacactgggctgggtatggcgcccaggctgtagtttgctgagccctgctcgggagcactccagctcctgtctccaggttttaagcaagccatgcttggtgggataatcagagtcccccctcaacttatcttgcctgtgaccccaggcagaagcctctggacccatggagatacctagaggcatgaaggacgtggtctcactgagactgtgttggactgtctgggtgaagtagcaatggggagctccctgcagccccggcccacagcaaggccccctgagcccgtgggtggtgggtctgagtgtgccttgcagagagggactctctacactgggtgtccacacaacctgtagacatgcctcactcagagaggtgccgggcaaaccatctcccttgtaaccccaacttgcctgggaacgtgcattcaccccagctaaaaagatcctgaggcatctccccagagaggtggacacatgtcagtatcagcgttccatgtgtggtcatgagtccctctcttgttaaacagtggtctccagcactttgggaggccgaggcgggtggatcacctgaggtcaggagttagagaccagcctacccaacatggtgaaatctcatctctactaaaaatacaaaaattagctgggtgtgttggcacatgcccgtaatcccagctacttgggaggctgaggcaggagaattgcttgaacccaggaggcagaggttgcagtgagccgagatcatgccactgcactccagcctgggtgacagagcgagactccatctcacaaaaaaaaa

SEQ ID NO: 12659 - DNA, 80858 bp, Human
ccctcggcactttgggaggccgaggcaggcggatcatgaggtcaggagatcgagaccatcctggctaacacggtgaaaccctgtctctactaaaaatacaaaaaaatagctgggcatggtggcgggcgcctgtagtcccagctacttaggaggctgaggcaggagaatggcgtgaacccgggaggtggagcttgcagtgagcagagatcgcgccactgtactccagcctgggtgatagagtgagactccatctcaaaaaaaaaggaaagaaaaaagaaaatggggtgaagctcacaaccagcagaggagtgagaagaggcagcccagcgtggaggcgagcagggccttgagaagcaccgtcttacccgtgggccccacacccacccctgctggagcacgtgagctgtcagtgccttttgagtttggtgcaggtcacacttgttaattgaagaatgaatgacatttcaccctcctgaaaggagttatggatctagggaactggagcagctgcctgccatttcgttttactgtgggatctagagaccacagtcgcattgtgacattctaacttccacccctcctgccatgaggtggtttttgctgcccagggcttgcctgacctcagattccagcatcggggtcttcccaggagggtccctccagagagtgaatggtgagagagggacctgtattagttgacattaagcagacagagtagaggggccgccagcctcggccctgagtgggccctgtacttttacatctgttcttgcttctgtgcagaaggtaacctcaggtggcctgtctcatcacccccattccactcaagggaaacctgggcttagattggtcatgggaggcttgccatggtccctcacggtgggtggtgaagctcccagctcagacagtggctgccaaaggccagagtcctctgagccaggtggcctcttatgtggaaaaacagggttagggggctggcttaatatgaaatggcttctcctcttctaccagagaataaactttttaaaaaatatttttattttattttattttttgagatgaagtttcactcttgttgcccaggctggagtgcagtggcgtgatctcggctcactgcaatctccacttcctgggttgaagcgattctcctgcttcagcctctccagtagctgggattacaggtgcctgccaccacgtctggctatttttgtatttttagtagagaccgagtgtcaccatgttgtccaggctggtctcgaactcctgaccatcaggtgatctgcctgctttggcctcccagaatgctgggattacaggcgtgagccactgggcacggccagagaataaacttcttctttttttttttttttgagatggagtctcgctctgtcatccaggctggagtgcagtggcatgatctcggctcactgcaacctctgcctcccaggttcaagtgattcttctgcctcagcctccccagtagctgggactacagtcgtgcaccaccatgtccagctaatttttgtatttttagtagaaacggggtttcaccatattggccaggctgatctctgactcctggccttgtgatccgcctgcctaggcctcccaaagtgctgggattacgggggtgagccatcgcgcccggcccagagaataaacttagaggaaaaagactctggcacactcatccttatgtctttgtgccaggcacagggctctaacccaaagttgccctaaataaacgttacccgagtcagcttatggtgccagggcatgagggcagctctgggggcagtgggggctgcagcgctgcaggcagattctgcaggggtgatggatcccaggaggacctgtcccctctccagcagcccccacccattcccctgccctttgttgtgtgtggtgtgtggcctggaatcgatgtgactttgcctgtccaggcctgctgtttgtccatgtgtcacaatgtgacatgttgacccactgcagatcattccctgaccacagagcgctgctcccgagaaccctgcacccctcaatggagtaaattaccataaagcctcttccttacccatgctttggggtgttaacagctgaggctattcgtcggtgacctgtgggactcgagctattcctgcagctcagcagacctcctggccgtggtgggtagctcctttcctttagtcagattccgaggcctctgcaacctggagccttggagtgggggttccattagaattactgggtagcagaaagccgggacctctgttgtatgaaggaggttggggctgggagtggatgggagaccgccctttggtcacaggtgtgaaggggaggccatcaagggagactctgacacccggaggcagagcctggatgtgggacccaggactctcctactctgctcacgtctgacctggatttttggttcttttttgccaatccagtttcaggagggaggtccaccctcctgaggggggttttggaaatgacagctatgagaaagggactatcatgtctctgagtggggatcggggagctgggaggggcttccctctgctgcctagaattccactctgaaccattagtcattctttccagcgaagcaggtgcttctccgggcaacataaatcctcctcaaggtgactgaagtgaccggatggacaccaccaccctcctgagacaggctgacctgaggccattgggacctgggcacaggagggagaggggggagggggtggatacgttccagctttgaccagttcagccctaattgggagactcaggtggatgtcagctgctgctgggttcccccagtgttagttgcttaatctttcagtgctcagtttccgtccttcatcttggctcccacagaaggtgaaaaaagcatatttcttgctcactttcccagtttccttgggtttcaagacccagaagcactcacttttatccttgtcccatttttatggggctttctgtctggtagggctggccttgctcaggctggctctgctcctcactgcctggggtctggaggctttgctcttttatctggaaagtaggctaacaacaaggctttacttttagggtggctgagagtatggccagagataggtctgcgctcactgacaggtcctgtgttttcttagatcccctagagtgagggcctccttagtggagctcagctaaggtgactaacatcgagttgaattccttatgagaggcagcatttcccccagggcccagtggggaagtagtagagagatcatttacactcaggaagatgcacctctcttagctgtagagttgaaggggcgccagtgatatgggaagtgtttttcctggccctggaaaatgccctctgtcccttcctggccccaggctcagtgtccctaggcctttcctgctttcccctttcccctagctgagcggggctctgctctgtgactcacactctgccctttctcctctttggcttggctaacagcatgctggtccataggtaagggtccatggggagggctctgggggaagtccaaaggcaggaggccactgaggtcctttgctgtgccctggggagcaaccggcaaagccagggttggaggagggagtggattaggtggttgtgtaagaggcggaataacagatgggccacgggaggattggtaatgggaatgaggcaagggaggggtagggtgaggccaggttttggctgggggctgaatggggaatggggagtgggagggatgggtgaaaactggccgctggcccactcatagggtctgctgtgcacatgcagggagataactcactcttggtgcacttcgtaagtgccaggcatgaccaaagccacgactcttccctgagccagctttccaccctccccccaccaggctgtcaagggacagggccttggaattggatgcgtgttttttgtttttgttttttttttgagacggagtctcgttctgtcacccaggctggagtgcagtgggacaatcttggctcactgcaacctccgcctcccaggttcaagccattcttctgcctcagcctcccgagtagctgggcctataggcgtgcgccaccatgcctggctaatttttgtatttttagtggagatggggtttcaccacattggccaggctggtctcaaactcctgaccctgtgatctgcctgcctagcctcccaaagtgctgggattacaggccaccatgcctagactggaggtgcttaatagatgttatcatcaagctgaagataaggccaggcctcaggttaagccccaggttctagaagctttggggctgcatcacaggccttccctcccctcccttcccctcccttcagggcaggacagcctgctctgagcctggcccagttgtccttcatgagcggccagtgtctgctctggggagtgtgggcctaggctcacagccccaggcgttgggaggcacctgctggagcgccaggccttgttggctgcaggcgctgggcaggcactgcgcagttcccagaggctgtggccacagctaggcaagtggtgcttccctgggttccttcttcccgccatttgcggagtggcttttcttagtcatttgtttactgatgcccacacctgctgccgtggccactctttcactcagctattctgtctacagattccagtagcagtgcacctttggtcctatgtcagctcattcatcccttaggaggggcctgcattggagcattttgtttgtttgtttgttttcagatgaagtgttgctctgtcacccagtggagtgcagtggcgcatcttggctcactgcaactcccacctcccgggttcaagtaattctcctgcctcagcctcctgagtagctgggattataggcatgcaccaccacgcccagctaatttttgtgtttttagtagagacggggtttcactatgttggccaggctggtctcaaactcctgacctcaggtgatccgcccacctcggcctcccaaagtgctgggattataggcatgagccaccacgcccggcctagagcatttaacatctgcttagccctgcccttggccctacagtgagatgattgtttgcacctcagggatgcaggctgatcaggtggggaggccacacgtgggaaggatggcaggccatagcagaagatggctttatactgatagacgtctgagggacatcccatggtcacaccctgcaagtgacctggtagcaggcagagttatgtcaggagactgtcgtttggggaagcaaggattggagtggaggctgcgcttgccccccagggctggctgaccctgggcagaagcaccatctcctccccaccgcttccccaaaatgtgggagatcaaagcgctctttgaaggaatttactgtatttccaaatgcaatagaacaaaacacaccattatgggaaagatcacagctctgatggactttacacttattttttttattttttgtttttaattttttaaaaaaatttttattattatactttaagttctggggtacatgtgcagaacatggaggtttgtacataggtatacatttgccatggtggtttgctgcatccatcaacccatcatctaccttaggtattcctcctaatgctatccttcccctagccccccgccccctgacaggcctcggtgtgatgttcccctccttgtgtccaaaaatgtggaacgcttcatgaatttgtatgtgtcacccttgtgcaggggccatactaatcttctctgtattgttccaattttagtatatgtgctgctgaagcgagcacaactttacacttattttataatttagtatttttaaaaaattttgagttgcatgtggagagacaccataatatttttcagtgcattttagaaaaagttttttattttaatttatttttaaattaattaattgtttattttttgagacagggttgcccaggctggagtgcaagtggcacgatcacagctcactacagcctcgaacacctgggctcaagcgatcctcttgccttggcctcccaagtaactggaactacgcccagctagtttttacatttttgtagagacagggtctcactatgttgcctagactggtctcaaactcctggcctcaagtgattctcccaccttggcctcccaaagtgagcccaggagttcaaggttgcagtgagctatgaacgcgccactgcattccagcctgggtggcagagggagactctgtctcaaaaaaaaaaaaaattgtaaaatctgaatatttgatactatattttatgttgttttctagaaatttctgtctaggtgctgaatcatgcagcctgctcttctactcagccgtgtgtttcagaacgtttcacagtgctgtgtgtagacctcgtgcttttttttttttttttttgagacggagtctcactctgttgcccaggctggagtgcagtggcgcgatctctgctcactgcaagctccgcctcccaggttcatgccattctcctgcctcagtctcctgagtagctgggactacaggcgcccgccaccatgcccggctaattttttgtatttttagtagagatggggtttcaccgtgttagccaggatggtcttgatctcctgacctcgtgatccgcccgcctcggcctcccaaagtgctgggattacaggcatgagccaccgcgcccggccgacctagtgcttttaactgctgtagtttagctgctgtaggaatgggccgtgggttttttttttttttcttcatttctttggttgctggacacctaagttgtttgtcattgttcctgacgttttcatgcaagatgatggcggggcgggggcagtgtccacgtgccccccgtatgcgggtggcgtggccgggatgtgggcacacactttttcagtttaccccgccccactcacaccctcgtgtgcactcaagattgtcccctgtcgagtgtgggcgaggagaggcacaccactattgttttaatttgcttttacctgattcctggtaggttgagcatctcttcacatttatctcagctgcttgggtttcctctggggcctctgagaaccctcatccaggagggtctcggtcacaccagggttggtgtcacctcccttcagggtgccaggcacccctcttcagaggtgctgatttcctcatctggcatccaggcacatttctgcggccgccctcccaggacatgacacagctcattaggtttcagctttttatcttcccttttatgagactacactgtagtaacctttgccggacttggatgttcccaggcctcccagtgtgttcccagagggtaactttttctccgactcctgggggctcacaggccctgctgtgtctgggtggtgctgatgctagctctgtccctgcaggcagacttctgcgttatgacccggctgctgggctacgtggaccccctggatcccagctttgtggctgccgtcatcaccatcaccttcaatccgctctactggaatgtggtaagtgatgtgcctgacactgtccagacgggagtatcccactgcttggtgagccccacatgcaggggatcgcggtggttgctgctggctggccagacagacagacagctctgctcttccctcccgtgtctgtcgctggctggtgtggagtactaggcgcttcctgccgtcttgccttggggatccagcagccattgggctgcccaggctggcgtcaggatggtccaggactgtaggggtggccctcctaccctcacaagaacctgcaggagaacgctgccatggtggggctgccattggtcacatgtgcctggcagtctggtggccttctcatgcatgaagtgggttgcccaggaagtaggggctctcttccctctctgccatgtcacacagtaaagccacttgcttgtgaatctcccacccctcgtgtgttccacaaacatggttatttttcccacatgaggcttcctgcaaaacggcctgcgcattccggacctaggcgagctgggtggcaggagcaagccggcatgagttgaaaggaagccaccagcgtggcaccagctcgtgatgggtgccaggggatgtttgggtgcccgggcaccagcaccgaggggtgggtggactgcatgggaagtgggctctgggcccttcgaggaaagtgtgggaggggagggccgtcagttccttctgcagcctttctgagatgcctcccacacctcccagactgtggggtgaagctcttggggttcctggcccgctctcccaaggctgtctctggggggtgcttctgggctgcttcccggggatcctgctgggggagtgggtggtcctggggctcagcgggggttgggcttgctgatgcagagccctgagcgtcctgtgatcacccccgaggctaatctgcagagtaaggccaagatcagcgtcagcagcacattgttccagacagttttcatttaaggtgaacccttgatcccagggcagaacaggacatgtttttcatttagtttatgacttgagatttttctccatctggtgagagaagtgggtgggggccagcctgctcatgtcaaagacagtgcattccaaagaatgccctgttcctgctgtcctgaacatgctggacacactccgaggatggatgctctggcggcccacaagggaggggcttcgaggggaggtccagaggtgggagtgagactggcgagcttggtgtagccaaacacaggcctcccggacacccctttctcctgagaagccttggctgggctggggagcacctgtactctcagccacaccgtccccagctggccccagcctcctgacatgggcctctggagccagggctgcagccgaagtgcctggccatcctggcgtttcctcccactgcctggcctgcatgcttcctctctcctttcacctttgcacacacccagcatgccagagatatgaggtggtgaagggtgaggagggtgtttggaggctgaaaaatggtcctgcaaagacgtccacatcctgtgaaggtctcttatatggcacacacacaaggatctttgcagacgtgatgaagtcaaggagcttgagctggggagatggccctgagttacccaggtgggccctaagtgccattgtgtgtgtccttttaacaatggagtggcacagggacattgaaacacaggagtgtctcttgtcaccatggaggcagaggctggagtgaccaagccactagccaaggaaggccaggcccaccagaagctggaagaagcaaaaaatggagtctcccccagagcctctggtggaagcacagcccagtcggcaccttgattttggcccagtggtaactaattggggattgctgttgttttcagcccctaagttggcggtcatttgttacagcagccacaggaagcgaggccagggtatttaaaaagccaaagacccctgctggaagacgttgtgggcctaacctttggagtgttgggtgtgccacgctcttggctgtccacagtccttctctgagggagatgttgggctcttacagccggaggaggtccctgccctctggcttcctgcaggcctgacgttgaccagcagtcattgaggtacatatgggtctcccagcactgggagcttggctggctgaatgcatagcaggtcctgaggacgcttttatttatgcacaagccccctcaggtcacttcccactagcctagccaacagtgtgtttttaaagtgaagttcattgtgaaggttctcagtggctcatgaatggcagagtggttaagatgcagtaagatttggccgggcgcggtggcccacgcctgtaatcccagcactttgggaggctgaggtgggtggatcacctgaggtcaggagttcgagaccaacctggccaacatagtgaaacctcatctctactaaaaatacaaaaatttagccggatgtgatggtgtacgcctgtagtcccagctactcgggaggctggggcaggagaatctcttgaacccaggaggcggaggttgcagtgagccgagatggcaccactgtactccagcctgggtaacagagtgagactctgtctttaaaaaaaaaaaaaaaaaaaaagatgcagtaagatttggaagacagcatgtgtctgtgtgtttggcatacgggtttttttttttttttttttttggtcataagcttttgattagtctcattttgagatagtttttcactggaacagtttgtggtcattggtgggagagggagtgagctcttcaaagtggtttcaaaaggagaaaagttaagaaacatgttgcagttccgtgggctgctgccggggagagtatccggacggcatctggagtgggatgacgaggcccagctctgtgatgccagaagcccagtgggtggatcagttgagccaaggagttggagaccatcctggggaacatggcaaaaccctgccactacaaaaaatacaaaaattagccgtgtgtggtggtgtgcacctgtagtcccagctactgggttggctgaggtaggagaatcacttgaacccaggaggtcgaggctgcagtgagctgtgatcacactactgcactccagcctgggcaacagagcaagaccctgtcttaaaaaacaaaaacaaagacaggccaacaggccacaaccagggaagcacttaaataacttaatagttatcaatgcagttgtccctgggtatccataggagattggttccagttccccgtggataccaaaatcggcagatgctcaggtccctgatgggaaacaatgttgtattcgagtataacgtatgcccaccctcccatgtactttacatcatctctagattacttatcatacccaagacagtgtacatgctgggtagttacactgtattattttttatgttattactttttgtttttatttttttcctgaatttttctttttttttttttttgagacagcatctcactctgtttcccaggctggagtgcagtggcatgatcttggcttactgcaacctctgcctctcaggttcaagcgattcccctgcctcagcctcccaagtagctgggattacggggacctgccaccaagcccagctaacttttttgtagttttagtagagatggggtttcaccatcttggccaggccttgtgatccacctgactcggcctcccaaagtgctgggattataggcatgagccaccgcgccaggccttttttttctttttgagacagagtcttgctctgttgcccaggctggagtgcagtggcacgatctcgactcactgcaacctccacctcccaggttcaagtggttctcctgcctcagcctcctgagtagctgggattataggcatgcaccactgtgcctgactaatttttgtatttttagtagagacagggtttcaccatgttggcaaggctggtgtcgaactcctgacctcaggtgatctgcccgcgttggcctcccaaagtgctgggattacaggcatgagccaccacgcctggctcttgaatatttttatctgcagttgctgcggagggctggctggtggtggcgggactcatgctcaggtgttgtgcccagtgcatgtcatgcagtatttcaatgaatcttcacagcaaatgctgttaatatcccctttggagactgaagcttgaagaggttcattcatacattcttcaaatgtttattgagcatctactgtgcgctgggcaccatcccggcccctggccctcacgcagcagcttcagtggtgaatgaatgtatagcactgccggtgacacagcaggcaaggggagggacagacaggggtggtggtcagggaaggcctctctgatgggtgtcctttcaccagaaacctgattctcatgcaggagggccctcaggtgtctggggaagagcattctgtcaggaaaacacaagtgcaaaagtcctggggcactcttgagtgtcctcggaggttttaagggacagctgccgctggagccaggcagagggagaatggaggagcaggacggagaggtggctggggacggtggtgcaggccttgcgggccatggggagagacattccctggactctgagctgggagccattgcagaggtggcatgatctgagtcagagtttcaaggtcactgcaccaaggacagaggagaagagacaaaggtggagctgagaggccagcaggccccagatggcagcttgaccacagtgggactggcggaggtgggagcagtgatcagggagagctgagagaggtggcttggccagcccatggttgggcctgagtgacccgtgggaggcaaggccgttggctgccctggggcaaccgtgggaggagaggcttgtggaggaagagctcggttttgcctgtgtccgacacggatgtccttgggctccagacagtgtgagaaggccaggcatggtggctcacgcctataatcccaagcactttgggaggccaaggcaggcggatcgcttgagcccaggagttcgaaaccagcccgggcaacgtggtgaaatgtcatctctgtaaaaatacaaaatttagccaggtgtggtggtgagcaccggctactgggaaggctgaggtgggtgggtcacttgagctctgggggtcgaggctgccatgagttgtgctcaagccactgaactccagtttgggtggcagagtgagaccctgtatcagaaaaaaaaaaaaaacccaaaacaaaacagactgtgtgtgagtctggactcctggggagctgggggcactggagaggggccttggccccaggcccactgtgtgcctttctgggctgtggctctagggagtgttttcccagcattgggctggggtgctgcccgcttctgctcatcagcacccactccgtcccttccctcttccctcccaggcttcctaggtgagccacctgctcccacccctccctccacctggccagctggcatctcctccactctgttggaacatttcttcccaaggcctcctcctgctcttccttgttcagaccatgggaggctttcccggccttctctttctgggtctttgggggagttcacactgcggaccctcactcttcctggagaccggccttcctgtgcgccacgatgcttttctggctctcttcctgctgttcttgtgaattctgcttcctccacctgatgttcatttgctcagcgaatagtcaccgagaacctgccatgcaccaggcactgtgtgtgtcctcagagagtgaatgacctctgtccttccagagcacagatatgtttgtaatgaacactgtgataagggctcaggaaacaaagatcaaggtgtcacagagggactgacaggcttttccctctgtcatctgagtctcagtctgtggcctggactcctcagggcttcaggaccttgggtccaggcactgtggccctacgtgggagtctccagtctccaaagggagcccctgccaagacctccccaatgttctgttctttccctatcactccagatgccagggcagtggtccaaggaccagcatggactccctcttctcacctgcccccggatctgtaccctcgcggactccacctggcttcatgccatcacccccgccagatcaccagcagcagctgcttgcagccagtctccccactgctcctctctagccacccttgagggccatgctcagaggtccccaggttttccaggaaatggaacttttcccctgtcccgggaggcccttctggcaggcgtcctcccacctgtatcctcagtcatcccaggtcttgggcctttctgggtgatctggcttctcttgtgcaaggctgcccacagacctttgttaccgcagcttggagtggtccttgtcaggtgtcccctccctcatacctcctcaccctgccctctctgactcagggttgctgacttttggggccatccctggcactacaggtgtccagcaatgtccccggcctctgcccactagatgtcagtagtaccccaagcccaggccatctgagtggtttccagacattgcctgatgtcccttgagggccatggctgcctgggcgttctgagtacctacccctcagcacagcctgccatacctgctgtcactgtttgtctctcactgtccccttcccaggagcatcctaagagagttgaagcggagcctgctctgcttctgtgtccccaatcctggcatgtgcagtgctccgggtggcagctgctgcctgaccttctgtgtcaaggagggtagggcacctgttgtagctcagtgcctgtgcccagcaccatgcctggcagaaatggatgtccaggcagtgtttattggctttgtgagcgtggattgcccattgactggttttctgcagtggcacctggtggacaaggtgaggctccattgtgccaggttctatgcacaccccgactctgtgaaataaagcactgcatggaggtaaagagcagcagtcatttgtagcaggctcagcgattcctggcatcccagtgaagataagataggcagcctgtgccactccagctcccagagcccccctgcttgccctgccctgccatgccctgtgttgtcccgagggagccagcatgggaggcacagcagctgccttgagcagttatttacaagagcaaagtgtgcacatgctttggtattttaactttattgaagaccagttgcatgtaaccaacatcaaagctgctggagacatagcaagttggaaccctacttccaacctagaaggatttctaggcagagttgcctgtgtctgacttcccttcctcactgggaccccgtaaacctgaaggggagctgtaaggaatcctgccaagacggcagatgcacacggggtcacgccggtttcctccagccttgggagggtgcttcctggtgcctttgtttgtccccttccaagccctgcgtggccaccctgctttctgctctccctgggtgcctggctctcatgtgcaggtctttgcttggggacacccaagtccatcctcaaggtcagtgtgcagctcctcccctctgaggcccctctctcccacagtgcaccctgcccaagacctctcgctccattgggccgggggtggctcctgcacatgtgctccagggaggaaaggcatttgacaggtcagctgcagacaggtgttctgacactcactgtcaaccagaccaaagccccagcccttggccctgcagaggatacctatagaggggcagcaggccttatgtctgtatcaggacgctgacctgtccctctggccggggactttcctgcttttagcctgagagtctctttccctggaacccaagtcagtcctgggcagaacaggacagttggccactgtagtctggagagttgtttgggaagaggcagcttttcctttctgggaggtgagagtccacttgctgcgctgggccgctggctgggcctggggtttcctgggcctggatgtttgacctgctggctggtactggcagcagctgcaccccagggtggccagacggtaggtggcgctgtgggcaaggtgaggtgtgcttctcctggctcctgggaggaggaagaggaggaggaggagaaggaagaaaaggtgtgggtgctcctgcctcacctcagtcacctcctcacctgcagctccctcacctgcctaccacccttagtgtgagtttgctgctgctgctgcctcagtttccattttcagatccccagccagcggtctatggctcgtttctgagtgccccaagggatccctccaggtgccgggaaagccgaccttgtaggtgctatgggatcagcccaggccctgtacccttgtcattcacatccccttcctgggcatcggtttctccatttgtaaagtgaggacgctcagctgaggccccatctagctctgaaatgctgcaatccctgcgctttaccaagtcctggctctggggcagctctgtgccgggacgggaccctgccctcctgggctggcactggattaacaaggtcagattggacattagatgttacatagaaaaatcagcatttggttaataagaaagctcacaacttattaaccaaggagttacggagagagcataaccaggtaatgcgtggggagacagggtcgtgggggctggaggaggtgatggtgggccataggcagggcagcacttggcccacgtgggctttttggaggagtcataggggcagggtgggcaggagttgaggccaaggaaagggatatgagtgtagacaaaaggtggactacaggtgggcctggggcttgtgagggaggaccccaagtgcatacctgcaatctggactgtctgctcaaggatggtggcatgtgtgtgtgtgtgtatgtgtgtgagtgtgtgcatgtgtgtgagtgtgtgtgtgtcagaagttaggatgggggcatgagccaaactgtctgagacccttgcttccatctggctcagaaatctggctcccagggcatggccgcatatccagtgggctccaagccagtgtttctggaccagaaagcgtcgtcctctgccagggcctcttgcacttgtgggaaagctgagctgagctgggcttactggcggagcctgtggcacaagaagggtttttctttgagcagagccagctggctcatcaggcctgactgagaccttggctctaggagcacagctcttgtctcttcagaccagtgtcacctaagatactgtggccctcctagctctcccccgctcctgtctgggctgtgctcacagctggactcctgcagaacgaatggcaggtctagcttcagctccatggctggggacagtcagtgccttgtccccagtgcccacgctcactcccctggccccttgatgttgggtctcaagtgcaagccgttccacggcacatgagtgtgggatctttcagagccaggcagtggacgtgggcttttagctggcaacagccctgctgcccctggggcactgcctgcctctgaatggcagctgagctgggcagcagcattgctctgtgtgctgctggcactggcctggtggggagcctctgctatcaggctagggctaactttagaattgtggtgcctgagcaacgtggtgacaaagtgtacaacaaggtgtctcgaactgggtcagctcacagcctgtgccaggatggctgggagtgacatggacaggaacaaaagggaggggagagggagcgcactcccacctggagcctggcaggcaggatccccactgagccgatctcttccactgagccggcccatccctccctgtaggttcctcatactccagagatggctgggtgggacccaagcgtgtcttccctggatgatttatttttggttctggcatttacagcatgatgaaggctattggacactgctagtgtgagcagaatcaccctaaccgaaaggcagcgtgcggccctgggcagtagggtttggtgtagacatctctcgggatccctcccacactgaggagaggaggcaggggacccaggctgccttagttactttcccttttcttaggcattcccagtaggttgggcctcctacttccacctttctgtggacccggctggtggccttcaggctaagcatggctggtgaggttcgttcgcgacctgcccccctgcgcccagttgggtgcatctcctgaaacttatctcccagagcttgggccacctgagccaccactgttctgcagacgcgttcttctccgtacttcagtgcctttgcactttctgcttcctccccttcgccagctttcccgccttcacctggctgccttggctcttccagcctggcttccctgagccctggctctgtgcagacatggctgggccctcctccctgtgccttcctgaaccctgcggcagtgctgagccctagccccgggaactgaggttgaaagtgtgtgttttgcctcctgcctagactgagagctcttggaaactaggggtggggtctgaggcacctgtggatgtcccgggcctggcctggtgctgtgaggcatggatggtgaagggtgccctctttcctggaggaggaaccctgaggcgtccccaggaagccatgcaaccaggcacactcacccccaactctactgggatcacgcacaacccgcttggctgttccccactttctcatgccttctttctctccctgtaaaactccctgccaggccccaggcctgcactgtcaggaactgagatgcagcccagcggggctgtgttatttgctttaccccattcctgggtcttctttggaggctgaatgaaattccatggacaatttccaaggcatgagtttttgtgtcatttcactgctaacctacttggtgacccaaaacaaaacccttcccttgagtctggaggagcagcctctgccccactttgctcagaggtgcaacaaggccttcaggagggaatgggtgtaaaagggtttgggctccaaggagaagcagctgcgggagctgcctggctgctccatctccagaagagctcttgcatgagtggaaacacccaggcctgcctctttcagccactgctcccagctttaggccaagcactttcacttagccccagaaactcttgcctagaaaattctcatggcctctagggatacatcttggagagtacttctgtagctggcggcccctttctctccagaagtgcggagtcagcctgggagggacagcttgagactcaggagctgatggatgtgctcatttgtggccaatgccacagggccacacagtggcagctggtgttgggctctccagtgtcacggatgctgctgccagggttcatcagttgccctagaggcagccctgttcctgccacctgtcctgactccccgccctccccatttcctgccaggcgtggcacagtgagacttaggtgggctcagataggagacggtaagtgctaggctgcccactgggcctcccggttcagaagatgctgggctgagaacactgagcttctgttccaggggagtttcccttgtttgtgttactgctggaccttgagatgattccattattttattcaaaaaaggggacactggcctgatgcagaggtgtggtctctctcctgcaggtgttggtggctggtgagcctgggctggctgtggggacccttcgcttacaggcaaggtgtgccctgggcagtgggcagagatctcaagagaagctgaaatgggggcagagcagcctgactcaaaggtcctgggggaagggggatggagaatctggttgcctgatgggaagtagccaattaggagggtcctgaggatggacgcagagggtgggaggtggagcctgcagagattccccagccacagttttcaaaaccagctgttgtctcgcaaggcactggcaggcaggcgcagggctctgcaggtgtgcaagaggttccaggcagctgctgggctcaccctcctaggaagacatttgtcccaccatcccatgctgaaaatgacccaaggcagggaccccacccggtgtgtgcagtgcaggggtgtgtgttcctggaggcctttctcccaaggccctccctggccagggcacccctaccaggctgagtcccacctgtccagctgacgtcacagcctcttgcttgaattggcatgggcggtgggtgtgagcccctctggtgaggacagcgttggcagctgctaggcactgtcccccttgggcagctgtgggagcagagggaagagagactgggggtacccgccttcccagatggagcgggctgctcatgggacttagctggagtttccaaggagactgaggtttgggggtttctgtgagctggccggatgttgctgaagtgcctctgccctctctggcctctgtgcccttattatgtgtaattctgttctgcaccgccctgctgtgtaaacttggcaagttctggtcccctctcctgcttatagtttcctgggctaaaatcaaaggaggtaaattatctcccaaggtcctttccattctggatcctctgttaatccaagggagatggggaagagggcttggaaacagctggatttggggatgaagattccactgggggcagaggggaggcagccccccacccaagccccatactccatctccattcctcactccctgccaggagtggaatgtgggcaggtaagagtcccagaggggtaagagccattggtgggaagcaactgtgggaccagtgccgccaccatggcccaaggacctggtgttcgatgccgcatccttccggtggcgtctgtggctcttctccttccccctgacccacccatgcctccgccctggggctggtgggattgctctcaaaaccaccttagccaagagggctccttcccagactcaggaggaagaacataggggacagccaggcctaaaggggctgggcaggggctctagagaattaaagctgcccaggccacagccccgccctgtgagggcctcacaagccctgtgcaggccgagtgctagagactcccctcttccaggagccagtgccctcctggggaggcgggcagactgtgccccactcctgggtgaggtgggtggggctgtgctggagctggctgccctagtggcctcagacctggccatgtgcgttcttagaaaggcgtttggtctttcctctaagatgagcatagcgtcccttcctcagggttggctgaggagcttggtgtggacagccgggctccaggcacacagcggccccagtacacctgtcgctttgcctgccacccgcttacggtagcagcatggttgtaataaagcaataaagccagcgtggatgggcgatgttgctattgctattaatgatctttgctcatgaaatttttagtcgcctttctggccttcctctatctcaggccaaaactgccccttcttcctaaggggcaccctgtgcttcttgctgcagaatcctggggcttcccccttcgcatttccgtggaactcagagatggtacctccctgcgaggtggggctgagagggggcccctgcggatgcggttattggaagggctgaggggtcagaggccaggtttggccccaccaatggctggcaccaataacaacacccatgtagaccaggtgtctgcccagaagccccatgtacctgaggtcaggaagcctccctgggaggtggaggtgctgttaaggagcagctggtgggaacccccaacgtgcttctctccgagggcctcaggggctcttagtctgccggctcctcaggctggggcttcctgcacccctagcgcccaccctccaactctcccctgctgctgagacagatcttggagcctcggccaggctgtcctagtcacaaggtaagtgtccaaggcaggcgtcagagtcaccagcagccacttgaggcctccttccctttgaattgagaggcatggaaaagggagcgtctgcgaggaaaggatggctgcatgcaggttccttgtcaggtgggtggggacgtgggacatgcctgacatcagagaagccacatggggcagggggatggggaaatggcctcctctgggcaagggtctggtgggacctgggggcatttctctctctttttttttcttgagacagactcttgctctgtcacccaggctggagtgcagtggtgcgatctccactcactgcaagctctgcctcccaggttcaagaaattctcccacctcagcctcccaagtagctgggactaccggtgtgtgccaccatgcccggctaatttttgcaattttagtagagacaaggtttcaccatgttggccaggctggtctcaaactcctgacctcaagtgatctgcctgtctcagcctctcaaagtgctgggattacaggtgagccaccgtgcccggccaggggcaattgtctgctcgaaggcacatgttccccaacagcctttgagcgtgggatcaagggagtgcagctgtcttgaggggcgggacagcccgtggcgagggacagtgccctccccatcaggagctcagtgctaaccgtgcctccactgtgactgtcacggtggtcagcctcatagtcatcatcaacactcctgccactgtcgtggctgccgctgcagtgagctcagtgcctgagacacaacacatggatccagcggatccgatctgccttaaggggcagcactggtgttacagaagcagcagctgaaggcccgagaagtcacttgacttgtcagggcctcggccgtgtgtgcagagctggtcccgccctgtgcttcatgccccctatgcctctcactgcctggtacatggatgcatcatggcaggaaagtggaaaaacagccccgagctgcagcacggccgactccaatgggccggaacgccagccttgctggcaggaagaggccctccaagcgcctctcgtggatccggcccagatccggtcctgaggcccctcccaccggagcctggggtgccctcacatgccctgcgccaacttcgcaacagcccagcttcccggctgctgtgtgccctgcctgtgtcaatattatgactggacttcctgtgggtcaggccgcacgtggggcgtccgcgtgaggtagccacgtggaagtggtacccccatgtccttgagcccactggagtctgtcccccttgccatcctcgggagcccggtgcggttgtgcccccctcatatctctgggcctctcagcacacaggtctgtcctgcctttgatagcaagacggacctgggcaaggttcctggcttctccgagccttggtattctcatctgtgacccaggcacagctgcctggctcactgttgcaagggccgggatggtgcctggagtgggtggtgcctggagccagctcagcgtcagtgaccctcgtctgttccctcttcctacctccagtcttaccgtccgcttccccctcgggcagccaccccagggcatctgttgtggaactgctctgtgggttttgtccttgatacctttccaggcttcttcaggttgggctcaggcagggactcagggggacttagcttccagcttgcagcctcaccgcttgggttccggctgtggctggccattcactgtgctaagcttcgtgccttggcgttcttaactgtgaaagagggttacctgtaggttccacctcctgggtcgtgtgaggatgtgacacactccgtgtgcagcacagggagccaggcagagttgaagcctgaaaaatgtgagctgggagtggctgttgtcctctgggccctgccccacggtgcccagtgaatgtttgatgactgtggtgtgtgtgggtcctgcccatcatgtgagactccctggaacctgaggcaaataggatttgagtgtggggtctggaggaagggaggagagaggggagaggaaggcgcggccggggtccttgctatcttcagtcacactgcacacattgctgactcctagacgtgtgtcaggccaggcccagggttcagggatcccagggcccaggggatggttggttaaaggcagtcttgggagcgggaaggacaagcggaagctcaggcagcgtgtaggtgagggtggggtgaggtggaggtggggaggagtgtcgaggggaggctggacaccctgcccctgtggctagggcagcagggagcctgtgtagacatgcagctggtgtggacgcgaagggtggcttggttgggacctgtcacccggtcaccatgctgctccttggctaggcagggctattcctcaagggccagtttggttaaaaggtgatgatgtctgcacagatgtggctccaaattccaccatccccaggggcccgcgcccccattcccggttctctaacccctccccggggccggtgtggtgaagacagcacagcttctgggccccaggcagcccctgttgctccttagctatgtggctttggataggttacctgcctacccttttctggataggtacctctgtctccttttccgataacctctgccacagcctctgctgtggcatttggtgatgaaatgagaccatgtgtgccaagagctggtccaggacctggccccggctggcgagtggcggggatggggcggccccttggtgtctgctcctgcctcccaggcgggcagctcggcctggcccagggcacatttctcctgcacccaggcatgttcttgcctctggtgtccccgaggctggggcctacagcctttccatcgtacttggcacactggaggcctccctgtctgccttcacccgatgcctgccttgaccatgtgatggtcaaggagtgcacagtgtacagcacatggggtgctgtgcaaaggacatgccccagccaggtcaccggggatctttctggccaggtcaggccgtggcttcgctgtgactgtcttggagaccgggtcttggcgggcctggtggaggccttaggtggggtagagtagccggtaggcctcagaggctttgtccacctctgacttcccagcactcaggtggggcccactcaggccaggaagagcaccgggccactcgcagccgtgcagcggggctccagccccagtcacaccactgattggcctgggcttgccgtttcactgctctgaaccataggttccccactcagaaactgggagggcgtggggctgcatggtgggccttttctgcccccacacttctgttgccatcctgttctcgggctcccctctgtgcctagggtttcctgggaatcctggcccagactcactgataaccacaaatgcccacccaatccagaggccacaattcctccacccctacttggacgtcccttaccagccagaactggccttcatctggccccaccagcctttggcacctctgaggactcacaggcccgtttcaaggagctcagtgctggactgcctctgacccctgtccctctccacaggtgcccaggctctggctggcccccttcacagcgggttcccttccccgacaggcctctgaggggcaggcacccgctttaaacaggctgcctggcttccagtcctgttctgcctgcctcgagcaggtcagttagcctctgtgagcctcagtttcctcttctgtgaaatgggtacagtggtgttgatctcattggcaaggcttgcatgggaagtcctaacgtagtgttccttcagaccccactgcctccagccctccccagggtccccttttctgaagtcctatgtcttggagccaggcgtggagaaggggctgggaccagcctcgccagcacacttgctagctgtgcagccccggcgggtcataccgggcctctgggactcagtttccttgtctgtaaaaatgggggggagcgtaagaagctgcgacggggtgaagtgagcagagacgaggtctgatttggattttgtgaaggtttctgcaaccatggcagggatgcagagagagcagggttgggatgggatgcattttggaaatggtgaaggacttgctgatggaaacctttccaatcagacttgctaagaattctttcgtgcttctcttaggaccctggttgggtgggctgaccttggagtggtgcttcctgctaggtggtgggggcaggctctgggaggggtgtcggctggaagggaccttgttatagtgtacatggagcacctgaggcctaggagggctcagaaatcactacaaacccgttgtcaagccaggctccggtccactctgctgccctttctttttgtttttttttttttttttcgtgagactggttctcactctgcctgggcaggagtgcagtagcgccatctctgctcactgcaacctctgcctcctgggctcaggcgatcctcccatttcagcccaagtagctgggaatacagccacacgtcaccatgcctggctaattttttttgttttttgttttttttttttgagatagagtttcactcttgttgcccaggttggagtacaatggcacgatctcagctcactgcaacccctgcctcccaggttcaagcaattctcctgcctcagcctcccaagtagctgggattacaggcgtgtgccaccacacccagctaattttttgtatttgtagtagagacagtgtttcaccatgttggccaggctggtttcgaactcttgacctcaggtgttccacctgcctcagcctcccaaagccctgggattgcaggcatgagccaccacgcccagccctaatttttaaatttgtgtgtgtgtgtgtgtgtgtttgtatgtgtgtggagacgggagtctcgccatgttgcccaggctggtctcaaactcctgggctccagcgattctgccgcctcaccctcccaaagtgctgggactgtaagcatacgctcctgtgcccagcctccactgccctttctttccgtgcctccagctggctcctctgactgtcctgcagcaggaagctactgcaggtgccaagctcttggggttctggtgtttagcccagccagccaagcatggttctgtccctagctagtccctggccctccctggccattcgcttagagatgccatttcctcctagtaaaccctggggagggtgaggccggcttgaagctcagcttggcagccatgggctccaggagccagtattttccctcgggaacacctgacagtcccggacgcctggctctacatggaactgggagagtggcctgtcattgtcaccagcccctgcaatgtccccctctactccttggtgctggcttgggcccaccccatttcagtcctgctgagctttgccttggttctttattcattcagcaaacatctcctgggcatttgccccaatggaaagtactgttctgggcgctgtgggcttttggccatgagcaggaagttgactccggaggctgcagggacctgcttaggcatcctcattaccgcctgggtcccagagcgagccaggagcctctgaggcagcgggggcttctcaaccacacacctggctctcctcctccaagactttctgcgtgcaccagcatcttccattttgtgtttcctgtctgtttaccatgtgtaattttgtcagcatgtcacgtccctttcataatgaagcaagggacaaagaaacaagggccagtggagcccagtacagggtggccagaggtgtcggctctatgtaggtctgctgctctggtgtgtccctgcgtgagggtcaggctggggaggtggcggcaagaatcagccaggcaggaaagactaacaggctgcccagaggccgggagccggtgcatgggtggtagtggttgggggcattgctgagtgcagaggctccgggggaaaagccaggggttaagggatgccaggcaggcatctgacctgggactgaatcctctggcagcaacctagaagcagctcagcaaggtgagggagatttgaggcatcagaggcaaattatgtcctcttagagcccctgcggatctgccaagactgagggcttctctgtctcttttctgcatcctgtgcttggctgaagatgagaaccttgctttcccactgagaggcagtgggccacagcactgcgggagccacgacatctgcagacgcatttgatttccccattaatagcaaagctcccactccaaggatcttccagcagacaaagggcattttaaccttcctctcagtcccagttgcttggagtggctcatgtggcctctctgaaggagggaggaggcttcagacagccccatgcatgttcagaggcaacagaaatttgcaggaagggccaggcgcagcggctcacacctgtaatcccagcactttgggaggctgaggcaggtggatcatctgaggtcaggagtttgagaccagcctggccaacatggtgaaaccccctctctactaaaaatacaaaaaacagccaggtgtggtggcacgtgcctgtaatcccagctactcgggaggctgaggcaggggaacctcttgaacccaggaagcgggagttgcagtgagccaagatcatcccattgcattctggcttgggcgacagagcgagactccgtctaaaaaaaaaaaaaagtgagagagagagagcaggaaggaaggaaggaaggctctcatgcagaaggctccggccttggctgagcatccagtttgctgggtacctgggccaggcccttctctcttgggcaatgagactcccaatgacagctgcctcgcagggctgctctgagagtcagaagacctgttcctgagttttagggatgctcagttgagcaggacctggccctgttctctggagctcatggtctgggggacaccccctcacctgcctctggactctctggcgtccatccagccacttcagtgcgacgtgtgactgctgcttgtgcccttccccaggagtggctgtgttccgctcatcatggaggcctggtgcccggcacagtgcgcagcacttcaaggcctcagagcatgtttccttaaagccacatcatctgtgaaaggagcggagcattcaagcctgctggctcttcccaggcagagggagacctggaggagaagcccagggacccacgcatccccctccttctatgggagccactctgcctgccccacccagatgccatattcagaggatgggaggcagaaaaacaggtggcttccgccccagagggcgagcatttgcttctgtgtgatcggagggcagcacaggggctggctgggccctgggatcatcgtgacaggctttagtggtctgggtggatgggccgtggtcagagccgatgtgaccaaattggctttcaggggagcccaggccaccttctgagtggaacccaagcaccagcataggtcctggaggggccaaaggaaaagggaggttcagactcactcaggtgtgaatgctgcccctgcccaggtagggacatggcacccccaccctcttctgtgatgcaggcctagaggtggcagttctggaaagttcctcctcaccttgcaggggaaactgttgaggtggagggcacttgtccagggcagcacactgtgacaggtgggagccgaggctcgggaggtgggccgggctgagctgtgacaggtgctggtgagcatctcctccgcttccccgtgctctggccgtagcagaaagtgtcccactgctgtctccaggcagctctggctcttccctaattcggccccatccctccgtgtcgcccttcttcttgggggtgggtacagtgctctgcagagctccatggcttcccagctgggtgacatggacaagccatgtcctcactctgggctccagtttcctcctctgttaaatgggcatagtgggagtacctgcttgtaggatcatcgtgagaatccagtgagttggtccctctgcagggtttagagctgtgcccattagtgctcatgcatgtgtgtgtggtcactctggtgcccatccgcatccccagtggaggccgtgcatggccttgaatgagtagctatgtgctccctttcacttctgtgctgtgggacctttaaaaaaatctgctggccgggcgcgatggctcgtgcctgtaatcctagcactttgggaggccgaggtgggtggatcacctgaagtcaggagtttgagatcagcctgaccaacatggtgaaaccctgtctctactaaaaatacaaaaattagccaggagtggtggcgggcacctgtaatcccagctactcgggaggctgaggcaggagaactgcttgaagccgggaggcagaggttgtagtgagccaagatcctgtcactacactccagcctgggagacagagcgagacactctgtctcaaaaaattaaaaataaaaataataaaaattttaaaaatctgctgaattcactctggccgtcactgatgaaaccttgcagggaagcggctccgttgcctcagcctgtgccgctcgcagctcacgtttgctggcttaaaagcagccagagcagggaggcaagctgcccacgctgttggccgcgcactctgccttccgaacacgttcctgtactgcttgccgtgcacggagggccacgttcatgcctttggggccacgacagctctctctagagtaggacatgggaggggggctgtgaacatctggggcagcatcttctcttcatggattgtcaggaactgcacccttgtttaccgagggacagaggccagcctcccactgccttgtggctgaggggagggggccgggtctctaacgctgtcttctttgtactgaaaaccaaacaccttctctgcacaaggtatgtctgtgagagaaacagacaagaggacagaacggagcaggtgctgaaagggttgctgttggctgcaggatcccggctaccaggccccgagcctggcctctgctggccttcacagccagttcctgctcacgggccaggtctcaggtccagtgcctcctcccgcagaagcctccagaccctcctgcccagaggagccccccaccccacccctggctgggtgtgctctgggtgggagggctgtgactgccgggcagcggggagggagggcgagtggttcccccaagtgcggctcctctcctgtcgtggcagggacatggcagctttcaggacaggcagaggacatagtagggaactgaggagagttgtccagagaagtttctagatttggctcagctttccacgtagggtacagacctggaagggaccgtctggccacatctgactgccaagtgctgccggggagaacctgctgaaggtgctggacgtggctgtcctgcgagaaggccacgcgtgggagctgaactgagcagggggtgctgggtcaggttagtgctggccattgggtggacgcgggcccatcgtgggcttgtgagccactgtgggcttaaaaagtgcagagttggggggatccagagtgaggggctggagcacaatttcatgtgaggggtcattctgggacagtggcaccacaagcagacccgggtggccgctggtaagggcctgtgtgtgtggttgcctacgctctttccatctcttgtcggcttctcacagcctccacagaagacagggatagttacagggaggacagggaaagtccgaagtgtgcaggcgccctgcatccccgcagccaagttctgggcggacactgccctgagccaggacggtgaggtgggacgccttccccacccagctgccagatcacccctcctggagggtggggtggggccctgacaccttgttctttgtccctgccccaaactttggggcctgaatagaggaaggcagtgacattaacttcttcctggccatggatacaggtccctgaggacaccgtgtgtggggacagcaaagccttcctaatcccccagccggccaggcaccttcacacctaaatggaaacctgcatgctggtttccatgaagaaaaggttgcgattggggtttctgggaggccagtgaggggttgggactctacagaggagagtggactcacggggcgctgggccgccctccagccaaggctcctggcctgggggaaagggggcaagggatgagggatgcagggagcagtgtgttcagaaaaggttgttccctgagcacagatttgacacctcttcactgtcagcgctgagacacgcccctgccctggggagctcagaaagtcaggtgcgggatccagtggcctaattttagatcttgggtctccatgtcgaaacgacagcagagtgattaaaaaagaaaacgacagcatggccttgcccccttgttaattatggatcaagcacatttccatgagaggggcatctccacgcagggccaccgtggccgcatttctgcagcctgcaggtctccgtggcacccacaccccccaaccgggaatgggggtggactccccaccgccctgatggggcttgggtgcgccgcgggtgaggagcagcgtctcacccacagaggtgtctcctcacggggatcagcaccgggtcagggatgggagggacggtggtggccgtttcaggcaaggcccttattagacatgagaatcccaaatggcagatgaaatacccatttacccaggaccctcgggaggaacccattttgcatcagagaattctccagtattcagtgaaacttttttttttttgagtcagagtctccctctgtcgcccaggctggagtgcagtggtgagatctcggctcactgccacctccgcctcctgggttcaagcaattctcctgcctcagcctccctagtagctgggattacaggtatgcgctaccatgcccggctaatttttgtattttttgtagagacaacctccacctcccaggttcaagtgattctcctgcctcagcctaccaagtagctgggattacaggcacgcaccaccgtgcctgactaatttttgtatttttagtagagacggggtttcgccatgttggccaggctggtctcgaacccctgacctaggtgatctgcccgcctcggcctcccaaagtgcaaggattacaggcatgagccaatgcgcccagccttcagtggaactttaaatgcctgaagtttttttgtatcgtctctttaaaaaattaaccgtccgtctcagtctcaggtaggttccctgccctcctccatccaaccgtgtcatggtgacgaggggtcgctgaccagcagctcaccagagctgggacacacggccctcatgccctgcgctggtggccgagggtgctacactttttcaggactctccttgttcagtgtttctggcccctccttccagtgtcacattgctgcttatggtgcctggtgcctgtcccgtgcccctcctgttttgctgctgcttatctgctgttcggggcatcctgtgacaggccagttggaatcctacgtagagtgaaagcatctcagccccagacaggcccgaccactcccacgccagcttgtcttctcatcagggactgggctgggctgctgtggaggcctgcaagcccgcgccagcttctccaccctgctgggcctcagaggcgcctgtcagctccagctcaccaccgtgtgtggccctctgccccttgcctctgggacaggtttagtctgcagttattatgttcaaaattttaaaattttaagcagttaacactgatgcgtgatgaaaattccaacagcacaaaaaggcagatagtgacaatgtgccccttgaatccctttcccctgaacccctttccggtgtcttgggtcccttcctgagatgttctctgcagccttctgcatggcgttcaacatcatttccttcatcaacagtcgaggattacggtcccataataacaacagtaattaacgtttattagcatttcccaggtgctgacctttgcacccgttctcccactgatggtcatttggtttatttccaacttttcctactatgcacagtgctaaattaaaccacctgataccaccaatctgcacacgtgggcaggtacatgcaagatctgcagcagggtctggaataacgtcctttagttacaacgttgatgataaaaagttgattcccttctgcacccactgcctgtgtggagtttgtgtgctctcacgactccgtgggctttctctgtactctgctttctttcacatctccgagatgtgcacattcagtgaactggacatctaagtggtcccagtctgaccaggtgtgggtgcgagtgtgtcctgtgatggaacggcgtcctgtccaggctttgtgccctgggagaggctctagccacctgcgaccttgaactagaataagcgggctggaaaatgaatgaatacaagtaattgtcaactaaaaactgttgaagtctacaacaatcacacaaatgcatgacaataaatgatgggatccgaatgcagcctgagcccgacacttctgttcttgtttggttttgaactgtgtggtggtaggaggtgctgtggcataccctcgatagctgcggggagtggggggaaggggggtcctgaagcagaccgttcaggtgtggcttgtgcacacaccccttgacacccaagtgccacaggggaccccaaattccgtcccagctgtgcatctgcaaagctcaaatggactcttgtttcaaattcgacctaatcggtggcacagaaaagctgtgaagatcgtccccagagaaaccgagcggcagcaggccctggaacaggcagagattgtgctgttctgtcctgtccctccctttgggtgacagagaaccacgaacgtctgtgtcctcagagggtcacgggacacgttccagaggggggtggtggggagcacagtgagcacagaacatggtattttcaatccaggctgtactggcgaggagagagagtctctgtgcccagccctgctgatcccccccgctatcagggaggaactgttttcagggacagtctcaccaccctgtgaagaaggatccatttccgtcagcaccctgcctttcatgctcctccctgctgttgagcagcgtgtgctccctccctgcgcccacgctgcccaccccctgttggcatggcctctggaagctgcggacttgcagggactgaatgtgtgtgcaggtacagagtggcccagacgaggacgtgcctcccgtctgctgggctgaaaagctgtggcagccccagacccgcctgaaaagcactgcttttgcccaagaggatggacagattgtcacagctatagttatcataagtggcctgtggctttgtgaggtattagcctcagggagctgagtggagacacacaggcctgccctgtgctgtttttgcaactttcctgaaaatctaaaagtgttctaaaataaaaggtaaaaaatgccacggttggctgggcacagtggcccatgactgtaatcccagcattttgtgaggttgagtgaggcaggtggattgcttgggcacaggagtttggaagcagcctgggcaacatagcaagaccccatctctacaaaaaaatataaaagtcacacctgtgatcccagcactttgggaggctgaggcgggtggatcacgaggtcaggagtttgagaccagtctggccaatatggtgaaaccccatctctactaaaaatacaaaaattagccaggtgtggtggcatgtgcctgtagtcccagctactcaggaggctgaggcagaagaatcacgtgaacccgggaggcggaggttgcagtgagccaagattgtgccactgcactccagcctgggcgacagagtgagactccgtctcaaaaataaataaataaataaataaaaattttgttaaaaagggcatggtggcacatgcctgtagtcccagctatttgggagtctgaggtgggaggatcatctgagcccagggaggtcaaggctgcagtgagctgtgattgtgccactgtactccaatctgggttaccttgtctcaaaaaaaaaaagaattccatggctgcttgtcactgcagagggttggtctcacagcctggtcagggtcctgctgaggagatgtggcctggtcactgtgccttctggacacacaccacctagtgtggacacttgccaccctccacacactgcccagacaggctctacctcctgtccttcaagacctgtactcggccggactcggcggctcacgcctgtaatcccagcactttgggaggccgaggcgggcggatcacctgaggtcaggagttcaagaccagcctcaacatggagaaaccccatctctactaaaaatgcaaacttagccaggcgtggtggtgcatgcctgtaatcccagctactcaggaggctgaggcaggagaattgcttgaacctgggaggcagaggttgcggtgagccgagatcgtgccattgcactccagcctgggcaacaagagcgaaactgcgtctcaaaaaaaaaagacctgtgctcaccgtgaagccgtcacagactctggtatgaatttagccacagacttgatgttctgatgcctcgaggagcttctgggtccctcaagggcccaggtgacatgatctccagtgcagcctagagctttggaatccctcttcctcccccagacccctggtctccagaagacccctaggagcccagggaccattctagaatggcatgttgtatacacgctgtccctccccactggatggtcagccctcaggggcagcacggcttggcccagcctacccagcccagggcattcaagctttggcctcacctagagccaggctggacgccagcagggctgtgtgcagcttggccagctttggagctcccatctgtggactgccgccatgacaatagctacctcaaagtgttcttgaggaccaaaggaagtcattccttcccctcgagggaggctggaacctaatgggtatcccgggaggtggggggaggttcggatagaacatcccgctgctgtgcgtgcagcagagtggctgccatcagatttctttggggtggcctgcgcactggctctgatttgatgacgttctctgtgttttccaattttcttcttgctctttagctccttccttctggcttctccatcttcacatttcccacagaattcagttgtgatttagattttccatgcccctcactagcgtgttctggctcctgtcatgcagacaccttacacttaaataccaagtccgagataaacctgctttcagttcacgggcgcttggaggtcctgggagttctgtccttgagcatgaggaaggagatgcacagggtagggccctgtggctgtgccccagacaggaggaggaggacgaggaggatgaggaggaggaggaggaggaagaggagggaggctttccagacacacaggcagggctgggggagccatgcaggagataagccaggctgaacttgggacttttgcacacaatgcttctctgcctggaaggcccttctttctgtgttctgtgtggtgtctgcttttcatcctgcacgccacagtgtgaaggtcacctccctgactgccctcgctccaggttattctttctcccagcaccctgttctttggcgagcgcatctctggcatcatcacacagagtccatgcggcacagacaggaggcccccttgggcagaggccctgaacgcctcgcctgcttgccctagtgccccagggcctggcacttggcagccctccatagctacctgaagaacagatctgtgtgtggagaggggtcgggagctctgcactttgggaggactatggctggcatttgcttgcagttggggctggtttgcaaatatttctctctgcctcagcaggtgagaaatagcacctcggagctccttgcctgttcaattatttccgattgaattaattatcctgcagtaacagcggagctgctaatagggaacattgggtgccccccaggcggagcatgtggctcgagagcacgcctggagctggagaccagtgggcagcccagctcttcgggggcgcaggccccctggagctcttctgacgatgggcagcttcatcctgcagtcaccagtgcatgcagaggtccagccacggccacctctttcttttctgtcctttaaatggagagggtcagcacgtagcaaatgaaccaactttgctttgactgcagctgtgaagataatgaggcagccttggttgtcatctaaactcagcaatggtcgagagctatttgggatttcctggcctgcttccaaattgcaagccctgttgggctactaatgccccaccttgtcccagcctctctttggccataggctaggccagccccagggtggacagggaggctccccagggtcggacgaaggcaggcgcctgtgagcagaggcctgggggctggatgggtggcaggtggccaggccactcttcctagcccagctgatgccatcccgttatcttgtaattttcttcccggggccttatcagccttattagcaaatgtcagaaacaatgagagtcacttaaacctgatcatgcccactgcaccccccaccagcctggcaccagtttgaaccaagcctgcttctgaaaatgtggtggagaaagccctgctgctcctgggaggggctcaggccatttgattctgcctggtgggttcagggctgcctggctagccaccaagacacgggagagcaaagcccggccaaacccaggggcagtggtgtccagcaggcatcaggacatgccgtggcccacacatgcccttctccacaggtgccatcatctcctttcttctcctgttagtgatggcttcattggcctcaggtgacaccgccttctagcccaggccactggatccagccagagcgtctgtgcatcgccccagggaggtgtggggaggctcggccccacctggcaagtttataggctgcttgaggacataagatgggtacagaagaggcttcagggctcagcagatgctgtgctgggagtgagcccaggcaaggtggcccagggacagaagatggaaggtcagtcgtggcctccttccagaaggaaagagattttagcaggaagagacaggcaaggaaaggaattggtttttcaggcagagcggtacttttttaaattgacaaattttaagcatacagaaaagtagagaggacgaacctccaaacatcagcccttagattccagtacatcctgccttggtagctgacgtcacgaacgctgtgacctgtccctctgcactccatcatagcatctctaaaacggaggacatttcctacctcagcacaacttcattatcacaaaagagaacattttgagcaaaagtttggaagcaggcaaaagtagggtttgttctggaatggcatgaatgaatgagtcatgggctggacccggccccgcagaaagagcagaggaggccgtctctggtgtaggagttgaagccaagactcagcatgcaggacaaggagcccagcctggtggcatgggctgtggcttctccagtgggcccataggaatggccctggggctgggacttgtggggacggcggccacaagaggaggatcttcagcatggcctgacagcacctgtaatgtaggcaggcaatgggctcctccaggtggcaggaacaccgtgaggagcatgcaacgtgctggagaccatggggcatgtgacctccgggcacaccctggacagacctgggtgagaggtgggctgggacgccaggacggtgaggggcttcaaggtgtgtttgtcctttgtccttatacaggtgacctgcatgggcgggtgaggtccatcagaatgctctagaacaggacaactgaggtcccggctgccccgctcaacacgccatgattcctagactgccctgagaggtcaggttttaaatagggtgtggcccggcaaggaccctgagggatgtgaggccagacagctccttggtggccgcctgcacgggaagctgagtggccctttggaacaggaagtgccttgtccaagttaacccgggcccgggcccaccttggactccctctggagagaacggctggcctgttcgcctcctttctccttccttccaaaataacatgtccaggtcccttggtaagaatgctgcagctggggtcagtctccaaactggagtttggtggctaaaatgcccgcctttctgcccccaatttcacacatggatgatggtcctggttcagcagggaagattctcttggacccgtgtctgctggttgggaagtggagaaagccgccctgttctgcctccattttgaaacgtcttttctgttcggaggactaaaggaagccagagctggttcagatgttcatgagcacctgtgccagcccctgcccgtcacacttgaggacaccaaggctgtggtctgtgcagtgaatcggggcagtggggggacttcatggttagaaacacaagctggaggccggatgcggtggctcatgcctgtaatccctgcactttgggatgcctgaggtcaggagttcaagaccagcctggccaacatggtgaaaccctgtctctactacaaatacgaaaattagctgggcgtggtggtgggcacctgtaatcccagctactcgggaggctgaggcaggagaatcgcttgaacccgggaggtggaggttgcagtgagccgagatcacaccattgcactccagcctgggcgacaagagcaaaactccgtctaaaaaaaaaaaaaagaaaagaaaaagaaacacaagctgggcttcctgcttcccagctgtgtggctttgggccagttactcactgtctgggtgcctccatgttcttgtttccttatataaaataaagttctttcctcgtggattgtcaggaggattctgtaataatccacaggatgtgttctgcatgcactaggtgctcaactttcctgacccccgtccagtgcccccctcaccgaccacgtctgccctctaagctgccagtcctataggaggcattaagacgtctagcaaggctgtgttctcagatgcctcgaaatgggacctcagccttggagttctctcctcccacatggaggcaagtcactgacagtcatctagcaaattgtatgcatggtcaagctcagaggttctattttgggtcaaaaaaggcatgagctggctgggcgccgtggctcacgcccgtaatcccaacactctgggaggctgaggcaagcaggtcacctgaggtcagcagttcaagaccagcctggccaacatggtgaaaccctgtccctgctgaaaatacaaaaattagctggatgtggtggtgcatgcctataatcccagctactcaggaggctgaggcaggagaatcacttgaacctgggaggcgaagtttgcagtgagccgagatcgtgcccctgccctccacctggggtaacaagagcaaaactccatcttaaaaaaaaaaagcacaagctggattttgccctttgtcgtgagagcatttcatgccttcatgaaagtcactgcagctgtgcttcaggcagagggcccgggatccaggtggcgtgcgctgccttccgtggccccttcaaagggcagccaccttcccagtgccgcaggagctcctggtctggggccacatgcttggaagggccactgaatgtggtgaagggctgggtcctggtactgagcctgttgagacttctgcaggattcactgccgtatgcctgaggaaggcagacgaaggaaaggacagtgtggagtgctcagcagagtccccatggtcgcacttgggaagaacgccctggcagtggacggtcagtggtcacatgcacatgcgaggccctcaggactctgtaggacacgacgtggcttctccacagtcctggggatcggaagcagatgcagaatgtggccgagtggcccgggccagggcctgagagtctgcattctgacatgcttccccggtggtgctgctggtctgggaaccacactgggtttaagtaactgatttaagtaactgatgcgaggaggccatgctctgggggaaggcagctggagaggagaagaatgatgtccccatgccccttccagcctcagagtcctctagacccggcagtgtgcaggaacggcagcttcactgcccatcccctggggtactccctgcagccttgggccctgctcctgcaacggtggccgaacggtgcaaaggagggggcggcccagtccctgcaggctgccctcagcctgggtttgctcatctgtgagatgggatcacatgtataatcctggctacttcacagagcccaggcgaggatctcatggacttgtgcatgtggaaaagccctgaaactgaaagattctagaaacaccaggattgtggtcactgtcattactggagggcataacccattcccctgtttttcctccatgaaagacaatcccaccaaaacacgaaggccctgccctcaatctgtttgtgtccttggcatggttcagcctgctctccccatggcctgagaggaaagcgttagccaggagggtagttggaggtggcgggaggtaatcccaggagcccgtggtgagctgaggatatggagaaggctcatctggggtgacctgagcaagcaccctctatcccaagccagtccccagaggccacgtaggcacctgtttctggattaactgagcgggagctcaatcaggcaaaccaggttgcttggcacggtgtttgccttaaagaagaacaaggtgggccaggcgtagtggctcacgcctgtaatcccagcactttggaggccaaggcaggcggatcacctgaggtcaggagtttgagaccagcctggccaacatggtgaaatcccgtctctactaaaaatacaaaaattagctgggtgtggtggtgagcacctgtaatcccagctacttgggaggctgaggcaggagaattgcttgaacctggtaggtggaggtttcagtgagcagagatcatgctgctgcactccagcctgagcaacagagcaagactgcatctcaaaaaaagaaaaagaaaaaagaaaaaagaggaaggtgggctgtgcccttctggctcaggcactgatattcaggggccagtaccaggcagatgagccctgggtgttgggctcacatgtctgtggcctgtcgttttagccttggggccaggggtagcagccgtttctctctgggcaaggggctcatgaggaaacgtttctgccttggcagcccaggccacagctgtgctggctgcagacaccctgggcaggccccggtcgctgaggagccttcttgggcaggttgcttcatctctgaagctcagaatcctttcctggagcacagatatcaaaatatttatccccagaagcctcaacaaacctgtgctcaccgctgctttaggccctgcagcagtcccaggtctgggcagatgtttcaagttcagtgtgtgggctctggcttgctggagctgggcccagggaactggcgccttgggatgaggcccgccatgtccgagcctgcccatgccccgctgctgctgcggccggtggtcttggggctgcctgccagccttctctcctgggagctaagtggggacaggtgctgcgggccacggtccacgatgctccctgcttcctgtttggtgggcagcctgggttttaggaatgtgtagagctggaggagctgaaagagctggggctcgggatcaggtggttcagctgactcgggaaactttgaggcaccaccgcacatgtccgtgcgtgagggagacatcttccttgcagggctctgggaggatggggtgcttctgtaatgcccagtcttgggcctggcgcctacctcatatgggtgctctatatagcagcaggcggagcacaattctgctaacgtcagcaacaatcctgtctgttggaataaacatgcagatgcatctgtgaccccagaatcccagtggtggctctgtcctcgtctcagccgagcactcatcggccagggtggctggactcagcacggggctggcactgaaactggcagtcactgctgtcagtgcccacagaaagcaagaagagaatagacaaataccaggcagtggagacactccctgcccactgcagatttataatcagcgaacatttactgagtacctgttgtatgccttgaggtgctcacaggggagcactcgggagcccattcactcgccagtgatgagtgggcactgtgccaggtgctgtccaaggtgggggagcgagggggtcactgcaggagagggtgagaaggaggctgcatgctgcacgaccctctgaaccctgagcctgcctggagaagtgggctgtgctgcggggaccctgttggagaggggcagcatggggaggggcggagcctgcctggggcctctcatcctgcagctgcctggaagttgggctccttctgacagtgtcctcaagtagacgcgggttctgggggtctggctggtggaggccagctggtgctcctgactcactggctcctctccttgcacagtggctgctgccacctgcctagggagtcttcctggggctcagttcccctgaccccctgggacataatgccagaactcatgctggctggccaccctccctcacgtgtgctgtgctcagcccgaagttggtgctttcacctgtgtgctctgggcaaagcaggcgcagaggaggcactgggatagagcgcagagtccacctggggcagccccctcctcgtcccggccattgccccatgttgggggtcttctgtcgggggagggagggttggagctgggattggaaggcccctctgaggctcttcttccttcctccatgagccctccaggccccaccctccatcctgcgcccctgccccatccccacccacggccagggctggctgctgcccattttggccccttcccttggggcgttgcttccaggttcaactcagattctgtcttttccagaagatgtctctgtccttccatgcccccagcctttgttccttgtcctcccctgtccctgcactcctggggtgggccctcctgctcccgagcctcctgcgtggaggctgtgagctccctgccacctgcgtggtcagtctttcctgcaccagcctcccaggacccctcctgcccacgctcctgagagattcaggcgccagtgcatgggtggggcacaggggctgcggcagacagagggtggtgatacaggggtggagtcccacaggccggatgccttgacacttctcagctgcagggctgtgcccggggctctgtgcccctgaatgagggcaatggttcccctgcacagtgaccttgtgagctgattcaggccccatgatcgtgattagctgacagcacattggccctcagagaaatgaaaatacacagttacacagtagcaaaatcccacgagcagtccctcagctggggcagggacacacggactgtggcacgtccacaccaaagaatcctgcgtagccacaaaaaggaacaagctggggatacatgtgacaccctgggcgcatcgcagaggcatcataccaagtgcaggatgccacagcctgcgcgattccatttctgtgacacttgaggagggaaacgggatggaacacaggacaggagtgtctggggtgggacagggaagggcccagctctgggttggagcctggagctggctggaagtgctgtgtcctgatgtggtggtggtatgcatttgtcaagactcatagacctggttggggcacagtggcttacagctgtaaccccagcattttgggaggccaaggcaggaggattgcttaagaccaacagttggagaccagcctgggcaacatagcgagaccccatctttactaaaatcaaacaacaacaacaaaactcacagacctgtgcattaaaaagggtacattttactttatgtgttaccttcataaatctgacctaaaaatgatttttaaagtccccccttctaaaatatactaatctttaagaaacaaaaacaaaacaaaaagctggctgacagtgggtcctactactagcacatgggcgttgatgatggtgataatgtctctcgcccataaaaggccagcttggaaacctgagccccagctgcttatcggcctgtgtagccagacaaccattctgccactcgccaaatattttcaaatttcctttccgaggcaggctgaagtccaggtaaatattgacccaagaaggcggatcacgctttgtgctatatttggttaatagttggagtcactcctaagctactttttcagttgctttgtacaggtgggtttgttttatgtaaaaagaaaagacactttaaaaagctgcgcataaatcagacatcataaatgcagtagaaagcctccctatttaaatgactcagcgaatcttctgatgaaacaactgcctcttcccctttaatgtatttattaatttttttttctttttttggagacagagtcttgttctgccacccaggctggaatgcaatggtgtaatccaagctcactgcagcctcaaattcctgggctcaagtgatcctcctgcctcagcctctcaagtagctgggactacaggcatgtgccaccatgcccagagaatttttcaattgtttgtagagatagggtctcaatttgttgcccagcctgaggcaaatttttagatatatattttatttaagtgagagctgtgacagcaatggcacaatactgcctctgtcctggcctgaggctctctttgccgctggtggccatcgtctttggagaagccgctcagcgtgtattgatggagtgacctccctgcctccctgtccagttgggctcaggtacccagctctttagcaccctccctctaccatcgtggggcctgcaggtcactgagggctgggagggctgggacccaggcccctgactggccccctgttgcagcgttggagagaccacctcagacaccaaggacggtcatgccatgggtcccggcagcagctgtcccttcctgaggagggcgtttgccagctgaccactccctggtgatttctgccctgatcttccctggaggtggcaggttggacgtgaggatgaggtcccacccaagtcacaactgtgtgactgtcttccaagtcaacaaacatcctcctggaaggctgagtggcgggaaggaaagacacctgccttctacgccatgctgggccctgcagcaggcactgtccatgtctcaaatctccctccccgggaaatctaggcacaggtcatactgctggaaggcttgtctgtctctcccagtctcagggccagagcttccaggagcaaagagtggtccgggcctttccttctctttctcccactctatcttatctctcctcctgctttctcccagaagacaagtatcagggatggaagaggtggccacgtgcagagcatgactaatcagcagctgagtggcacacacacaggggatctcgcctgaggcctgggccagcatggggaaggcccctgcaggctgctgggcacggggatggctcagggtcctgggctgggctgggctaggcttgggggagcccggtgtgttgggctggagctggcctctgctgtcgctggaccacagtcacccatggagggcaggggttgggaacctgcagggacagcatctgccctctggccggtggggggttcttagtagcagggcaaggggaaggcaaagggggccaggcccaggagcaggtggggcctcctcacaggagcagggcaggattcgaggagctctgggctcccacctccgagctggactctgagcatgctggctccttccttctttccagggcagcagcagccccacattcaggacagagccatctgtgtaagcagggctcagagaccctcagacagacagggaaaaggagcaaaatgtattgtcatcgtccagcctgaaatctccagtgggacccgtcagtggagcacgtagcagacaccctgtccctcccgtgccccccggcctgtaagggcagctgaggccgtcttacctgctgagggagaccccgcactccctgacttcccgggctgggtgctggcactggtgaagggtttcgggctgtgagcctcttgccttccactcagactgggccagacccgacagcaccatgaaccagagccgccctgagtaggggctgacactgccaggccagcctcatcctgctcccggccataccaggtcccacggggccaatggaccatttcagtggatgcagggagcacagagcatgagtcgcacctggtggacgggcaggtgtagcaggccctcatgagaggaacaccattgactttcccactgggtgaggaagggacagctctgtaccatttccctctgctcaaacccacaggagccagccagggcatggacactcccatgaggtcacctttgctggtctgttccttgcggggctgctgagttcttgatagaggtaacaagcaaccctggggctcccgtgtgcaggaggaaggttggggactgcctggttgtgcttcggacccagaggcagacagaggaggcctttgaacttggcctgagcttgttgggtgaagccaaggacagaggctggggtctgagtgaggggagatggtcccgtgaagtcagattggcacagattcccccatcagagttgggaggccccagaatgttcaggaacagcatgtggcaggggtcataactgaagccagacctgagttacaatccatttactcactgtgtgtccttggcaagtcctgcaagggaggcacactatcggacgtcccccgtggggctggcatgcagattgaataggatacatggctgcactcaccccagcgcctggtgtgcagcaggccctatgccagtgtcggctgacgtcactgtgctgtgggtgtcatcagagcctgcatgccacagtcagtgcagtggcacagggcctgcatgccacagttaaggagattgtaggcccttggggagacagtggcagaataagggagtcgttgccagacactggaccaaggccctcacagaacccaagggagggcaggggcatcccctgctcaccgatggggactgtcacccttagggaagttggggacctgcctgagctcacacagctgggaaacagtgaagcctggatttgccttctaactttttattttcaaaaatatgcaacatacactaaactagaaccgtttaatgacccctgcaccaccgtacccaatgcccagcttcaagaattctctcacaatatgtcattcttgtttcatctgtcttctgccccctctccgcctcttccccttcactcctgtctgcttcctttcactagagtgttttaaagcaaatccagacatcaaatttcatcagtaaatatctcacatgcatatgaaatgcagaatgtatctctaacaagtaaggacttttttttttttttcttgagacggagtctcagtctgtcgcccaggctggagtgcagtggcgcgatctcagctcactgtaacctcgtctcctgggttcaagccattctcctgcctcagcctcctgagtagctaggattacaggcacatgccaccatgcttggccaatttttgtatttttagtagagacggggtttcgccacgttggccaggatggtcttgatctcccaacctcgtgatccacccgcctcggcctcccaaagtgctggaattacagatgtgagccactatgcctggccataagtaaggacttttaataatataatacattaaacattcagcaaaattaataatttcattttaaaatagccttacaggccagacgtggtggttcagcctgtaatcccagcactttgagaagccaaggctagtgaatcacctgaggtcagaagtttgagaccagcctggccaacatggtgaaacccctctctactaaaaatacaaaaattaaccaggcataggggcgcacacctgtaatcgcagctactctggaggctgaggcaggagaattgcttgaatctgggaggcagaggttgtagtgagctgagactgtgccagcctgggtgacagagcgagactccatctcaaaaaataaaataaaataaaataaaataaaataaaatagccttatagaggaataaccaacttacaacaaagtgcacctatatgaagcatacaatttgagttgccttttttagagatggggtcttgctctgtcgcccaggctggagtgcattcgtgctgcagcgttgaactcctgggctcaagtgatcctcccacctcagcttccagagtagctgggactacaggcatgtgccactgcactggctaatgtttttatttttgtagagatgggggtctcaccatctggcccaatcttgtctcaaactcctgggttcaagcaatcctcctgccttggcctcccaaagtcccagagtgttgggattacaggcaagagccgctgtgccctgcctacaatttgagttttgatgtgtttctacagccaggaggcacgtactcaggttaagactgtgaacatatccattcccacctttgagatccccccagcccctcttgccctttctaacccaggctgctgctgatctgctttctgtcactggacattagtttgcattttcaggaattttatgaaaatggaatcatacagtatactctatgtttgtctggcttctttcactcagcatagttattttgtgggtgatggatgctcttgcatggactggtagttcctttttagtgctgagtagtattccattgtatccattcaccgtagtttgtttacttattcactggttgatggacatttggattgtctccaggttttgactattacaagtaaagctactgtaaacatccatgttcaagtctgcctggatagctgctttcatctttcttaagtaaatactaggagtggaatggctgggtcatgtggtggtaggtgtgtgcataacacttcaagagactgccaaactgggctggatgcagtggctcatgtctgtaatcccttgcgaggccgaggtgagtggatcacctgaggtcaggagttcaagaccagcctagccaacatgttgaaacccctatctctactaaaaatacaaaaattagccgggtgtcgtggcatgcacctgtaatcccagctacttgggaggctgaggcaggagaattgctagaacttgggagacggaggttgcagtgagccgagatcgcaccactgcactccagcctgggcaacagagcaagactctgtctcaaaaaaaaaaaaagagagacactgccgaactgccttcagaagtgattgtgccattttgcattctagcaaggagtgagcattctaattgctctgcttctctccaaccctctttacttttagccattttgtaagaattctttatgtattctagatacaatcctttatcagataaataatttacaaatatgttcacccattctgtgggttgtctttgtattttcatgatagaatcatttgaagtataaaagtctaaatatttgataaagccagtttatttttctttcattgcttgtgcttttggtgttgcatctgagaaaccattgctaaatccagggtcatgaagatttatacctatgttttcttctaagagttttatagttttagctcttacatttaggtctttgatccatttcgagttagtttttgtatatgatgtgaggctgagagtccaccttcattcttttgcatgtgaatatcctgttgtccttgtgctatttgttgaaaaggctattctttccacattcatttgttttggcagccttgttggaaatcacttgccatgtatgtggaagtttatttctgggctctgtatgctattccattggtctatgtctatccctatgtcagtgccacactgtcttgattactgttgcattgtggtaagtttgaaatcaggaagtgagtcctccaactttggttttttgtttttttgtgtttttttgagatggagcctcactctgtcacccaggctggagtgcgatagcacgatctcggctcactgcaacctctgcctcccgagttcaagcgattctcctgcctcagccttacgagtagctgggattacgtatgcccaccaccactcccagctaatttttgtattttcagtagagacaggtttcgccatgttggccaggctggtcttgaactcctggtctcaggtgatatgcctgccttggcctcccaaagtgctgggattataggcatgagccactgagcctggcctttttgttttttgttttttgtctttttttaaaaaaagattgttttggatattttgtgacccttaaatatccatatggatgttagaatcagcttgtcagttttacaaagaagccagctgagattctgattgtgactgcattgaatctctagatcagtttggagagtattgccatcttatccagtctgtaatccatgaacatgggatgtctgtccatttatttagatcttttgtttctttgaacaatgtttcattttcagagagtaagttttgtacttttgttatatttattcttaagtattttactcctttaattgctatagtaaatggaattgtttttttgattcctgctttcagactttttattgcaaatgtgtagaaatacaatcgtatcttgtggccttgctaaactcatttattagcttgaaatttttttagtggattccttaggatttttaatgtatgagattatgtcatctgtggatagagttagttttacatatttcttttcaatctgaatgcctttatttgattttcttgtccaattgccctggctaaaacctctagtacaaagttgaattgcagtggtaagagtgaacgtcctttcattgtcttgttgctgagtttagggggaaggcatccagtctttcaccattaagtatgatgttagctttgggtttttctgcccattgaaaaaaattgagttttttgttttcttattatcaagttctaagagttctgtatatatttttgatataagtccctcaagaagtatgtgctttgccaatattttctgccagtctatggctgatcctttcattctatcaagaatgtcttttgaagagaagaagctttaaaagtttggtgaatttcaagttatcacgttttcttttatgaatcatgcttttcatattgtgcctaagaaatcatcatataatccaagatcataaagattctctctagtctattttcttctaaaagttttagaagactttatatatttagattgatatatttatatatagatttaggtttatatttctatttatagtccatcttgaattcatttttatattttttctgagttatggattgaagttctttttttttttttttttttttttgcatatgatagccaattgttccagtggcatctgtggaaaggctgtcctttctccactgaattgccttagcactttgtcagacatctcaaaatctggttgtgttagttccactttgtccttttatttcagagttgtcttgagtattctaagttttttgtattttcatatccatctatttgtggtttccatctgatttttgacatagatgattattgttgtctgtgaataaagacaaatcctactgagacagactgagaccatgtctcataaaaaagaaaaaaaaaaccatttcagaataatgcgttagtgtcctagcaacctcagcatgtctgcctttagccagctggggacccttcaagtgtttcttagtgttcttctggcgtttccacctcgtctttcatagctttcagtctcaggttcaacatcttctgttcccagagtagactggaatcggccttttaaccaaggagctctggttatttttagtggaaaatgatatttggagaccacagtttgaatgctagggtgctcactgttccaggcctctctaggaaaaatgatttttttttttttttttttgagacggagtctcactctgtcgcccaggctggaatgcagtggcaccatctcggctcactgcaacctccgcctcctgggttcaagcaattctcctgcctcagcctcccgagtagctgggattgcaggcacctgccgttacgcccggccaattttttgtaatggaaaaatgaattttttagaaatagaaataaatcatgaattcataccaatatttccacttcaaaagtttttgttcaacctttcaatttcatttttgtaccacttttataggaagcttggatcctaaatacagtaacataattaatgtgtatatagtcaaaataataataatatctgtattattaaatattttatcaccaacaatagatttactcgatgcagtctagaatctttctggttcttttgtcctcaggctgtgcggcaggagggaggattagtcaaaatactgtatttcaaaatcacttgaaacttcttatctgtgtttttaccaggtttattgattgagtttttggatttctagtagttcctttgttctctctctttttttttggagacggagtctctctgtcacccaggctgaagtgcaatggtgccatctcagctcactgcaacctccgcctccggggttcaagggattctcccacctcagcttcccaagtagctgggattaaaggcacccgccatcatgcccggctaatttttgtattttcgtagagacggggtttcaccatgttggtcaagctggtcttgaactcctgacctcaggtgatccgcccgcctcggccacctaaagtgctgggattacaggtgtgagccactgtgcctgccctgttcttactcttaattatgcaaaacatttacatggttccatagtcaacaaaggacatttgtaaatgtctggcatgtctcctccctcacctgtaggtaataattttgatcagttttgggtttgtccttcccctgttgctttttgaaaatgtaagcaagtctgtgtgtgtatcttcccccagcccctcttcatgtccttatacaacaggatgggtgcaccttccgcacttgcttttttacttaatgaatatatcctggagcttacaccatagcaatagatagaaatcttcctcctttctacaaggagcccttctccagggtggggctgtagcgcagttcattcagcccctccccctgccagtggacactggggtgggttccatctttatacgatgctataggtagtgctggagctagaatttgaactcagagcccatgttcctattgctctttctcctgtgctctgtgggccgtcataatggaggaggcggggagcaaaacggagtgaagaggttgagcatgagcactgaggctgggggaggcgagtgtcccccgctgtgccatggcccctcgggtgtgaagctgggtcatgttgctttgctggggcctcgggtgcaggttgtctggaagtgggcagctggtgctgggacctgctctctggcactagtgtgctcactgcagggcgagagcttgggtgcaccttggacagggattgattcactggactagctggtggagtgggcaggtctgttgatctgttggagacaatgactgttggagcccttgagcaggctgtgtcacgtggaagggcagttgagccatgtgctgtgggacgctttggatgctgccctgagctgccactggtcctatgtcctggagaggccctggcccaggttcagcagcactggccagattggggcagatctgaaaggagccagggctgtgcacacctggcaggacaggtggaactgggtgttgggaagggcaggtgtgatccaggtcaccgggccggctgggcctagcgtgtgcagagcagagggggctgacacggtgcgacctcggagagccgcctgttcatatatgcacttgcttgctggcccagggcctgcctagctggcagtgactgggtcctgtgctgggctctgctgagctcccacaaacacaccccatccactatgagccctggtgagaagggagaggggtccaggccccgctgggatgcgcggtgtggacagcacttggcgtgcacatgaagcttatgtgacggtatcacagtgaccttgatctggggctggggaggaaatgcctcgatgggctgtcctcatgctgctgggcctgggccatcggggccggcctaggggatgcccagtagccttggcagcctcagccatccttgtcaactccagtgggactgggggatcctgaatcccgcctcctgatgccagtggagccctgagtttctgttcagaaggccaatggagggctgggctccaccgcctctgaggtccctgacctctcataggttctggggggccagggtgggatgagggagagacaggagtcatgggcagactccctgctgccccggggacgtctcactcagacatttgtatgtcacctacaggtaccctgggggccttagggcccctcctctcttcatggagcccagctagtggccccctcccttcctggctccctgcaaggcgagggaaagaggagaggagagaaggcctcggagcgctgatgtatccatcattccacacagacccgtgcttgttgagtgcctcctcgggtggtagccccacgtgggattcagcatagtgcaggcagaggtggacacagtgtgaactgttaggccacagccacatcttgccggagccgcaaggcaggagttcaggagtgagaaggcactggctgcggctcctggggctggaaagggggccagtcaggcaggcagaggggtgggtccagctgtagaagcgagatgggggcggttcgggaggcaaaagcaggaaggcagaaggaagcttggagctcatgagcccctctgtgctggcgcacggcccacgtcctctaaacaaaagggatgggctccttcagtggttccgtgggcccttggcaaagctcgtggaaacaccagctcctccccagcattcattaccaatgcgaagcactagccctttgcttggggcattctagacccccaggtgcctaggctgggagccctgggccaggtggtgggggggtcctggctgtggaatccagatgggacctaccactgcagctgggtattaggcagatttagccagggaaggacaaggtgagagaggaggagcttctgagagtccatcaagggctggccgcagaggggagaggcctggcagccggcgagcccagtgtggcacaggtctgtctgcctgtcctctccctggggacactgcttcacaacagactttcttcatcagctttgccggggcctgtcaggccaatagcttggacttagcctcttgactctcacccttttgcccattccaaaacaaaacaaacagcagcaccgccatgcgcccatgtgcctggtgtagtatcgttccaggcatttcatgggcaggaattcgcttaatccgcacagcagctctgtgacgcagtcgagagtattattagctccattttacagatcaggaaacaggcagagagaaaggaaataacctgcccaagctccaagctgcaagtagaggagccggtgtttgagcccagaacctggcgctgggagccacgagctgccctgctgggcactggggtggacacttgcccatcagtccttcagtgagtgcgaaggagccgtgtctcacttcaaagagggatttaaaaattctaccctcgccgggcacagtggctcactcctgtaatcccagcactttgagaggccgaggcgggcggatcacctgaggtcgggagtttgagaccagcctaaccaacatggagaaatcccgtctctactaaaaatacaaaattagccgggcatggtggcgcatgcgtgtaatcccagctactcgggaggctgaggcaggagaatcacctgaacccgggaggcggaggttgtggtgagccgagattgcgccgttgcactccaggctgggcaacaagagcgaaactccgtctaaaaacataaacaaaaataaaaaactcgactttctgcggcctcacttcaaggatgcgtaggaaatttgagagaccaataggaagtctctaggaaagggtcttgttcccagaagggggtcgtgcttcttgggcccttactgcatagctgggctggtgtaggccttgtggggtgggaggctgtgttcattgccaagatttgagaagccttggcttttatgtgaaaaacgctgagtgtttaattgttgatccaaatattttaaacatgctatgagtttgaccagaacacatcttgggctgccagttacaacctctgagtccaaggacaccaagaatagcaccctggaaagggcagggaagaagcatgggtcctggcgtggagacagaggccggagctgccacctcaggccagacgggcaccacgggcatgtgcatgggcagaggctgttcccatctgagtgggacccagaaggaaatcagacacagtccctgctctgagccacggatagggggagagacgggcgctctcacatgtcctgggccacatgccagggctaggagcctttcatccctcacctgctctacccctccttccacgctggccggggatcggggtggggggtactgtccgtcctgtttttcgtactttgcagctgactcagtttaggtagcgggcagctgagtgatttgcctatgaagtgctgtcggcttttggcgaatgtcaaggccaggatggtgtccctgggtctcgaccccattcctgttttcctcccactccacttgccttgggcctgtctcttctgccctagggtagaggctgtgggtgagatttgcaaaaaaagaaaaggagccggcatttggggaggagacctgtgtgttccagagctcagctgggaactccttgccagggtgtgggagaggctgggctactgaatggagcaaacacacacccagggcccggttgcattagggttccaggtcaacagcacagactgttttaggattaaaagcagtcccatgggacaggttgcaccaaaacattgtttgtttgtttgtttgttgtttgatacagagtttcgctctgtcacccaggctggagtgcagtggcacgatctcagctcactgcaacctctgcctcccgggttcaagcggttcccctgcctcagcctcctgagtagctgggactacaggtgcacaccactgtgcccagctaaatttttgtatttttaatagagatgaggtttcaccatgttggcctggctggtctcgaactcctgacctcatgatcctcccacctcggcctcccaaagtgctgggattacagacgtgagccactgtgcctggccaggttgttgtttatctgaagcttacatttacctggagggtcctggcagtgccggggagaggaaatttgagccagggtcacggagtgttgggcaaatgaatccccactctaggattctggaaatctagaagacaggcaaaaaccaggagcagtgagagcagagtgctgggccacgccgctgcctactaagggctcacatgcatggccctgggaggcgactgcgtccggcacccgctcattgttggatgaaacgagcagctgggctcccagtgaggacacggtggtgctgccaggcagggaaggaagttctgggagtcctgctggctgctggtttatcgattgcctcggaataacagccccatcgaataccagttcgctgggaggcaaggcgtggtttcctctttttctttcccacatgggttagtcttgcttgatgcttttctgttgtcgttagattgttctgaaagctcatttagcatcagctctttccgaggctaagggacaggtgtggcctgggtctgttgggggaggggggctgtatgggaggctgaggatggcagagagaacccttgaaggaaaggtttttgttgtttttgtttttgttttttgagatggagtcttgctctgttgccaggctggagtgcagtggcgcgatctcggctcactgcaacctccgcctcctaggttcaagcaattcttctgcctcagcctcccgagtagctgaactacagatgcacaccaccactcccagctaatttttgtatttttaatagagacagggtttcaccgtgttagccaggatggtctggatctcttgacctcatgatccacctgcctcggcctcccaaagtgctgggattacaggcgtgagccaccacgcccagctggaaaggtatttctttatcattagggaaatgcagaccaaagccacctgacacccactaggatggctacagaattttttttcttttctttgtttttgagacagggtcttgctctgtcttcaggctggggtacagtggtgtgccatcttggcttactgcatcctcaaccttctaggctcaggcaatcttctggctaacttaattttttttattattttttttttttttggagagacagggtctcactatgtctcccaggctggtcttgagctcctaagctcaagcaattctctcacctcagcctcccgaagtgctgggattagaggtgtaagccaccatgcccagtgtcccccacccctgaaggctataatttttgaaaagggaaaataactggtgttggggaggatgtggagaaactagaatcttcatgcattgctggtggggctggaaaatggggcagccactgtggcaaacagtttcacagctcttcaataaatagatttaccatgtgacccagcaattccactcctaggtgtatacctgagagcactgaaaacacacatccacaaaacacttgggcacgattgttcctagcaagcgcccgtatgttgcttggctttggccttggtcaccgtggacagtgctgctaacgcaacctaagtgtccatcagctgctgaaccggtggacaaaatctttatatactggagtcgtattcagccgtaagagggaatgaagtgcatttacgcactgtggcacagacgaaccttgagaacgttacataaagtcaaagcagccagacacaaaagaccatgtagtgtgtgattcagtttatatgaaacgtccagaataggtgaatccatagcaacggaaagcgatgagtggttgccaggggccggcagatgggggatggggaggacggggtttctacttggggtgatgaaatgttctggacttagaccgtggtgatggttgcatagctaaaaactactttgaattttatctcagaattggaacaaaacaaaacaaagcaggctgtggtcctgggcccccgcggtgctctctgcagactgctcctcttctgcccccaccccaccccacacattcccagcaaggtcaccgcagccccctcctcacccctgcagcgcttattccttccgccttttgagcttcccacagagtcagcagcggccacctgctgagacctggactagggcctgcttaccttctgggagaattggctgcagtgccaacagctggttgaggggaaggcccgggagctacctccttcacttctccttcctgtaaactttggcataccctgccccccgccatctgctgccccctagcctgccactgccaaggagctctgaggacaggggccagaggactcactagggagccaccttctgggagtcagtggccttgaggaaatcatcgctaatcactctcctgccgcaactgctgggaaaggcaggtccacttgggaagtggagcaggcagcagtcatcgctggggctggggtggaggtaggtggctgggagcaggcctctgaggctcttcctgtgcacacacaggcgcctactctgggcccacagacaacttgctcacatacctagagcccagcccctgaccccaggctgcatgcttgtctttttgcatcctccttgccccctcccctcctctccgttccttcctcagtgtgctgggccaggcccgggcgataaccagctcaggactgtggaaacagcaggcaggcaggaagagctcccttctctccaccgttggtggccagatgttgagattccagatgtgattagtttgaaaaaaaacaaagtaaaaggattctgaggctaaaagtcactgtttgaaagtctgtgccttgagaagagcacttgggcagagggaggagggtgaggggttttctttgctttgctttgcgcctgtgatggacactttgtgaggcccccagcggaaatttgggcctgtgctctgaaggccgcgtgctcctgcagccttgggctcctctggcagttctgctggggcccttttagagtctgtgggatgcactcagcagctcccaggtagggcctgaggtcagaccccatgtgtctccccagggacagatcttctccgccagacgtctctttctgcctcttggtgggttcatggctgtgtctggttgaagagttgtttccagaaggaccttgttgtccgtccagatgaactgagcaagtgtgaaaatccctgtggaacttgctctagggcagataatgtgcagctggggtgcatgtggttgttgctcccgtgtaattcttcttctttggaaatgggggctttggagcctgggaagcagagagaggcatgtgctccccacccccaccctggagtctccccaggaaatatctcgttcttgttctctgctcacggtttaggttgcacgatgggaacacaagacccgcaagctgagcagggccttcggatccccctacctggcctgctactctctaagcgtcaccatcctgctcctgaacttcctgcgctcgcactggtaagcacagctctctcactggggagccacaacccctgggctagcgggagggccgctactggtggtacctcatccctcaccacgcgggagccttgtgtctgagcactcaggggttagctctcaaagccacctgccacagcaagccaccctacccctcccagccgtttagactctggccagcagaggagccccagtgacctcaggaatgggggtatgtgaatggggggcaagggacaatgcctgggtggtccccaggtcacatcccagcctctgccacgtagccaaggctgttttaggagtctcctccaggaagcgtccagtcagaaggtggatgctggctcgggagccctcaggggtcaggcctgaccatctctccaggttaggtttgaatcagcgtcagaaagcttctttgaggccgggcgtggtggctcacacctgtaatcctagcactttgggaggccgaggcgggtggatcacctgaggttaggagttcgagaccaccctggccaacatgatgaaactccgtctctactaaaaatacaaaaattagccgggcatggtggtgcatgcgcctgtaatcccagctactcgggaggctgaggcaggagaattgcttgaacccaggaggcggaggttgcagtgagccgaggttgcaccagtgcactccagcctggggcaacagagcgagactccgtctcacatttttttttttttaaaaagaaagcttctttgcccatctctggacttgggacaggcaccttcctgctgtcaaatgaaaaggtcagagaagaagaactggaactagatgatgaggcacagcccactgcacttgggagcgaatttctctgcccagacaccaggctagacaaggcccacctgcgtggaatgtgatggctgcaggcgacctggggatgcaggctgtgcagggcagctgccccatctctgggccccggtctcacctcccacagtaccctgagaatcattgcgcacggcagctcatggactaaacatggaccacgtggttctccaaaaaatgagaaactagctgcaccagagaatccccatttttgacttgtcgagacagaccagaagttgtgtgtgtgcctggccacaccccacgtggagcgctcactggggccgaggcacagctgccccctttggatggggcgcgtgtagcctggctctccccattgcccgtggccccatctccgtcggaccagcctggcttgcaggcactgggtgcacacaggaaggggcctgtgaatgctccatgccagcacgtgcggagccggggcaggccttgctggtggtcaggcccctcacacactcaccgagggtggcctaggccttccccctccgtggccaggcacccttgctgccttctcgtcattgtcatggccttggccacaggaatgtgggtgagcagcgtggtcagggtcctactgaggtcagccttccgcactggacccctggctcctggcctttgcttcttggccctttgggccagggctgcctgctttctctaggcctgggtggctatcccacggtcttggtcctcagaggggtgggtcccctggcacctgccctgggttgaatgatgtgaagaggcttccccagagagggcttttcacccctcggagggcaaggggtttggcccatggcaccgcctcggggcctgtgcgtctgcacagcctgcatgcttacaatcttctaggctctccggccccagggagcattttcacatttatagtctctgggtagagaagactctgactgtgcagatggaggaagtgaggcttggaaagaagcaatggttgcccgaggttttacagctcatgaagcgctgaccagcattggagaacaggcagcttccagctcagcagtggcttagggagaaaagattccatccatttaggccagaggaacctggcaggcaccggcaccacccaggctgggttatgggagcatcaggggacgggagatgggcctctttcctacccatgctgcctcttgggccaccggcagagtgtccctccttacccaggatggggccctggctgcattggcaggacagtcaggggtctgtgccctccagcccccaggcatccacactccccagcggccaggagggagggggctggtgctggccgactgaacgctcagagcttggagtccccccacaggaacagcgaggctgaagacaggtggagggctgcagagggttgagactcagcccagggctggcacgctgagctgttccaccactcctgctccctagagcatgccgggaccaccatcagggccggcacaaagcaggagaagtgggctgcagcccacagcgcacacagatccaggagcagctagaccaggccaggtgactgcccagaaacaccggccagcgccacaaggcagctgccttgatggagcccctcctgccagccctgccccgggagctgctctgagtctctgctgagttctgatttcctgcgcaatctcatcttgcactagaaaccccagaggcttccttgagtcctccccatcacctccctgctggtccagcagcacagcctgtgatctgcctgaccctggaggtctgcccccgtcatccaccccttttcaaggcagagagtagagggccctggaaggggtcatccttcctcctccaggccccagccgagtgctgtgtgtacctaggagaccagggggacaggcccacccacagcccagttccagccgtagacagcagcaaagcactgtctggtttgttcttggatcccggggcctgggagtcctcctggggtagctggaggaagtcagcttcttaccgatggtggctcccagctttccctcctctcatatcagcgttggcctcacctggcatctgcccagccagcagggccatgacttttggttgaactggccacccctggattttggggaggagagaaaggatgtcctgggctgcttttctcctctcaccttttgtgttcagaggcagaggtgtgccctggtcctcactctctcccccactgttcttcccctccaggcccctgcctgcaccctatcctgccatgtccctggtgacccatccttcccgcccacacctgccagtgtgaggcacacaggtggcaggtgctggagccggaccgggctgttgggccaggctctgacaggaccctcgggaccagctcctgcataccccacacccccacaccctttcccatgcatgcctcgcttcagtggctgtctagaggtgggtattcttttttgtgcagtaaaatagacataacataaactgttatgaaccattttaagctttacaattcagtgacatttagcagcttcccgatgttgtgcagcccttcctcctgactagtttcggagctttttcctcaccctataggcctggagcagtcatctcccgccccccagtccctggcagcactcgtctgctttctgtccccatgagtgtgcctgttctggacctttggggtgtggcatcgttctccatgggagatggcaagctttgtggggtccaggctgtgctcaaaagcctctgcacccagcaggagtcggttggtgggcagagaacacaggcacgtgcttgagccaagcctgggtcatggatgggatgtccgagaggccaccagcagctgacctgccagcgggtcccaggggagagtaggtcactatgttagcaggtctgcaccagcagtgcatccagaggtggtcaggggaggcccggggcaggatgagccactgttatctggaagcaggtgtgctccatccagtcccgaaggggccattagcacagacctgtttgctctggctgtggagtgtgaatggggaggaaggctgatgggctccggggcacttgttgaagtcccttgcctgagctgccccctgcacagctgaacttggccagctttggctggaccgctaccctctgatgagccacaaggctggtctcgagaaagcccacgggggtgggcgaggcgtggatggccaggcagggctcgaatgggcttcacaggactgggctgcagcccttcctccctcctggctgtgggaggagacagccgagcttgttagggcatcagcgagctcctggtgtcgttcaccagtcacgggatggaactgtgctccagcgcacatcggaattgcctggagtctcccagggctccctctgggtcttctgaggggagaggctcctgtgtgctctggtgtggcgggcacagccaggctaagaagctgcatcctggcctcggagtgtggctgtcgatcaggaatcttcctcaacctggaggtattcccaggctgggctaggaggcacctggaggggcagggtggtctctggaaggtggtctgggtgggtggggtgcaggcggagccctggctgaagaagcgttacgaccaaggcctggaggagtgagccggctcttcagatggctgggcagggcccatgagtcccaggagagggcggcccccactcacaggctgggcagcaggggcagggcaggtggggactcacctcagcgctctgtatactagaggccgtggggcaggtgcaaccctgtgggacaccagactcaccccagagcccctctcccctagggaagtctgttttcaaaaactccctgatgattctgaggccaggcctttggggactgtggccctggaggaggctggcacaggtggccctctgtcctggtgactacatgtcctggtcactgctgcatcccacccagtgcctggccggacctgctcaaggatgtggtcaggacaggccgggggttgagcagctgcatgaaggagggagggcatggagctgatgggacagtttgcttccgatggagcaatggagggctgggcgtgtgcagcgttccatggcagaaaaaagcgactcctgctgtcttggcagaacaggccagaatttttaaagagtctgtggactgggaagccaagtgtattagtttccttctgctgtgtaacaaattcccacacacttagggcttaaaccacacaaacttactatgtgacagtttctgtgtccaggaggctggatgcgggggcggggtctttgcttagggactccccaggctggaatcaaggtgcctgctgggtgtgagctcacccaaggcgtggtcctccactctttcgggttgctggcaggacgcgggtccttgaggcccagctcctggtggcctccccgcagcacagcaggcagctctgtggctttggcttttggtctctctggcttctagacccttttggaaaggcctacccagggtcacctcccttttgattaactcaaggccagctgattaggacctgaattctatttgtgaaatcccttcaccagagtgatttcctcgcggcaggtgcctggggtagccactgggcggggtccatgagggcagctggagagtaaggggtgggggggcacttaggacagggaagctggcataggctttcctgggcacaagggcccccagctgctgggaaggaaggagggagaggggctgcagttcggcaagagtgggtccaggccctggtagaccaggctggtctggcacctgaggggctgtggctgggaaggagggaagaggcaccctccccatccccaaagcacacacggccaggaagtctggaaggagagtgggtgtcagcctgggattcccaggtgctaggggtgctgggatactgctgcctgttgtccttggcctgcccgtgaggcttgagcctatcccactgtttacaggtcgtgaggaggcaggagagccatcctgcccctcctgctttctaccatctgcttccctgtttgtaaaacaagacagactctctctcagctattgatgggttctggaaacactttggaaaggtgacgtgttattcaaatgctcagaattagtgcagcgtcaaagcccgaaattcaagccctttgatggtctcgggggttgcatagatgaacattttttgttttagtagttacatgcttattttaatatgtcttggaaaagaaatgagcccatcagacgactcatttcatggctagcgtcgtgtagctgagatggagtggaaagagcgagtcactccaagcctggggtgaaggatgtggagtacatggcactcaggccacacatggatgtggacgacgttgcggagacaccccaggatgatcaaagtcagggaagtgtttctggtcggctgcagatagaaacgggacaggcctgtcccaggtggggccgtgtgcctgtggcctggtgtgtggcccaggactgctggctggggacagggcggggacactgagggcagtgatgccccctccccacctccaccccagggtttccgggattttatgggagcagagtgcagacagcctcaaatcacattaatgactgaaggttcaatccaggtcttaaaaatagaacccaaggcaaatgaatgagtctccgttccccacccctagtgcggaatacttccaagggaaattgcgtcctatattacctcattctgttagggagcttgtggtcacagagctactcatccatccactaattttccctgtggaatggacggactgtgctttcctggcttaatggaggagctagaacactgtcgattgcctaattcgggccatgagattccagtaaacctggaatctagaatcagagtgtatttgactgggtaaggggccacttggtgagaacgccagggaggagctcagcccagttcctctgccgactctgagcaaatgacccacagagcattgtgccaggagccagcccaggctgtcatctcagagaaaggaaaggaaaggccccaggactggggccgtaggcggaggagcagctgggggactgagggtcaggtctggggcaaatctggggcctctcccacccgctccctggccccggatctgcccttcatcaggaatctgcttccaagcagatctgatttgcctactgagccatgcccccagggaagctgggccctgaacgagctgggcttttgggccacaccagagggaggaagttccctttcatctgctgcctgcttgtgtgatgcagatgaattctggcagaggaaccctgagcatggggtatggacccaggcctggctcgggtctccgcaggagggggtaagagcgacagagtctccgtccagagtgaccctccagcgtctcgggcctggcctctgcgcccaccccctattgcagcacctggatgggtctccctggttctgcattttccacagcaggcagagtgcattccaaaccctgccgggccgaggcctgcaccttccctgctccatgccctgccccagactctaaggcacacctccctgctatttcctctttctggaatgctctcccctgttcgcccctcccaacccctgtctgttttctggtccccactgcagtggcagccaaggagccagatgcttgcaggggagccatgctcctgagcagggccggcacccttcctttccctcccactccaccatctgcaggcaggagagtggagggtgccaggcaggggagaaggtgtgcctggatcgtggcaccacactgggtgtgcatgtggccacctgattccatggcagcccgtgaccctgagccaatcccagaggctcggcctggagctgcggggtgaccctgagcccgggcagcagcaggatcagggcagggcactggtgggtggagagctgggggtatgggcagcatgaccggcagtgggtttgccctgacacccgaatgccgctgtttaacaggtcggtgtgcccgcctctgccaccgggtcctggtggctttgtccacaggcccttctccctttctccctggctccttctctgctcttggggatgggaggagaaggaaggagcggctactgcttctctccagtcgatgaatatgcactaaacatccattctgtggcctgggccaagtgctggggggatacgcagggaaggaggagcaacttctgttccccaagagctcccagtcaagctggaggaaggagttccagggaggcataaagacatgtctgtatgtccttagctcagcataaggagtttcacaacaatctgaattcaccaatgaatggaacgagtggatgaagatgggggcttcaatctgcttgaaagagcctagcaaacaaagatacttcatggtggatggatggatggttgtgtgggcagatagaggatacattgatggatggaaggatggatagctggacagatggatggatgtgtgggtgcatagaggatagatggatggaggaaggatgggtggtggggtggatggtaagctggccctgctgggagatgccgtctacagactgggtgtgaaaggcgctgccctgcgtgaggtagcagatctccatgtctcttctgtgttgtgattattgtgagcatgggaagtgcacatttggtcacacatgtccgtgctcccacacacagcctttcctgtgagtgtgcctctcatctagcacccagggcccccttcccaccagcgcccgctcccctgtgatgaggcctgggtacatcagcacatgcctagcccctgtgccctccctgcaccagcccctcagttctccggagccaactggagaacctgagcctctagacccactgctgtcatagtcacccccttttggtcacgccactgccttttctttttttcttttttcttttgatactaagtctcgctctattgcccaggctggagtgcagtggtgtgcaaactccgcctcctgggttcaagcgattcttgtgccccagcctctcaagtagctgggattccaggtgcccaccaccacacccagctaatttttgtattttgggtagagacagggtttcaccatgttggccaggctggtcttgaactcctgacctcaggtgacccgcccacctcggcctcccaaagtgctgggattgcaggcgtgagccaccacacctggaccccactacctttttacaaggccttcagtggtttggccccaaagggagcctagtgggggaattcaggtgtggaggaggacattaagggcccccaaagtgcctttaaatgcaagtcaagccacccaggatgtggccagacccacaggggctgtggaagcgcaatccctagcacagagcatgccccaggcctcggggcactgagtctgttggggaatgggacacctgggcctgccctgcaacctggcacctgcgtctttcctgagcctcactttcctccatagtatgagttgctcattggacaggatgagagtttgcaagctggtggccttcgggctgaatccagcctgctcacatgcagggtctaaagtggctttcatgaattgtctatttctaaaaattaggatatttcacatacgagtcaggatttctggcttctcttgaaaaaatttaaaaatctgacaggcctgggcccctccctgttactgtcacccacctcccaggtggactggaccccacctgctgcctgcctggcctggcagccctgggctggctactctctaagggtccctggggagagggcgagaagatgaggtcggcctcctcccgggctgtgacatcctccctggccatgacgtcctccctctccatcccctgcccacagcttcacgcaggccatgctgagccagcccaggatggagagcctggacacccccgcggcctacagcctgggcctcgcgctcctgggactgggcgtcgtgctcgtgctctccagcttctttgcactggggttcgctggaactttcctaggtaagaccctgagggctggggtgaccctgagcaggaccgctggagccccagggaggtgcagggccaggtggctgctgccctgctatccgtgacatcggtgggagtgctaggggccccctccatcggggcgtctttgctcctccaggcctggcttgtctgtggttagaacaggaggctgggctccaacagctcctcttaccccagcgtgctgagcggctgcctcctggggagtgaaggcagctcctgctgcttctctccagctaatgaagatgcactcaatgcccgttctgcggcccgggctgggtgcaggactccttgagtccagctccagcaccagctcccccttgcagaagactctcaggccttgttgcacagaagcctgaggtggtggtgagtcagccacctctctggcagctcccggcacgcgtggctctcaggccaggcaggattgtggtttgtgccgtgtttggccgcaggcagggctggtgtaggtctggggaggggtgaggggtggaggcaccttatcccttctccatttccctctgcctgtggctgaggtgctttcaggctgtgagcccagtgctggcctggctagacgcccaccaatgaccctgatgatggcagcaacttccagctccttggaatctgggaaagaaaagcagccatgggaaaggcagtaggggtcggggtgggaggggagatgggggcaggggtgggggacaagagggggccttcggaacctggaaggagagaaggaggcagtccctgtccaaggggagcccctcccagtgagcagggagttggtccagctggccgcattgcccgctctccgtcatgggtgggaaggcccacgtcttcctccccatcagccctggccagtgcaggagcttggaagtcactcggcttcagtggcctcagtagcctcctgggaccaacggtgtcctgaggagctcccgggcctgcctgccatccccatcctcagatgccggctacagctccttgggcccagcccccagggcaccgtgggctgtcacagggcactccaagttctcaaggagcttgtgcctgccagtaggggtccccccgagggaggaagtggcatctgtgggtgcagcattctggatcgcccatggccaggcctctctgggactgtggggggcacccacaggcagttcagtgcttcctgctcaggcagacgctgtagggagtttggtccaggaagggggacggcagccaggagcgtctggatctgccaggtgggggcaggtgcgggcaggtaggaaagagaaaaaagccttggtgcaaggagagggaggttgagggcagagtagctggcagctggaggtggggggcagctggactggccgcacaggtgctgtcggttgggacagggcaggaggatgagccgaggccttgaaggccatccaaggggctgaggctccatccccagagaggtgggagccatagggggggtcccagcaaggaagaggttggaccgatggagccaggatcagaggtggggctcaggaggagctgtggaggggcccttccaggatgtgagggcggtgagggccccatgggaagggggactccgggctgtgcaatcaggtcctgtgggagaccagcggcgggggccctccagtggccagtgctcgggtggatctggacagggagggctgcagaggcagcgtaaggagagccaggatggtgggtggagcccctcagcagtggaagaacaagctgggggtcctggacagtcagagggagggaaggagcctgcaaacaccagtggccacagcctcctggcggccctgccagcagacatggcctagaaacaccgaggaccagcagcgcggtatgtaggcaaaggtggtcacttcctgctgtgactcagctcgaattgggtttctgtgccatctacgcacaccctgtgccccacttcctgcttcctgggaagaaagaactttccagtggtcctgggccctgccccgtgtccccagatggtgatgaagctcctggacccctcctgcccatgctgcccattgtcgggcagctgccctactttccgccttggatgaagctccattgtcctctgggaggagagacaaatgaggggtttctggggacagaaggctgggaggaacgaagccacaccctttatggagcggttactctgtgtccagtgggactgtcctctgtgggcctgggacagacactgtgactgtgaccccggccactcccttatggctcagagcagctctgccgggggacgccttgtggctgtgcggctgacgggtgcatggctggcctgtctggaacaggctgttcaatagtcaccctctctccactgggtctagctcctctgggcagctgagtgagaaaacaataccagagctgacctcccagagcaacgggaggcgtgctgtggccaggccctggtgccagagccacacagcctggggtgtggagcagagcagcccttagcaaccagctgaggcccctagagggagaggaactcaccagagcgaggaagagtgggaggtaggacaggaagaggaagggtctgcataaagaggcgccatgagcagagggcgaagggcctgaggaggaaaggcgctctctgtacagagagcagggaaaggcatcgcaggggagggaacagcgtgtgcagagccaggaagaagaggaaggccagcatggctgggtcagagtgctcgagaagaggagcagtggggcaggggcggtgctcagcaccttagtccttaggccccacgccctctgctgtctgcgtgcctgttgggtccctctgactctgcccattgttgaactctctgaagtctcctggagggcagggccctgtctcacctgcaggtctcgccacagcccgctctggggcctccctcagtgatggtgtggccagggctgatgaatagccgagggaccctgccttgcctcatccacaggtgattacttcgggatcctcaaggaggcgagagtgaccgtgttccccttcaacatcctggacaaccccatgtactggggaagcacagccaactacctgggctgggccatcatgtgagtaccaggcttgccacccctctgccctgctggccacctcccggagaggagctggtgcagctcaggacgcgggggccagggcccctggagagagagaaaggaagaacgtgtcatttgtgggggcctaggcgccctggttctccctttctcagaagcgtcttatctatggtaacagaaacaacatcccagaacagggtggtcagcttctccaaagagggctggagtgtggaggctcaaaggctgcaggcaggtcacagctgctcagccctggtcctgccacacaaaacagctgcagacgcaggaaaatggatgcgcgtctttggcgccagcacagctccacttacagacactgaagcctaaatttcagattcttttcacgtgtcatgaaacattctttttgatccttttgcttttaaccgtttaaaaatgtaacaggcgttcttggcccctaggccgtagtttgcggacccttgtgcggggacatcagggctgggaccacccgacccatcttccccgcaggaggggttggccagagccgccagggcccagctcacccgcagctgacagaactccctgtgccccaatagcctctgcccatgtggcagataccccttcccacagagggggccccgtgccatgagggaagcctagaactgctgtcggcctcagccaggtacgggtactgacaaggtatggagatgtgctcccccggggggtcagaggacctgcggtcaaggatggcacagcgggcgctgccctcggcttcatacccagcccccaccccagcagttctagtttagccattttcttccatagaaggttttttggcagacagtgttccactgcttttgtttaacacttgaaaaccactggcctagaatttacaggttctccacaagacctgaggatcccaaaggagtgaatcgtaaacagtgaatgtcaagcgcaagatgttgcctcctggctcccaccttcagcagttgggaccgtagcagcgggggttggagacagcagaagctagaaggggggctgtgggtctggctgggacccaccctacccccaccccacgtccaggccaggcagtccccagggacacgtcctacctgccttctagcctggtccctctgcctgctaaggcccagactatgtgcccccaggctcaccggccatggagcacccccactggggccacaggatgagcccaaactcaaaacaatcccccccacccaggtcgtccctgcaggcttagggttcccaacacacctggctcccccctctcctctgtgtgcacaaacacatgcatgtatgcactcacacactgttccctcgcctagaaccctcccacttatgccccttgtcagtccttccaaacccaacgtcaagtgttccctcctgcacgaatccctccctaaccccccaaccttcggtgcctccccagtggcttagtgtccccagcagtgtcttgtgccctggagtgagagtcacccttgggctcggggcagccaggccagggctctgggggacgcataagccacctccagaggacatcagccatgcagcgtgctgagagatggcatcaatggtccaggagctcattagagatgagccattatctggccagacgctgacacagcggggacccccacaggcctcccacggcccatctgtctctcacctgccagggccccggagatgggccttccaggtgtctgagctccccggcatgtaggaccccagcaggctgtgtggcagtgagcccgatgccaggggacagatggcagaggtggtggcctggctgtgagggacaggtgggcctcctgcttcgtgttgtgcaatcagggactcctgtccccctcggcgcccacagtggggtcgctgctggttgccaggcctggggttggagcctgggcttggatctttgcttacgtctgccctgcctcctgcagctcccagacaggcagaccagtgtgaggtccaggggtggaaggcagtgggcagggcagagggtccccacggggtccacaggtgtcctccagccctcacctcgatccagccctgcctgaggttcttgtgatggtttggctggggagggggcagcttggcacaggggcagccaaggagggcacagcccctggcccaggcctgcccatgcgccctctgtgcccgccagacagctcctttcctccctctccttcctctcttcctccctccctccctcctccctggcagcagcccagcacctgcgggagctgtgggatcagaggtaactatagaaatagattgggggacagcttgacggcagctatttctggaaacccaaagcagctgcgcccgggctccttggtgccgtcactgacgagctgccgctgcttactggtgtggcggggtcaggagctggtcaccagcaaagagcccctggcgatgctccatccggccttgggcctgctgtatgctctgcctggggcctcccgtcctctgggctggggtgaccgggggctcctgggcgtggggctgctgtcccaccacctgggagagcccaagctgggctaggtgttgagggctgggcggggcggcagctcctaagcccccttccccacagccagatcctcccagggcgtggccatggggttgcacctgtggccaggggctggggactcagggtggaccaaactggctttgggggaccctggacccatttctagaaaacagcctttgttcctcagagcatggtttctgggagacgggagcactttgccccagaatctcctcctgtgcgggaatgaacagccctagccactgggactcttccgcctggggctgcgttcccagctctgggctggcggctggagacccggaaagagtgagcaggccccaccctgagggaacccagccaggccagacaggcagacaatgatgataaatggatcaggaccgagaacatggggaccctggtcctggcacaaaagccagactcaggaaggggcagtgctgcctgggctcggtcggcccaagtggcccagcgtcggccggagggcctgggtcacggcaggaagggccagcctgggcaggtgggccgtggccctgagagaccctggctccagccaggcctgacctgcctctgtcctttcaggcacgccagccccacgggcctgctcctgacggtgctggtggccctcacctacataatggctctcctatacgaagagtgagtaggggctgcggcgggtgggggcgtggctgcccgactggccctgtctctccctctagaacctttccttgtggccagggcaggctcaggacaggctgccgtcagccaggcccactccagggctcccaggtcagagtggccatggtagcttacaatgcggcctgcaggacccagcaggcagccggcccctctcccctcccctctcccgcctgcgctctgaaggctccaagtcagtgttgccccagtggctctgggggatgaaggggatcccggtcccatctggacaccctcaagctgatggacgcagagctctggtgcgggcagtgggtcacccccaggacctgctgaccgaagcctctccccgctgcccggcaggcccttcaccgctgagatctaccggcagaaagcctccgggtcccacaagaggagctgattgagctgcaacagctttgctgaaggcctggccagcctcctggcctgccccaagtggcaggccctgcgcagggcgagaatggtgcctgctgctcagggctcgcccccggcgtgggctgccccagtgccttggaacctgctgccttggggaccctggacgtgccgacatatggccattgagctccaacccacacattcccattcaccaataaaggcaccctgaccccaacatctgctccagcctctgtctgtctgtgtggggaaggagcaggcctggggcacgaatatcaggtcaaatagctcccgagcaaggctggctccagcctttctgtcttgaaatctcagagctgaggggtgggcacctctctccaggcctcccagtaaggtacttaggaggcgtcaggggttcacctggccatggccatggtttcatctccaggagacttggtgtcttgtgtcacctgctcccacccctgccccagcacacccaagacagcccctctgctgcctcttcccttggaggatccagccccgtgtccgtcagcatgagggtggagaggtgtgggcatgttgtccttggccaccccagtctagctgggcagatgacactgtcattcctaaatgaatggccttgtgctgaccagcagctggacacatgctgggcaccctatgtgtctgtatgggggtgaggggtgggccctgcaagggtaagcctcatctgggggaggcagggcacagtgaccaggagtgtaggctcagccattgccactgggactcctgaggtggacagaggggacaccctccccctctcctcctggcatccatgccgccacttcctgttttcatcccagttctgctgctggtggcagggtcacccctcagcccccaggactccaggccccctgactggggcaggtcgaggacttctatgcttggtgggctttggggtgattctccccggggtgctagaggccctcagcccttcagctttggtcaacattatccctcagggtctctctgtgagccccgaaggccagtcaggggctcccggaggccgtgtggggattagggttctgcggggagaggcctccacctgttccagcccctctcctcttccacctgtgacctcaggcagatcaccgccctcctccagctccaggggtcctcagtcaagctcagagacagtggccgagggccggctttcccttgacctcccgttactttcgctcagggctgcaaagccacggcctgaatggatatttacaaagcgccctcaatccaggatcttcgtgctcacaccgccaagatggggtcccgggccgcattcctgagccttccaggcaagcctggccctctccttggagggctggaggcgggtgcaaggagactcaccccccagcacaggagtccccaggccagagctgtcagaagccacagggcttccgaggagtgaacctgaccctttcatcacacggcctcttgtcccacttccttggcccccagggcacatggtggaggcagggctgccagccctgaactcctcttgccccagccccagccccagccccctcgcccctggacctgggcaggttccccaacttcccactctgcatatggaggtagagtggatgatggtgccagggttgctgggcaaggctgaccctcacctgtgtcttcgctatcccaggtgcccagttgaccgggccccacagcccaggcaggtggccttcagggtctgggccacagagcctctccatccctcagctgtgctggctccttctctctctgggcctccttccctgtctccccagccaggatgctcggcctgggatccgggccatgggtgggaggtgccagaaagtctcagcctgagcactgctcatgttcctaggcagttccctgctccccacctccgctccccatcagtcccagcccccactggggggctttatttttaggtaccacttactcagcacccagctgtgtgtgcagccggaggaagcctggttccctggcaaccggcctggctcagtccagtgggcccctcccctcagggctcccacctcctgcccactccccactcacccctgcgcttcaccctcacaccaccccccctgccaaatgcaaatggggtcaggacaccccctcaaccccctgttgtcctcagaaggaagtcttggcccattaaccctggggcccaggacttattctctccccagagcctgtcc

SEQ ID NO: 12660 - DNA, 15027 bp, Human
ctaagtttgagtttctcattatttactaaatcgaatatgcaccaaaaggatagactcctcactttcactcagtttgaggcaggtgactgattccctaaaacatatattccttgctagacaaacctggcctgggttaaaaataaataaataaaaactcaaggtttaagacccttgcaggccgggcagggtggctcacgcctgtaatcccagtactttgggaggccaaggcgggcggatcacctgaggtcgggagttcgagaccagcctgactaacatggagaaaccccgtctttactaaaaaaaaaaaaaaaaaaatacaaaaaattagccgggtgtgctggctcatgcctgtaatcccagctactcgggaggctgagggaggagaatcgcttgaacccgggaggcggaggttgcggtgagccaagatcgcgccattgcactccagcctgggcaacaagagtgaactccgtctcaaaaaaaaaaaaacaacaaaaaacccctgccaacatttatttagactctatgacaagcacgctgacaagatgccatcatgtttccagtaaaataaattcaacaatgaaccgaaagatgaatatattctcttgaatcaaaggtccatataaataggtgggggaggggaggaatgcccttccactcttaaaaattattcttcctaaaaatcacaaagtttggtacgactctcaaatagacgatgaaattaggaaatttccaacactgcatttctaacttaaaatattttttctaaagtaaaaaagtacatgttcgttgtgtgtgtcagaagaagaaataggaactacaaataaaagaaacatgtttaaatgaccataatcccaaattactcagcgataattacttgctatcaatccttcttaacttttccatgcattcataaatacgatgagactgtaaataagacaaaaaaaaaacagaccccgataatgatcaaagatcttcggcgcaataggcaatgtctaacaacttcaatggctttcttcaggggattctcaacgggatttcttgatctttcccaaaatgctgggaagccctttaagtttaaacaaacaaaacctccaaacgggaagggatgccaacctctcctaggctgcctgcagagcggggagaaacaggtctatcggaagaagagtagagatactcacctaaggagactcctctcccgaaaggaatctgcttctcagccccacccccagctcaccccaatcccacgtaggtccgcagatgctccccccgggaaggacgggacgaccccgcagccgcgattcaacgcggcgcgcccggaagccaacagctactcccgggctctgagcgggaagtgctgctgcaggcgccagcccggacccgggaatgctcctccctagggtagggaagcgcgcgggcgcaggcgtttacctgtctcatcttcccatggttcggggcgagcaggcgtggaccgcgctctgcgcctacctccctcctccttccccaggaaggctcagggcagccgccgacggctgcttccccggttactacaacaaccaacaagcaaccgcccgctcggagccactgcgcaggcgctcataacgctcagctgcggacgcgggcgaatgtcgtcaccgccgcgcagcgcgggcgcagagccctgccctcagctgaagggagtcttctttttttttttttttttccgctgtttttttctccgcccctaagaggttgactccaaacccggagttccgctaggtccaacaggagggcttacggcgtgagcggcgtacctggggagaggcttaggcagcggcaaccgctgattggcagtaaaggggttcactccccatctcctgctcgggcgaaaccgggacagccaatcagagagagtactgacggaaacggcccaatcctggagcagggctgagggagggggcggggacaaatggctcaggtggactccgggctggagctgtcctgggggagcttgtttgcggcagcggctgctgctgccactgctgtgctgggggcccggtcgccaggtaaggagaatatgggggagaagagggatgtaggtgtctgtgttgcttctgattgagaggatccggagagtctggaaaaatggaggtgggatggaaggaagataactggaaggcaaccttttggggggaaaaggtttcgagaggcgatgacaagggggagctaggaagatggagaaggcttggtgaattcaaggaacgaaggaatggatgagcgaatgagcagccactatgagcctagcactgtacaaagagccttcactttttgtcatataattcttacaatagcccttcgggttgatatttctatctccattttgcagatgaggaaaccgagactgaaaagtgtaaatgacttacccagggtcacacagctactaagtggtagggccaggataagaatccctttctcctgattaagttttaacagcacacctatgctgggctgggcttggctgggctgggccagggccaggacaaaatttggaaatagatgttgtatacactctaagaggcccttaagctttagggaaattaggttgagaaattggcagagcaattcagaagtgctcaggctctgtcctcatcagctatctgttgggatttctaacagataacacttctgtgaaatggaaggcatacttgtgcagaaaagtggagaggtgcatccatgcagcttttctaaaccccggaggagtctcctcttgagagagagtgagaaaataaagaggatgggtggatcttggcccaaatgataatggcctgtgatgtccagtagaccctcagtctctctgatcttcgacagagaccacctttgtgatccagctctccctgaagggctcatcaattcacccttccttctctagatctctttattgcttgtttggggcggggagttggcggggggggcggcggtgtttcacactgtcttgggccattgctgactttaatatctgtcccactgggtagcagagaacaataccgaaacttgtattgccaaagtgacaaagaaagcctgttagtttattaccacttcaggcccaagaggttaacctgacaacagataaaccgtggaccaagaaaataataatgaggatgggaaaaagtcattccattattagattatttatctattttggttttatttaaatcagactaactgaaattactactcaacaagagttgaactaagccttaaaaaaaaaaaaaaaaaaggctgggtgctgtagctcacacctgtaatcccagcatttgggaggcgaggccaaggtgagtggatcagttgagcccaagtggagaggttgaggtaggaggatcacttaagcctttgatttcaaggctgcaatgagccatgactatgccactgcattccagcctgtgtgacagagcaagaccctgtctcaaaaaaataaataaataaataataaattaaaaaacaaaaagtatgtaatctaattgtattttccatacaacttgaagacaaaagtggatatggtatgcttttctttctcaaaaaatgggaacttcattaaaatagtctcaaacaatgaggtagcactgcagcagtccagcagaccatgattcttatctcagctctgccaactttgctgtgtgaccttaagaaacttgtttaacctctctgttccaaccctcatctgtaagatggaaatattaatagtgcctgcttacctcattgtaaagattaaatggtaatatatgttaggtgcttggcacagttcacggtgtaagtgctcaatgactgaaacctattattttcttgcaacccaacaccaagattgctgtttccttcgctatataattttcttactagtcctaaactcacacgttaacttaaacacacacaatttataaatttggaaaaaaggaaaagaggctttatctcttgcaaagggttacagccacccaacagggaagagtgcctcccaccaagaccagagacagttactttgaaggagaagggtttggggtagagcttcatgctgaacaggtttgctaaacatacacattcgacaggttacaggaggagctgtgaatattcctgaaggttgtcctgacacatgcatattgaacaaacatatgtaaccacatatgaaccctgttcactttggagtggagacctaacatttaagtctatcacacctaggctctatacgtcaaaaagtcttttcaggacaccaagacactcaagtgtgtgatcctgctaaactggccaggagcagtccacggttggtggtcttatctggagaaaattactgaaatcagtctcttgtccaatcaaagctgtagttacaactggtggaacaggggtcaggtagtcagcctctgtgagctggatgagctgcaattgttttaatattgcttatctcaaggccagtgttcatctagctgctggagaaaaaaaaaaccttgtggcagaatataacttttattctttaaatgtaggagtgtgtaacttaacccttgcctggcatggccttaggtcttgtttataatttggtatcttattgcacaaagaatctgttgtgtcattcttatgatctctattttaactttaatgctggtaagttgctgtctctaaacctgaaaacacaacgaatataacagggcatgtcagacctcccatcttgtcatggccaggagctcagttttaggatttttctggggtcccctaggccaagaggggctctgttcagtccgtgatgggcttaggattttattttgagttgacacacagcagtttatttttaacttttagattgttcttctagtttatggagcatggtatacctgagaaccagagtccagaaaacctagggatgtaaatagtgacctcacaccataagtcctactcaaatttataaagttccatacacttggaagaatccgtcatcaatagccaggcaggtgtctgtgagtatagttataatcgcctttgagctatttgcattacgaaggaatggcatgaaaacatgaaggtatagaagtaaagatagaggactgattccaacccagaaaaaggagttctgatttagggtaatattttggagaaattgcttagacaaggataagtactgtgccacttattgcaaagtatactgttcattcaccactattagtgtgactgaatttctttttttggcctgcttcattcttcctcccttcctgcttatggttaacatagactggccctcattgtctcatgtcctctgcctttgtttccaaggcaaaaagccctcccacgtttgaggggagtcatgagccgtttcctgaatgtgttaagaagttggctggttatggtgtccatcatagccatggggaacacgctgcagagcttccgagaccacacttttctctatgaaaagctctacactggcaagccaaaccttggtaagaaatcaaagaatttctgcatcctttataggacttataggactggccctatgctgtggttcccaaaccaggctgtacatcagagtaacctaggaaacgtcaacaaacacaggtacccatttccctcaccaaacctatttattgaacctgggtggagctcaggaatccagttgctaaaacacttcccagatgattctgatgctgccttagctagcctttggcagctactggagtaatagactttgtggtgagcacttgaccctttttcccccaagcttctctgaatacttttcattgattttacactgccctgggcaattcatgtatttaaaaaaaaaaaaaaaaaagcattataagggcaagtgaggaaatagacttacttggtgactctgtgatgcctgacaagaaagccataaagaagctttacatatatctcaaagccctcttcagaatcaggtttacatgattctggggcttacatgactcatattccatgttacagatggagagttattaattcaaggtcttccgtgacatagtccctgagaaggtatttaaaatcccttcaagttggtctcccaaaatgaaacttaagaaggcccatggcagcctttcctggcttcctgagcctctctactgagagtgtccatttcagcttccacttcatcacgctgatgtgtggggtagtttaagctgcagcactgtttcacagcagatgacaattctgtgtcacatttatagctaacccagattcaggctctgacctagctcgtttttctgcagtgtctgagtataaaatgaaattaagtaggctaaggctcattttaagaaagctcaaatataataagagtaaagaacctgggaaagtgagcagaataattccatcttttcaccttcaaatgctgccctcaggtggtcatggaaccctatatagattcacacatttttagaggtcatctggtctagccctttgagtttaaagttgaggcaaagaggtccagaggtcatgtgacttaaaggcatatagctgagcagaactttatgtgtgtgtgtgtgtgtgtgtgtgtgtgtgtgtgtgtgtgtgtgttcagccagcacggaagctgaggctgccatctcccttgtgatctaggggccttcatggtactcttctgaaagtagcagtgctctaaagtgtcccacagaatttcacctcatacctaatctggttagggctggttgagtactcttaactagagaaacgtccttagtcttctcattatcaaattggtttataaagaatatagctatccagggctaatgctagatatttggttggcatatggaattttttctcactaccatctaatggtcttcagtattgtgaatttgggagagctgtctgattttccaaaggctggaaaaatccttaaagcccaagtaaacattagtagacttttcagttgtcaattttgtcccttaaaatttatcttactcagcaggtagtagaccagcaaaggaagtatctttgctttcactgttttggcatccccgagccactggatgccttagctcaatggttttgcatttaaattacccaaacagggagtttctagaaaatacttatgcctggggccctcctccagagaatacgatatagttggtctggtacccaggccttgtaattttataaaactacctcagttgattgtaataaatgcccaaagtcaagaaccactgttatggtggaatatgacctatactttcaggacaagatatttaatacagcaatgtcagaacaaagctaccaacagcaggatgcccccagcaaacaccaaagaaacagtgctttgtcccactgccatgcacacaggaaaccaacctggtattggttcatccaacagcatagatctggatgcaggaagagacccaggcactcacatatcttaaagaccatatatgggcatctaaattggtccccagtatctctgagttctctcctggatcagccttgaaagtctgctggcctcctgggcatcttgcatttccagatcagtctctacaacattccccaaaacctgtcctgatccagaccctctaggcttccaggacaaaaggggtaaattactatatctaggagttatttgcctaactgggctctttgtgggtttccactcttggaacttcccttccaactgtagacatttgaagagaatctgagaagttctcattctggaattccttctattccttctagttcccatgttgccactaggacctccatcctgcccagccacagagaggtcaggtccagctccctatctcccatgaaccaccagtgaaataggaggagtttggaaggaacctcaagtctccccttctgaacactcttgcttttttctgctacacagtgaatggcctccaagctcggacctttgggatctggacgctgctctcatcagtgattcgctgcctctgtgccattgacattcacaacaagacgtatgtaagggaaggaagagctttagcatccttttgttggaaatcagatgcgaggcatacctgttaccttgagtaatgggaactgttaatcattttaatgcattagcttagaatgtgaataataaaaaactcacaggttacattccctccaagcctagaaaacatagtagacctaacaggtcttcattaaagtctgaaaattctttggaactgacatagcaaactggcaggccattatccagtggcctgcatcatgcccctccacttctttatgaaagaatcagcccttcttctactaaagaagtagagtggtatgctctttttagagtagccacccacacatacctttctcacattcctccttaagaagcaggaatgaacagaaatcacaatccatgaaaaaagaggaacccacaagtaaactgttgtatgtgtatgcagcatcagcaggtgagggtgaaagagaagctagggctcctgaatctacctgtcttgggtactcaaacagaccagggtggaacaattgcaggcaatcagaagccataaccagtgctggccactagagggggctcgagctttcttcccagcgggagtcatcatcacactctaggtggaaacagtttgttcaggtcaccgagggaggctatctgaatgccaacttcacattaaaatgtttttctgtcttatccaggctcttggcatctggggaaaacaggaggcgataatatttattgagcccctcttattatgctgagcttttatctacgtgatcttgattaagtcttttcttagcagccctggaggtcatgattttcattcctgattttgcacatctaaatattagagatacagttagtttaaagaaagactgactcaagtgagatttgaagcagggctattagccgtttgatctcttcaaccttattttttttttttaattttttttcaaacttgaacctgcagtttacttgtcctagaatgacacatacttttggaagcagtgtgtttagttctgggcccagttctgttggtaactagctttgcagtagcaagtccattattcaccttccttgcaccttggcctcttcatccataaaatgagaatagatatctgttctacctctcagggtgactaagaggaagggaggattgaacaatcattttaaagacctgtaccacaatgaagaattgctgatgagtatgagggatatatcttttgattgttgtgcttttgaagtgagcgaagacaacccagacttatctctttttttttttttttctgagacagtcttgctctgtcacccaagctggagtacagtggcacaatctcagctccctgcaacctccacctccgcctcctgggtttaagccattctcctgcctcagcctccccagtagctgggattacaggcgcgcaccaccatgcccctctaatttttgtatttttagtagagacaggttctcaccatgttggccaggctggtctcgaactcctgacctcatgatccacccaccttggcctccaaggtgctgggattacaggcttcagccactgtgcccggcctgacccagacttatctttacctcagttaccatttactttcacctctccccacacaggacagctgcaaacgctgactcctgtttctagacctttctagcctaggactttgatcgatgcacttctgatgtgcattctgatcctattccctccctaactagagactgaaagtcaacacacatacatattgtttccacaatgggccaggcgcgggtggcttctgcctgtaatcccagcactttgggaggccaaggtgggcagatcacttgagatcaggagtttgagaccagcttggccaacatggcgaaaccccatctctactaaaaatacaaaaattagctgggcgtggtggtgtgcacctgtagtcccagctactccaggaggctgaggcaggagaatcacttgacccaagaggcggaggttgcagtgagccaagattgtgccactgcactccagcctgagagacagagcaagagtctgtctcaaaaaaaaaaaaaaaaaaaaaaaaggtgtaaaaatatgcacaggagagatacaaatcaaatgtaagataccagttacttgtggggatgagggagaacagacttagagcaggataagtatacacaggatgatttaactcttctctgtaagtttttattagaagagtctgaaacaaaatgtcaagatgttaagatctgagggagctgggtgttggttgcattggtgttcattatagtgttcagtaatttttttgtatgtttgaagtatttcataattttaaaaaattttatactaaaaagatatcagcaaacaaagtggtcagtcacctagtagcctgtctcttctctaccttatagtcaaagctgaaagataagttcttttcccatgaggttgtcaccatgtcctcaatgtgactacttttctaggctaaggcacaaagtaaccaacgtatattgcaagagcatctaaaagccccagaggtgtccttgctccttactccccatgaggccgttcgttctgtggcatccatcttataaacaccgacaagtgcatggccagatgcctgccaggtgggattagactgcagagtcaaccaatttggataaatagaatatgtaagcgtgctggatccaaagttgtctacactgcctgcgattgtcatcattcaggctctgctttgctatagctgagttcaccactttgctgagacctggacgttcattctggatgcctgaaccattctcctctcagtttagcagttgaaaccttcagttttgccctagatgagaatatcgttgtgatcaaataaccagctcttcctcaggaacaagtgtcctttcttttaagtcttaatgacatcctgggttcttatttgtctgtatgaagtctgatacttttcctctgttctgaacaaacagtaactttggttcccatttctgtctgcttccttataggctctatcacatcacactctggaccttcctccttgccctggggcatttcctctctgagttgtttgtctatggaactgcagctcccacgattggcgtcctggcacccctgatggtggcaagtaagcatccaaccaccctagacctcctacaggagctgtgccagctctagagctagtacagagggtggacacaggagagagagagaagaaaggtaccgtatgtatgttagtcactagtctttcctctgtatttaaggtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctctgctctgatcagttcttgtactttgacctctgctaagacaagagcatggctgcctcctctgagccctaggagaatcacagctttatgcctgattgaatacaccatagtgagtaggacagctcatgacacaggtcagcctggctgcctccggctccttactgtcatttgctcattcctcttgtattcttgaagtcaaatcttcttttttctcaccttcaagagtctgcgttcacaactaaacactaagtgccctttcttatttcctcctaaagaagaaacagattcttgagagagcagagacaaaaaaatagaactaggcagcatagatgaaacaactgcatgacatgggaagaagacaactaaaccccgaggagaatgcactggaatggacagttgctcttaaaccctacccagagggcctcccccagctggaccctcatacacagtgtgtgtatccaaaaggccattgctatttcagcaaatatttgttgagtacttctccatgccggacacttgggaaagagaaatgaacgacacaggcaatgcccctgccctgtgggccttatattatagtcaaggtaacagaatcaacaagccaacacaaaaataaagaacttcaaatagggataagaactctaacaaacacaaggtattttggtcaagaaggaatgtggggtgggcagtggggaacgtaacttaaattagatcatcagaaagtcctccctgaggagatgggatttttttgttttttagagacagggtttcactctgtcacccaggctggagtgcagtggcacaatcacacctcactgcagcctcaacttcctgggctcaagtgatcctcctgcatcagcttcccaagtagctgggactacaagtgtgtaccaccacatccagctaacatttttgggggtgggaagagatggggtcttactatgttgtccaggctaagaggtgggatttgagctgagacttgaatgcccaggagttaaatgtcttaagatatggagcaggccgttagaaaggagggagcagcaactggaaggtagaatagtcttattcaaggaataagaactatgtaatcacagcatggtgaagagttaggaagtgaaagaaaaggtcagaaaaggaggcaaggggcttataagggtgtgataagaagcttgatgtttacacttaaatacattgggaattctcttatcagttaagtctctttaggtgaaaggacaaaacctaccttaaactagcttaaacaataaagatagctggctcatataactgaaaaattacaagattagcttcaggaagggtttgatcaagactccagctccatttctttacgattctttcagcactacctacgtgtgctggcatcctcaggctgacttcttttatggtaccaaagttggttgcagaaattccaggcctcatatgcccagaacactgtatctagaaaaatatctcaatggtaagaactatcttttctttacttgtcagctatattgttaggaggcagtaaaaaagcagtgatgacagttaatgtttgaacacagatccacatgaagaccttatgaaaggagtgaatgaaaacattggatgatttaggtcctctgagcatgtgtcatgaaaatgtgatgccctggccgggtgtggtggctcacgcctgtaatcccagcacttttgggaggctgacacgggcagatcatgaggtcaaaagatcgagaccatcctggccaacatggtgaaaccccgtctctactaaaagtacaaaaattagctgggcatggtggcgtgtgccggtagtcccagctacttgggaggctgagacaggagaattgcttgaaccaggaaggcggaggttgcagcgagccgagattgcgccattgcactccagcctggcgacagaaaaagacaccatctcaaaaaaaaaaaaaaaaaaaaagtgattccagattagtaaaggcagggacccaaaggatctaaagagatgtacagttagagtatttagcagacactatggatattagatttcttaacagcccaggcttgggtcccttcctagatcatttaaaatagaatcataatattgttcctccccagctacgagttgctataaatatgatgctagaataccacaggcacagtacaactctctatggaaagaatgtacagaacacagatgatagtagcagcatattcaagtaacacgcacaaggtgatcacaactggggagggatgagtaacaggacgttggccagttaggaagaaaaatggtaacgcaagactgcagctgctgggactgagccatgggccccagccacagcaagctggtgcatggctgaggtaatcagagaacaaacatttcaaccaccctttgaggcagagccagaaacaacagtggactctctcatcagcagtcactcacattccagcgcgtacacagcatggaaagaggtcagggtcgtgctggatgttgagttgcagtccctccatgtaggcaaacagtaacctttacagccttgtctttaaaaaatatccctcccagatggtaaggtctggcaacagtgagatgctcctgtggaagaccacagttgctgcttctctagcctcacactcccccgccccagcccagcccttccccacacctaagacaggagcctcaggaatgtgtgacagtcttgcagggacttctaagagccatctctgccccactgaatgataaggcagaccactttctgagaagtttttattgcctcgaaatgtcagatcttacaaatagaaaacacaaattatgtttttaaaataaagcaataggtttggtaaacattttgttaataccttttgaagggtttatgagtaaacatctttctctttatcaaaaagtaaagcacaccctcacctctcttccacactgactcactacttctgccgaaaacgtggacttctttcttctattacatacagcatgttccttgcatccattgcttgaatctgtacaaacacacacacacacacatgcagacacacacaaacctggctcctctcaggcagtggcccaagcaccacagtattgcagccagcacaggctgccctgatatgctgaggccagg

SEQ ID NO: 12661 - DNA, 44342 bp, Human
gaactcctgacctcatgatccacccacctcagcctcccaaaatgctgggattacaagcgtgagccactgcgccaggccaaaaacactccttttagtgtacagttcttgaagttttgatgaatgtatacagttatgtaatgtactagtccattctcatgctgccacaaagaacttgctcaagactgggtaatttataaaggaaaaaggtttaattgactcacacatctgcatggctggggaagcctcaggaaacttataatcatagcagaaggggcagcaaacacatccttcttcacatggcagcaggaaagagacatgctgagcaaaggggggaaaaccccttataaaaccataagaactcatgagaatttactcactatcatgagaacagcatgggggtaactgcccccatgattcagttacctcccaccaggttcctttcctgacacatgaggattatgggaactacaattcaagatgagatttgagtgggacacagccaaaccgtatcacataaccatcaccacaatcaagatatagaactcttccgtcacctccccaacacgtggatttttgttgtcaacccctccttacacccccagtccctagaaaccacttagatgttttctgtttctaccttttccagaatgccataagaatggaaccgtgcaatatgtagccttgtcttttttcacttcccatgactcatctgacattcatctgtgtggtttcatatgtcagtattttgtttcttcttcttccttcttctttcttcttcttcttttttttttttttttttttttgaaacggagtctcgctctgttgcccaggctggagtgcagtggcgtgatcttggctcactgcaagctccgcctcccgggttcatgccattctcctgcctcagcctcccgagtagctgggactacaggcgcccgccaccacacccagctaattttttgaatttttagtacagacggggtttcaccgtgttagccaggatggtctcgatctcctgacctcgtgatccgcccgcctcggcctcccaaagtgctgggattacaggcgtgagccaccacgcccggctttttttttttttttttttgagacagggtctccctctgtcacccagggtggagtgcagtggtgcaatctctcctcactgcaacctctgcctcccgggttcatgcgattctcatgcctcagctacgtgagtagctgaaattacagccacacgccaccacccccggctaatttttgtatttttagtagagacggggttctcccatgatggccaggctggtctcaaactcctggcttcaagtgatttgcccactttggtctcccaaagtgctgggattccaggtgcaagccactatgcctggccttctttttttttatttatttttatttttttactgacagtgtctcgttctgtcacccaggctggagtgcagtgatgcaatcatagctcactgcagccttgaactcctgagctcaagtgatcctcctgcttcagcctcctgattagctgggactacaggcacgtgccatcatgccccgctaatttttcaattttttgtagaagtgggatcttgctatgtggcccagggtggtctcaaactcctggccaaaagccatccttctgcctcagcctcccaaagtgctgagattacaggcatgagccaccacacctggccccagtaagttcatttcaaatgtatctggcctatacagaaagaatatgtcaaagagatagcattcacttgttttcgcttggcactaagcaaagtccacaggtgttgtcttccaggggcaagggacaggatctgtgcgtattctcacttgtgattcatcatatgactatgtagccatgtctggtttctctttagggtgggatttggctttcagcaagctcctattaaacagtaaatgaactaaataaacacaatgctgcttcatttggccatagctatgccaggatctcttcatgaaagacgaacagcaaagagaattagaatgcaaatactctacaagacggacaatactgggctgggtggtggctcacccctgtaatcccagcacagtgggaggccgaggcaggcggatcacttgaggtcaggagttcgagaccagcctgggcaacatggtgaaaccccatctctactaaaaataggaaaatcagctgggtgtggtggcgggtgcctgttaatcccagctacttgggaggctgaggcaggagcattgcttgaacctgggaagcagaggttgcagtgagtcaagatcataccactgcactgggtgacagagccagactccgcctcgagaaaaaaaaaaaatgtgtagcccaggatgctcaaagggtggggccttctcaacattcccaccatcctcatggcaaacccctggattgtagagggattctgcttctctttcccctccttttttgcatttgaatttggattactgggttttatttctacccctcccctggcagcaacagatctttgcccattccctgagacagagagaatttactgcttttgctttttttctttctcttttctttcttttttttttttttttttttgtgacgagtctccctctgtcgctcaggctggagtgcactggcttgatcctggctcactgcagccttcccctcccaggttcaagcaattctcgtgcctcagtccccaagtagctgggactacgggtgtgcgccaccacgccgagctaattttgtatttttagtagagacagagtttcaccatgttggccaggctggtctcaaattcctgacctcagatgatctgcccgccttggcctcccaaagtgctgggattacagccatgagccactgtgcccagcctgcttttttagaagagaagagtccagaggaagcaggtggggtctgtgcctgttcctgagcagctggatgcccaccccacagagaggtctctctccgggctctttgccagtccccatcttccttgtgaagtacggtttctgatggaggtttattaaaaagggcttatgaatgaatgtgaactccctttgtatctgaggcccccagctagtccaaactcacatgccaacctacacttggcctttaagacttcattaaaattatagccgatttcctgttgccaactagtttggcagtaacctctttctcctgcgctctgccaaaggtgaaggggttcttgtgttctgtctttggagaggcttctgttgtctctctttggcgctgaggttacttggttgccttgcaacctcagctttctgatgggctcaacagaagttacaatttggtagattatccagcttttctcattatgatattgggagggagagcctttgtagctttctacattctaagcccattccacaaatctttattgaatgcatactatgtgccaggcattattctaggtgctggggataaagtagtagaaaaaacaggctgagcacagtggctcacacctgtaatcccagcacactgggaggccaaggcgggcggatcacttgaaggagtttgacaccagcctggccagcatggtaaaaccccatctctactaaaaatacaaaaattagccaggcgtggcggcagctgcctacaaacagctactcgggaggctgaggcaggataattgcttgaatccacgaggcagaggttgcagtgagctgaggttgcgccactgcactccagcctgggtgacaaagcgagactctgtctccaaaaaaaaaaaaaaaaaagtagaaaaatagatctgatttcaagagatttatattcaattgaggagaggcagatacagatagatagaatattatatatcataatattagatgccaataagttctatgaaaaacacttaagcaactgacagataagacaaccatagtgtattggccgggtgctgtggctcacgcctgtaatcccagctctttgggaggctgaggtgggcagaccacctgaggtcaggagttcgagaccagcctggacaacatggtgaaactccgtctctactaaaaatataaaaattagccacgtgtggtggcatgcgcctgtaatcccagctactcgggaggatgaggcaggagagtcgcttgaaccttgggaggcagaggttgcagtgagccgagatcacgccatggcactccacctggatgacaagagtgaaactccatctcaaaaaaaaaaaaaaaaaaaaaaattagccaggcatggttgcgggcgcctataatcccagctactcaggaggctgaggcaggagactcggctgaacctgggaggcagaggttgcagtgcgtcaggatcacaccactgcactccggcgagactcctcaaaagaaaaaggagaaaaaacatttgatttcaagaaatatatatatatatatatatatatatatatatatatattttttttttttttttttgagacagagtcccgctctgtcgcctaggctggagtgcagtggtgtgatctcggctcactgcaacctctgcttcccagattcaagcgattctcctgcctcagcctctgagtagttgggattacaggtgcccaccaccatgcctggctaatttttgtatttttagtagagatggggtttcaccatgttggtcaggctggtctcgaactcctgacctcatgatccacccacctcagcttcccaaagtgctgggattacaggtgtgaggcaccgcccccggccagaaatatatatttttgtattcaattagagccagataacatatagatagaatattatatgttatagtattagatgctaagttctatgaagaacacttaagcaaccatagtgtataaatggtacctcctaccccttcctcccctattcgtgtagatactgtctataatttactgcttttgtttccctctcctcaatctctatggtggagaatgggctagactgcactactctgataatataacttagtaagatttcagctccaagtagtaaatgggaccatcattcccattcccatcaggaaggataaaactgctcataaacatgcccggtattctgcataaggccaaactagtacccggtggacacaaagcacaggtgttatacttcgactcaatacaggaagaacttttaaaccatcagagctacctgcaaaagtaatgtacttttctggaagataatcaatttccctttcttggaaaagttgcagctttgggtttataagttacattgtctgcaagctcccaactgccaccgagggtctccaagcagataggtggagtgtacatttcctgacttctaacagtagaaagcctccaccaaaggctcttcaggatatccctaggaagctgctcacctgtgctactcagcactgattctttaatttctttgtacagatgaataaaccatggtttattttattttactttttgagacagggtcttggtctgtcgcccatgctggagtgcagtggtgcgatcttggctcactgcagcctcgacctcctggactaaagcgatcctcccacctcagcctcccaagtagctaggactacaggcccatgccagcatgcccggctaatttttgcatttttttatagagacggggtttcaccatattatccagtctggtcttgaactcctgagctcaagtgatcctcccgcctcagcctcccaaagtgctgggatcacaggcatgagcccctgagactgcaaataaaccatgctttagagaaggtaagtgtcttgaccaaggccacagagctaggaagcagctggctgaactgggattgaggccaaggtagtgcctttgatgccaaaacctgctgtccttcctcactatcacccaacctctttccagtggctccacacccattgtggtgacagaggcaccttctgctgagtgtaaactcttctggctggaattgtttcccagagggtagggtgcagccccgagggccggggttaaaagtcaagcttctcatctggactcatcagttctgactgagcacttctgcctcaacccgcactgccatctctccatgaacgtgacacaaaagcccttggtttcagaaagccagtttccgggcaaagaaagctttccacccagggcctggcgtgagctgagggcaagaattaaaaagagtcgggcgcggcggctcacgtctgtaatcccagcaatttggaaggccgaagtgggtggatcacctgaagtcaggagttcgagaccagcctgggcaacatggtgaaaccctggtctctactaaaaatacaaaaattagccgggcgtggtgatgtacgcctgtaatcccacctactcgggaggctgaggcaggagaatcgcttgaaccagggaggttgcaaggagccgcaatcgcgccattacactccagcctgggggacagagcgaggctccgtctcaaaaaaaaaaaaaaaaaaagggaaggccaccagctaaggtccggcgtcaaggcacgggccctccgtccgtctcgtgccgaaggaaggcgcgtgcgccccttcccctgcctctgacctttccatggaagcagcccgttaggcgaaatggcgatcgaccaggcgaaacgttggtggatcctatggcagcgcgcgtggcaggcagccacacccgggcccggcttcgcccagcgctaagggcgtggagccgcgccgcaaatggcgcgcgagcctcctgcgcacgcgcgtgcagcgcctggggtcgggccagcggcgcggctgaagcgagggcggggagggaaagcgagcggcgcctgcgccccggcggtggacgggcccggtcgtgggcggggattggggcggagcctgaccgttacgcgcagccccgcccccgcggcctcgtcgctcctgctgaggcggtagccgcttttcgtcgactcttaccggttggctgggccagctgcgccgcggctcacagctgacgatgggggaccccagcaagcaggacatcttgaccatcttcaagcgcctccgctcggtgcccactaacaaggtagcggccgcgggcgagtgcgggcctgcctggcatccctgcgggaaccggcgggaggccccgcgggcgccagtgcccgtggcttgggaggcggggccggcgcggcctgtgacacgtcgcactgtggggccgcggcagcctggccgggccggggcgggcggggccgggcagctgagaggcccgggcgggaggccgcagcgcgggggtcctcacgcgagccggggagcgttcccgggggcggcggcgcgggcacaccccccggcgagctcttggggcggggggcgagcaccggcggctctgagcggaggcgggggcgggggcatcctcgggggcgctgcgaggagggagctcccggctcggaaaccccggctgctggcgccggatgcggggaaagcgcggctcccccagcgccaccctggagctcgaccccgcctgttggagccggcttggctcctcgggccttgcggtgcctgcctcagtttctcttctgataaagttgccgagtagtctacgctttggcttccagcttttgtcgctttggccagggaggctcaccacagcctcctccctctcctcggttctctttggagatggaggtttcctttttttttttgtctccagaggctgttctctccctggaacttttacagctttgcgcagctggctggaggcgttggggtgacgcagggggctaaggtgacacgtcgggtcggagagggacttggagagtgcaaagggctgtcgcgtcagcgtgggctctccccgcccctcctgtgacacgagttttgtctggttcccactgtcacttcccgaagggaacagctgttattgaacctcgatatgctggcatagaaagttcccgagtgttacaaaataggtgtttctgttggttttaagtcttgatggtacaggggagcccatattttttccagcctaggtgaggaaggaaacagtttattggaggtgatgtctgatggatgtgggaaagttaagagaaaggctccaggaattctccagtgcccgtttctttactgttctcttgattttcacatttttatttatttatttttttagagacagggtctcaccccgtcacccaggctgaagtgtagtgccttgatcctagctcactgcagccttgacctacccagcccaagccatccttccttcccagcctcctgatgaggctgacaccacagggctgtaccaccacgcccagctaattgttattattaattaattaattaattaatttttgtagagacagggtcttgctatgttgcccgtgctggtgtcaaattcctgggctcaagcagtcctcctgcctcctcctgccttggcctcccagagtgctaggattacaggcatgagccaccatgctggccttaatgttcttttttttttttttaacgttttaattttaatttttttgagacagagccttgctctgtcgcccaggctggagtgcagtggtgcgatctcagctcactgcaacctctgcctcctgggtttgagcaattctgcctcagcctcctgagtcgccaggattacaggcatccaccactacactcaagtaatttttatatttttagtagagacgaggtttcaccatgtcagtcactctggtctcaaactcctggcctcaagtgatccacccgcctcggcctcctgaagtgctgggattacaggcgtgagccaccgcgcccagccttgatttttaaatttagattgatgtgtttataaagagtgggtcctgtgtaacttagtcaagattaggatctgcggttagcaatgtgtaaactatatttttttgtcacctttatctcagaaacatcaacatgtattctctttgatttaattcaaagataattttaaattagaaatcaatgtctttatatcaagaggcttttgagagacaggcttgtattgtccaaactgctactttctaggtatgtcacccttggacaggttacttgaccactttgtcccttttttcctcctctgaaaatggggcatgaactagacctgactcagagggttattgtgaagattaaatggaataatccaagaaaaacacttagagtaggaactgcatataatagtcttcaataaatggcagctgtttttatgatgaagaacacacctgtgaaaaatttatattctgtaataagattaataaaagcaatgagcaaaaatgttttctggtaatgtttaacagtaatgtgctatatttcttggttgagaccttttatttgatcattggtttgaaacccttacctaaacgaagataacaatagcattttaaaattggggtcataaaagacagctctaagatacatgagccaggaaaggtaatcaaagaaaaacaagtcggcttacttttagaacatggtatccaatttcttcgtctcatgtatgatgatttactctagatcaaaggtcatgagggtcaattctcttttttctttttctttctttttttttttcttttgagacagtctagctctgttgtccagtctggagtgcagtggtgcgatcttggcacactgcgacctcctcctcccaggttcaagcgattctcttgcatcagcctcctgagtagctgggactacaggcgtgtgccatcacgcatggctaatttttgtatttttagtagtaatggagtttcaccatattggccaggctggtctcaaactcctgacctaaagtgatccgcctgtctcagcctcccaaagtgctgtgattacaggcgtgagccaccgcacctggccaagggtgaattttcttgtttgtggaaatccttctttgttgctataccattccttacttttatatagattgggttattcattcaacaagtattcattaagcacctatgctatgctgggcactgtgtagagcatgaaaggtatgtacactgatggtatgttcctgtcctcagggaacttatagtctagtggacagatgaagggcagatgcaggacggcaggtggtatgttttctgctctgaagcacagtgtggtggagcgggaagagtggctctgggaacagactgcatgggatccagtccccattgtgggcatttccactaaggaattactaagcagtggccacttcttatctgtcatacttaattcagtaattccttagttttctttaaaatggagatcaagatttaccgccaccatcccacgcccggaagggctcctcatgctctctgcagcatggtgcttctgtcgcttacagaacaacttgcctttgatgattttcaagagagttgtgctgtgaggtggcaaaagtatccaggcagcaggatgccagtgcctcaaggaaaaaatggtccttttcggcaatgtgttcggtactgggggcttggcccttgtgtattaccgcatacaaaagactttttccagggctttgtattaccagttggcattggagcaggtgcatagccatcccaaggcacagggagctctgggccctcttctcaacattcactgtctcaaactcaccaagcacaactttgtggacattgctgatgccaagttgaagattcctagctctggatccaagtcagagggccatctccatgtcagctcatccagaagtgcccctttcagaggtggcaccttgatgaggtcttcctagagcccaaggatggccagcagattcccttgttcaagctcagtggggagaatggtgaagaagtgaaaaaggagtagaaacgatccaaaagacccagctttcttctagtctggccttcccttatctccaccatgtgcccaccaggggtgatggcccatctgagtgacagacactcccgtaagctaattttccagccaccagtggaatgattgtatgtgctggcatatggtaattttggtataattctaacttgggcacaacgaatgctattgtcatttttaaactgaatcagaaagaaactcttattataagataatttatgtgaaagttctttgtttaagaaagcacatgataaaaggaatcagaattaagaaaacattcattgatttaaaaaacaaataaataggccgggcgcggtggctcacgcctgtaaccccagtaccttgggaggctgaggcgggtggatcacctgaggtcaggagttcaagaccagcctggccaacatgatgaagccccgtctctacaaaaatacaaaaattagctgggcatgatggcgagtgcctgtaatctcagctgttcgggaggctgaggcaggagaatcgcttgaatccaggaagcagaggttgcagtgaaccaaggtcacgccactgcactccagcctgggcaacagagagcgactccatctcacacgcacacacaaataaaataaaattaaataaataaaatggagatcaagactagctacataatttgtgaaatgtacaaaatgaaaatgcagggcccttgtttgaacagtattaagaatttcggccagacacagtggctcacacctgtaatcctagcactttgggaggccaaggtgggtggatcatctgagctcaggagttcgagaccagcctgggcaacatggtgaaaccccatctctactaaaaatacaaaaaattagccaggcgtggtgccatgtgcctgtaatcccaactactcgggaggctgagacaggagagttgcttgaacccaggaggcggaggttgcagtgaaccaagatcacgccattgcactcaagagtgggcgacagagcgagaccctatctcaaaaaaaaagaatttcaagatgaggctaggcgcggtggcgcctgtaatcccagcactttgggaggccgaggcagatgaatagcttgagctcaggagtttgacaccagcctgggcaacatggtgaaacctcatctctaccaaaaaaaaaaattaaaattagccatgcatggtggctcatgcctgtggtcccagctgctcgggaggctgaggtgggaggattgcttgagctcgggaggcagaggttgaagtgagtcgagatcatatcatatactccagcatgagaccctatctcaaaaaaaaaaaaaaagaatttcaagatgagacagcagagcattaagccaatcacacactcttttattctaagtgtggggccctctgcgactgcatagatcacacacatgcccaggaagctggccctgatggggatgatcatagtaccttctactagtaccctactaatgaaagcgttgttaggaagatgaaattggctaaagtgccaacaatagtgcctgaattaaacactcaatattagctgttattattatttgtatactaattattctcatcattaaacaaaacaaattgtcagtcaaaagctatttcttgctcatcaccataagaactgatgttctgctttaaaagccacatcttgactttggtttgggattgcatatcaaatcaaagcgcagtccctgcttccaaagcatagcctcctggtatagcaggaggatcaaggcagcatttatgggagccagacctgtatttctcaccacttctgacctccacacgtcccagtctccacttgttagctcctctacccctataaactgctccaccatgtgcattcgcatttagtgagcacctgtgttgtgccaggcatggtgccaagctcaggtgaataaggtagacatggcccccccctcatggggctacattttagcaatcccttagcttaggtgatgggtccggaggatgccaaagctgcctgcctcattaggaacctcactgctctcttcttgtagccagtctggtgaccacctcagaagtgattctcaaacttggcctgctctgggctgtgtacccaaaatctctgccatcacctctaccaaaaaccctttgcatcctgtccttgcttactaggaaacaatcttgtaactaattgtcttgcccactggactgctagactgtgggctccatgtgggcagacttcctgaaccacgctggtatgtccacttggtatgtgccaggtacacttgatggtaagtgcacagcaactggtagttgagtaactaggtgagaaattacacacagcctgacggggaagaacagcaccttttggcagagtctgtcgttttgtttgatgccccacagaagagggttctcctaatggccatcaccacagggcgtttgaatttgcgcgtctgtcttccccacttctcagtgagctctttaaagactagcaccaataagcgttcagctagtgtttgtgctgctactttttcatacctcatcacctgtcacatgtctgacatacagcaggtgatcagtaaacaccaaagtaaatctcctggcctctttttgtgtcagttgtcactccaccccgattattcagtgtgcgatcagtgtgagcatattgtggtgaggggctttagaaaacccactcgtgtttcctctcttgtattgcccttgtattgccctgaaaagaccagaagccagatcttgcttgataatgataggttggacaaccttcacataagtgattctgcctataaagtatatcttttttttttttttttttttttttttgatagcagggtctcactgttgctgaggctggagtgcagtggagtggtctccgctcattgcatcctccgcctcccaggctcaagcgatcctctcacctcaaactcctgagtagctgagactacaggcacgttccaccacgccggctaatttttttaattttttggtagagatagggtttcgccatgttgcccaggctggtctcaaactcttgagctcaagcgatctacctgccttggcctcccaaagtgctaggattacaggtgtgagccactgcacccagcctatatatctaatatgtatttttttttcctgcaaaaagattaaaaacacctctattagaggaattttttccctattcggagtttaatgagttataaatactactttccacaacaagcactgtgtattttatgggcccagcacacttccgacgcgtgactctgctagttagcactgtgtattttaaagtacttttatgctcctgttgggcttcagtgtcagtgttgaaggggctagtaatttttgagctggcaatacgtttttaaagttattcttttgagtaacaaatatttactgaatgcttaccatgggtaagcctatttttcaggctgtgtgtgagatttaaaagtacacaactattcagcaaacacttattgtgcgtttaccatgtgcaggttctgtgctagtggacaggaaagtaaggtgacaggagccggacgtggtggctcacacctgtaatcctagcattttgggaggccgagagggcccaaattgcttgagcccaggcgttcaagaccagcttaggcaacatagcaagacccccatctctacaaaagaaaaaaaaaaatctgggcacggtggcatacacttgtcctaactgcttaggaggctgaggggggtggatggctcgagctcaagagttcgagactgcagtgagctaggaccgtgccactgcactccaacctaggtgacagagccagaccttgtctctttaaaaaaaaaaaaaaaagccataaagcagcgagctaggaccgtgccactgcactccagcctaggtgagagccagaccttgtctccttaaaaaaaaaagaaaaaaagccataaagattagcaaaagggaaagattctacccctgtaagagctctcagtgccctcagtgggcagggaacgtagtcctcggttatgaacctgcatctaagagttatcaaagtgacctggacagagtgaggcagtggaggtagagaagggcacagcatttcataaaggaatatctctctgtattagtcatctattgctgtgtatcagatcacccccaacttggcatcataaaacaacagatagttctgagggtcaggaatttgggggtgacttagctggctgcttctgacccagggtctttcatgaggctgcagtcaagctgttggcccagggctgaggtcatctgggagcttactcacatggtggttggcaggcctcctctcctcgctggcagttggactgggggcctcaactcctcagcacttcaccctctccacagggcaacctgagtgtcctcaagacatggcacctggcttcccctagagctagtgatccaaggtggggagggagagagggggagagagaaaaagagagtgggggagacaggaaaaggccatagtgtcatttgtaacccaatctcaaaaatgacatggtcatttctgccatatacacatagacacacagatcaccttggtaaagtgagggtggtggagattacacgggatgcaaataccaggaggtgggtttcactggggccatcttggagtctggctgccacaacctcttcctctggctggggagagaagcaatatgctcaacagcctgccatctggtatagccactgccaggaaggatggtagggctggagtgtttctaggcagggctgcttccctcactagcattcctttacatgactggtaggatccctgctgatgcttcaaggataaggcatgtttgagatggtacacaaacctaaattctcttcactatgtatagtgtgcattgttaaaatatatacatgatagcccgggcgcggtggctcacgcctgtaatcccagcactttgggagtccaaggcgggtggatcacgaggtcaggagatcgagactatcctggctaacacggtgaaaccccatctctactaaatatacaaaaaattagccgggtgcggtggcgggcgcctgtagtcccagctactcaggaggctgaggcaggagaatggcatgaacctgggaggcggagcttgcagtgagacgaaatcgtgccgctgcactccagcctgggcgacagagcgagactccgtctcaaaaataaatagataaatatatatataacataatctgtaatatactgtataaatcatgtagtaaactgggcacagtggctcgtgcctgtaatcccaacactatgggaggccgaggctgccagatcacctgaggtcaggaattcgagaccagcctgtccaacatggtaaaaccccatctctactaaaagtactaaattagttgggtatagtggtgtgagcctgtagtcccagctactccggaggctgaggcaggagaatcaatggaacctggaaagcagaggttacagtgagccgagattgcaccattgcactccagcctgggtgacagagcgaaactctgtctcagaataaaaaaatacataatatagtaattaactatactaatttataattaatataattatatatatataataataaaagagcatgaaatttgaggcttttaaaaaaacctaggtgagatattttctaataatacaatcccaaagtttacattgtaaaggttaaacagttttcaagctaagtcatttactgtatcttacaggataatttatttggctaacataaattagtaactgaatttaacattttttttcaggtgtgttttgattgtggtgccaaaaatcccagctgggcaagcataacctatggagtgttcctttgcattgattgctcagggtcccaccggtcacttggtgttcacttgagttttattcggtaagtgaatcttctctcattggggtgagattgattacattgttacatgggtgtttttttcccttttttcttttctttttttgagacagtgtcttgccttgtcgcctgtcaccttggctgcaggagtgccatcatagctcactgggctcaagtgaactcagcctctacaaaaaataaaaaatgttgtggtgtgatgatgtataactctagtcctagttactcaggaggctgaagtgggaggatcacttaagcccaggagtcaaggctgcagtgaactatgatcttgccgctgcattccagcctgggcgacagagtaagaccctgtctcttaaaaaaaaaaaaaagaaagaaagaaatgtgattttcagtgttgccatacagtattaaaaggtgaggcctttaagaattgattgagccctcattggtatgggttaatgggttatcatgtaagcggctttataggaaaaggaggagagacctgagctagcacgctcagcgttctcactaggcgatgctgcctctggactctacagagtccaaccagtaagaaggttcttaccagatgtagccccttgaccttggtcttctcagcctccttaactgtaagaaatcaacttcttttctttataaattacccagtttcaggaattctgttacaagcaatgaaaaaccgatttatgtcaatcatcttctaataattcggcagtacaaagtacagactcatgggagaaggggaatcaggtgctgtgggtctgtcctatgtcctccaaagtggagagtttatgtcaatgatgagacactctccttgtatcagggcttcacttccaccgtaatcttatagctctggcttccaaggacactaatatcacaaagcctgagtgaatgatttttagtggcagtttcaaatgtttataacatgaaggtcttttttctccttttatctgaagacttgggctgcattggcccctctggtgagtaaaccgtcttctacttctgatactctatggcaatagcccatatggggccttttgcatcagaagaagacaccacctttggactgacagtctgatgggataaccccacagtccagtgggaggcaggactatttgtgaagtgaaataaattgaaataataaaagaaataatggaaagatccccagggcttggaagctaagcaaggcctgcctgtcacctgccacaggcccttgccaggacaacttgtgcagagcaccctcaaacagccatggcttagtcattgctgcctcccccagacaatttccagagatttccctactccatcttttctagggaaggaaccagctaggctgcccatctggaattgtggcaagcaatcttatattatgacttaaggaatatcgaaatattgatagaacgtgattattaaaaaggagcatttgtttctataagataaaatctattatgattctttgtctttttttttttttttttttttttgagatggagttttgctcttgtcgcccaagctggagtgcaatggcgcgatctcagctcactgcaacctccacctcctgggttcaagcgattctcctgcctcagcctcccaagtagctgggattacaagtgcgcgccaccacactcagctaatttttgtatatttagtagagatgggctttcaccttgttggccaggatggtcttgatctcctgaccttgtgatccacccccctcgtcctcccaaagtgttgggattacgggcgtgagccactgtgcctggccttgccttctgttttcttctaagagttttatagttttaggtcttacctttaagtctttgattcattttgaattaatttttgttcacaatgtcaggtaagagttcaacttcattcttttgtatgcggatacctagtttttccatcaccatttgttgaaaagactgtcttttccccattgaatcaaacttggggtttttttttgttgttgttgttttgggtttttttttttttttgagatggagtcttgctttgtcacccaggctggggtgcagtggcacgatcttggctcacctcaacttccgcctcccagattcaaatgattctcctgccctcagtctcctaagtagctgggattacaggcatgtgccaccacgtccatctaagttttgtacttttagtagagacagagtttcgccgtgttggccaggttggtcttgaactcctgacctcaggtgatctgcccgcctcggcctcccaaagtgctgggattaccccggctaaagcttgtttttaatgtactttgttttccagattgatcattaccagttaacttatggtaacctactctgcccagagcagatgaagactagactcaaggcaatacctagttacttctcttccttctgtctttactgtgttctttccctctttctttctgctaagtctcgcccattataacctctccttcttcctcatcgctaaagaatacttccagtttaagccattccaggaaatcgggtggttttatgatgtgttcctccgtgagggaaggagtgacctagagcctgaggggcagtacagcaggatctgtttgggccattgcaggtttaatcactgaccttttaaaagtcagataaatagaactgtatgagtcacaatgcttgtaaatgattcaaaaacagcaattaaaattcatgatacaaccttagggcaggagtctaggatttgggcaagaaaaagtcaaggatgagaaagtactcagtattgtttttgttgttatttttaaggcagagaagagctattctttaaacatttttattccttaaaaaaaactgaggggccggacatagtggttcacacctgtaatcccagcactttgggaggccaaggtggaaacatcacttgagcttgggagttttttgggttttttattttttttttttttttttcctttgagacagagtctcactctatcccctcggctggagtgcaatggcatgatctcagctcactgcaacctccgcctcccgggttcaagcaattctcctgcttcagcctccgaagtagctgggattacaggtgtgtgccaccacacccagctaatttttgtatttttactagagacggggtttcaccatgttggccaggctggtcttgaactcctgacctcatgtgatccacccacctcagcttcccaaagtgctgggtttacaggcatgagccacagcacctagccgagcatgggagtttgaggctgcagtgagctatgatctcaccacttcacttcagtctgggtgacagaacaaagaccctgactcaaaaaacaacaacaaccaccaccaaaaaaagaaacaaaaaaaaccactagctaattgggaaaaaatccaagcagccccaaaatatataaagtctctcctctagaatacttttcccctcttcttcccctcccactgccagacacacacacatgcactgcttcctgtgtggcatgggtggtgtgcatatttaactggagttttttttctttaactagaatttcaagtcaacaaatttacagaggaaaaataatttataagttatggcttttgccaagcaaaggggggaaggcagattaagagtatatggagagggcaaactgcattggttgctgactgctcccagagtggaccagattgaactgacctctgccccttttcacctccattgctgggatctccatgtttcaggctgctcctcccctctagctctgttttttctcaagtttgccgttacgtatttcatgagcttattaaaggtgaatgggatccctgcatcgatcttgttggcctggggttagggacaggcttaaatacaacgtaaataagaagatagactgcaaagttatgcatgagagatggaaactaagtcctgtgcccacttctggttggaaaataaggcaaagtttaaaagaggtaacatttgcaatgaacttggaaggtttggtgaggttttgataatggagacaaggccgggcatggtggcttgcgcctgtaatcccagcacttgggaggccggggtgggaggatagcttgagcccaggagtttaagaccaacctgggcaacatagtgagacctcatctctacgacaacaaaaaaagataatggagacaagggagggaaaattgaggtcagcactcggaccttcagatataaaagcaggaaaaagcgaaatgctttgtagcgactttttgtatgcataggaaaataaagagaagtaagggtgaaaggagaggatctgtgtcatattgtggagcgctttagctgccacactgggagctaaaagttcactcctgaggccctggaggggtgaggcatgtggggaggctgactcagcctgggcagagcaggagacagcatcaggaagaggtgaggaccgaggctgaggatgcaggagcggggatgtggttggggggtcggggggaggcaaatctgagctgtcctttcctggccttgggtgtgttccttacctctgaatgtcttgctttccttctcttgaaagtgagggtgagaatactaggacctgccgtacagggtgttggcaggagcgagcaagagagccccatacagcctggcacatagtgagccctagaacatgttgatgatgaccagggcagaatctgggctcctgctcggtggacactggggagaacctttttatgatgttggcgtagaaaggcaacgctttttatgaccttatagaggtaatcaaacaagttataaacaaagggcggctgggaaattactgagattgtctataagtaaaactctagattaataatggtatgcactttgggaggctgagatgaggggattgcttgaggccaggagttcgagactagcctggcgaacatggcaaaaccccgtctctactaaaattacgaaaattagccaggtgtggttccgcacgcctctaatcccagctacctctggaggctggggcacaagaattgcttgaatccagaaggcagagattaccatgagctgagatcgcctcactgcactctagcctgggcaacagaacgaggctgtgtctcaaaaaaaaaaaggtatggttcactgggcatggtggctcacacctgtaatcccaacactgagaggctgaggtgggaggattgcctgagcccaggagttctagaccatcttgggcaacataacaagaccctatctctatttaaaaaaaaaaaaaaaaaaaaaggccaggcacggtggctcatgcctgtaatcacagtactttgggaggccaaggtgggtggatcacctaaggtcgggagtttgagaccaacctgaccaacatgaagaaaccctgtctctgctaaaaatacaaaaattagccgggcgtagtgacacctgcctgttatcccagctacccaggaggctgaggcaggagaatcacttgaacccaggaggcagaggttgcggtgagtcaagatcgcaccattgcactccagccggggcaactccgtctcaaaaaaaaaaaaaaaaaaaaagcccggcatggtagctaccatctacttgggaggttgagacaggaggattgcttgagcaatcctggttgaggctgcaatgagctgtgatcacaccactccattcctgggtgatggagtgagaccctgtctcaaaaaaaaaaaaaaaagaaattagtaaatataagggcagcacaaaggaaagttttggtggacctaaagcttcttttcttttctttcttccttgcccattttgtaaaaggtattctgcctatactcattctaaaatatccacattcctttacagttagtgtagggcaagctattactgaataacaacctctgctttttgctcatttctgtggattcagtataaagattctaacattgttgctttaccgtcgaccccttggggaatgtgcattgttgaggctatactcactgcctttacttgtttcagatttgatcttacagtggagagaagttaggcataaggtgtggaaggggcaggaagtgcttgtagctttcacttcaggagcatgaaatcttgtgttttttcctctctctgctggtcgtgatgttgggtaggtctcttctaccttgtgataagagaatgagcatcctccaagcttctggtagcgatcaaactggacaagtagatcaccgacctgaaaacatccaaacagtgcatctgtttcaagtagagacacattaccaaatttcaaatcatatccaaccaaggatgggaggcaaagagttggtgtcgttccagcagcccgctgacacttgtcatgtccctgtgccctgcattccaggaaggacgagaggagccaggggttgctcacgccaaccatcatccactctggagtcctagcatcccaaaagtgtgggtccttgttgacacaaacttagaattctttaggatcctaaagcctaaggaaaccttgttctcaaaagctcactgattttgctcctggggataaaaaatattaacagttagtaatattctttccatttagatctacagagttggattccaactggtcatggtttcagttgcgatgcatgcaagtcggaggaaacgctagtgcagtaagttcatctcaaactcgtcattttccttcttgtttaaatatttgttatgctataatagtaaagaagctcaggctaggtgcagtggctcatgcctgtaatctcagccatttgggaggctgaaattacaggcgtttgggaggatcactggagcccaggagttcaagaccaccctgggcaacatggcaagaccctctgtttataaaaaacaaacaagtcaggtgtggtgtctcacgcctgtaatcccaacactttgggaggctgaggcgggcggatcacttgaggtcaagagttcgagaccagcctggccaacatggtggaaccccatctctactaaaaaaaaaataataataacaaaaattagctgggtatggtggtgcacacctgtaatcccagctactcgggaggctgaggcgggagagttgcatgaacctgggaggcagaggttgcagtgagccgagatcacaccactgcactccagcctgggtgacagagcgagactccatcccaaaaaaacaaacaaacaaacaaaaagagttcaatacttgaaagtttgggaggccctatgagaagaagcagagagcctgatgggttttggagttggacagacccagttgacttgtttattcaaaaatctgttaaacacctaataaacaggaagcgttggctagctgctggggatatagtgacagacaagacaaacaagatccccagctgggcacggtggctcatgcttgtaatcctagaactttgggaggctgaggcaggcagatcgccttgagcccatgaatgtaagactgacctggacaacatgacaaaactccgtttctgcaaaaaatgcaaaaattagcaaatcatggtggtgcatacctgtagtcccagctactcgggaggctgaggtgggaggatctcttgagcctgggaggtagaggttgcagtgagctgagatcgcaccattgtgctccagcctggttgatagagtgagatcagtgatagatagagtgagttgatagattatcaaaataataaattaaaataaccaatatcccctcttataggggatattttattataaataaaaataatcaagatcccctcttatagacaggggcagtcagagagtaatcaaagaaatatgttcacaggaaaataacaggcagtgataagtgctttaagaaaattaaaacaggaagtgagggtacagagaaactggaggcttctttatgataatagttttttaataactggggtgacttttgtggttaggatggaatgcttgtatttaaattaatatttaacttcttaaatctacaaattaaaaaacccattcttttttttttttttttgagacagagtttggctctgttgcccaggctggagtgcagtggcgccatctcagctcactgcaacctccacctcccgggttcaagagattctcctgcctcagcctcctgagtagctgggactacaggtgcacgtcaccatgcctggattttttggtatttttagtagagacgaggtttcaccatgttggccgagctggtctcaaactcctgacctcaagtgatctgcctgccttggcctctcaaagtgctggaattacaggcatgagccacagcacccgaccaaaaaacccattcttcatgtctttaaatatagcaaatattgtgtgttaatttctaaacacaaacataaatactgtgtgttaagttctgtgaaaaaataaccttaaaatattcaattaatttataattttaaagaactgatttccttaaccccatttacaaacctaagtaaggattttctttttttttttttttctttttttttttttgagacggaatcttgctctgtcacccaggctggagtgcagtggcccaatctcagctctctgcaacctctgcctcccaggttcatgccattcttctgcctcagcctcccgagtagctgggactacaggcgcccgccaccacacccagctaattttttgtatttttagtagagacggggtttcaccatgttagctaggatggtctcgatcacctgaccttgtgatccgcccgcctcagcctcccagagtgctgggattacaggcatgagccaccgcgcccggcctaattaaggattttcaaacattttaaactttatttacaaattcagtatatttgattatctcaaacactgaactggcagccttacaaatctagccagccaaatcttgcacagcactggtaacctatttatcaggccaaaatggtgtagatggagtaaatggaattcctttaggcgtttcttatatgctaaagtataagaaatcaaatttgtatgcatttcaaataaaaattatggccaggcatggtggctcgtgcctggaatcccaacacttcgggaggctgaggcgagaggatcacttgagtccaggagtgtaagaccagcctgggcaacatagtgagacctcatcgtacaaaagacttaaaaattagcaaggcatagtggaacctgcctatagcctcagctactcaggaggctgaggtgggaggatcacttgagcccaggagttcaaggctgcactgagctgtgatcatgccattacactccagcctgggtgacagagcaagaccctgtctcagaaaaaaaaaaaagaaaaaaaaaatatatatatatatatgtgtgtgtgtatatatatatcaattaaatagttaaagtcagaggtctaaaatagcagtttccaaaatgctagtttctcaatcttttttcttcgttgtccctaagcataaaaatcaattaattagataattttccatttaaattggatccaatgtttccctaatgagataaattaaatactaaggaatacaattttgtcaggtagaggtgacctttggaaggccataaaccattgtaataactaagatttttttttcacttttcaagaaacaatttttgcccctcttaattaaaaatatatgcctggccaggcatggttgctcctacctgtaatcccagaactttgggaggccgaggcaggaggaccacttgagcccatgagttcaagaccagcctggacaacaaagtctacaaaaaaaaaattttaaattagccaggcatagtggtgcatgcctgtagtcctagccacttgggagtctgaggcagaagaatcacttgaatccagggggttggcgctacagtgagcagtgttcaccgtgccactgcactccagcctgggtaatcaagcaagaccgtctcaaaaaaaaaaaaaaaaaaaaaagaagtatgccttagatgtttcaaggcttttttttggtttttttttttttttttttgagatagagtctcactcctattgcctaggctggagtgcagtggcaaaatcatagctcactgcagcctcaacttcctgggctcaggtgattctctcactcagcctcccaagtagctgggactacaggcaagtaccaccacgcacaacaagttttttacatttttagtagagacagggttttgccatgttgccaggctggtctcgaactcctaggctcaagtgatctgcctacctctgccacccaaaatgctgggattgcaggcatgagccaccgggcccagccagtgtttcttattaattttttattgattttctgtttttttgtagaggcgtggtctcactttggttcccaggttggtctcaaattcctggcctcaagcaatcctcctgctttggcttcccaaagtgctaggattacaggcatgagccactgtgcccagcctcaagcatctttttagaaacctttgcccattatcatgatgttcacaaacttgttcctaaacttagcactgttggtttgacttacctgttcttatttctaagccttcccaaggttgcagagtcaccctccaaactccagaaaggagctttctcatctcaagccatcaggggttgggggacatggggagggaaggctcagatgagtggtcattcggtttagccagtggagctgtgagttctgtgcttggaaccatcctttttgtatttgaatcctaactctgtcccttgctacccatgtgacttggggcatgttgttgaacctctctgtgcttcattttccccatctgtaaagtgtagacagcagtagtgactgtctgatagtgttgctatgagggttgaatgagatgatgcccatgaagcactcacaacaggatccggaacatgtgggtgaccaatatcattatcagttaaattaggttcatcaaaggatcactcgtataggtttttagaagacctgttttaattaagatatgaattctataattcatgtctatacatggatcctcatgaagtgggtaaaagcagtttcttttaattgtttaaatacttgttttatcatcttacctatattgtagtatctgttaatgataaaatagtgctaaacaaggtaaacattaatgtagctcctcactaatttgtcaaaaattctgatttactggaatccattttgagattgattgtggacgaagtgtagtggttcacacttctaatcccagcactttgggaagccacggtgagaggattgcttgaatccaggagttggaggctgcagtgagccatgatcatgccacactaccctccagcctaggtgacagagtcagaccatctcaaaaaacaaagaaaagggccaggagcggtggctcacgcctgtaatccagcactttgtgaggccaaggcaagtggattccttgagctcaggagttcaagactagcaacataacaagaccccatctctacaaaaaatacaaaaattagccaggcgtggtggcacacacctgtagtcccagctatttgggaggctgaggtggtgggatcacttgagcccaggaggtggagtttgcagtgaaccgagatggagccactgcattgcagcctgggtaatagagcaagactctctcaaaaaaaaaaaaaaaaaaaaaagaaagaaatggattgctcgtgaattaaaagtagtcctgagtagaaagcttttccccaaataaagttcacaatgacagagatggtttaatggacaaatgaggactagttatttcattttgtaatgcaagtctcatagctagtttttgttgttgttgttgttttgagatggagtcttgctctgttgcccaggctggagtgcagtgacacgatctcagctcactgcaagctccgcctcccaggttcgccattctcctgcctcagcctcccaagtagctgggattacaggcgcccgccaccacgcctggctaattttttgtatttttagtaaaggcaaggtttcaccgtgttagccaggatggtactgatctcccgacctcgtgatctgcctgcctcggcctcccagagtgctgggattacaggcatgagccactgcgcctggccatacgtagttttacgaaaatattaatgtgcatgcttttctctgtagtcttccttttttcatcaacatgggtgttccaccaatgacaccaatgccaagtacaacagtcgtgctgctcagctctatagggagaaaatcaaatcgctcgcctctcaagcaacacggaagcatggcactgatgtaagtcactggaggctggattgtttcctttagatacatgttcacttcatagaaaaagtgatttttatcctgaatagtaaaacttttctacctgagttgtcttacaaggaattagtgtacagtagattcttactattgaagtagttatgttctgtaaattcatcatgagtactggattagtgaatactaaaacattgctcctaggagaaatacaggattaggttcctataagctctggtctcattttcatcaactgatcaatacataaccttatttaacatgtgtttctatttaaagacacctttttaaatatatattgatggctcatgaatattgaactcacagccaaggactataactcagccctgaatgaagcttatttaatgcctgaattttctccatgaggcacatcacagccttcatgtgcttcagaacattagatagcccttcagtactgcacttgagaggcatcttaaaaaatgacatcctcaataaaaagcatgggaatatgaagaacatagcacaaaataaactgcagaaaggacatttgttatgagaactgaaacaagaaggcagagtagtgtgtcttgttctacctcagctgagaatgtgcttcttgggcaactcattttttgctgcactattctccaaatgactgaaaacaccacgaggactaattttgggttaaacgtaaattttagcaagtaggtagattcataaatatggaatccatgaataacaaggattgattatcatttggaacctgcatttagatatgaagtctttgatctttccttttcagaaatggtttatgtgtttgaggtccttgacttcctcaaggtttggaagcaaaatttactggatgatagattactaaagtgcacgcagaggtcctctgtagggatgttactgattttataagaatggaaagcaccaatctttaggaaacaggtctctaagggaagtgaaaggtatcaaataaaatcctttacaggccggatgaaatgctcagccctgtgttgtttttttgttctagctgtggcttgatagttgtgtggttccacctttgtcccctccaccaaaggaggaagatttttttgcctctcacgtttctcctgaggtatgtattatgcttcacatcattttaaagtgtgcttactctgacagttaacaaaaggtgcatatttaaaatgttaggatgtaggctaagctcttgtaacaagaagtgctgaaacataactactgaagagagaaatgacattatcaacaattccaaggttaggatatctgctattgactgatggacttactttgctgttctcaacatgtggcttccatctcagggtctaaagcagctgctccagtttaagactctcccagattaagagaaaaagacaagcatccttgagagctaatgccctattcttctatttatttatttttggggggactgaatctggctctgtttcccaggctggagtgcagtggcacgatctcagctcattacaacctctgccccctgggttcaagtgattctccagcctcagcctcccgagtagctgggactacaggtgcgcaccaacacacccagctaatattttttttgagatggagtttcgctcttgtcacctagggtggagtgcaatggtgtgatcttggctcactgcaatctccgcctcctgggttcaagcgattctcttgcctcagcctcccgagtagctgggacaacaggtgcacgccaccacacctggctaatttttgtatttgtagtagagacgaggtttcaccatattggctaggctggtctcgaactcctgacctcaggtgatacccccgccttggccacccaaagttctgggattataggtgtgagccaccataccccaccacagatgccctattcttttacagaaaaagtctggagggagctcccatcccttctacttatgtcctatgagctggaatttagttgcatgtcttatctagctgctagggagaactgagaatttattactagtagtgtgccacagttcagttcagagctctgaaactgactaaaaatgaaaacatttttaataggggtttcattctcagtgccccagttttgctgtttatgtagtattatctcaaagctattggatgagttaatgcaggtaaaagtacttagtacctggcacaaagtaagccttcagtaagtgctctaaatatcactatcttcatctttgtgacctgatagcaacagtgacagcaatccatagtacttctgtggcctctcctcagatcacttagatctagggaaagtaaagcctaaaaggcgacaatatttactatttggccctttcttttctttcttcctttctttttttttttttttaaagacggagttttccctcttgtttcccaggctgtagcgcaatggcgcgatctcggctcactgcaacatccacctcccgggttcaagcgattctcctgcctcagcctcccaactagctgggattataggcatgtgccaccacacctggctaattttgtatttttagtggagacggggtttcgccatgttggtcaggcttgtctcaaactcctgacctcaggtgatccacctgcttcggcctcctaaagtgctgggattataggcatgagccaccacaccgggcctactatttagccctttaaggtaacgtgtgcctacctctgtcttggaccatcatatgttctgccagctactctagctcctcccagtcccactgggtaaggagcacgatttgttgaactcttgctcaatctattctttaattttctttttttctttcgttttttttttttttgagatggagtcctactcttctgtcacccacgttggagtgcactggcacaatcttggctcactgcagcctctgcctcccaggttcaggtgattctcctgcctcagcctcccaagtagttgggattacaggcccacaccaccacgcctggctaattttttttgtaattttagtagagacagggtttcaccatattggccagtctggtctcgaactcctgacctcaggtgatctgcctgccgcagcctcccaaaatgctgggattacagatgtgagccactgtgcccagcttattccttaattttcaatttaaaactatgtaaagttgtacacaggttgttaaagcttgttttttgggttttttttttttttttgctattataatttgcacatacttattagcattgtcacagtcaatagttaccaaaaatggttatcaagaaagaggagaacaggccaggcatgttggctcatgcctgtaatctcagcagtttgggaggccgaggtgggaggatagcttgagcccaggcgtttgagacgagcctgggcagcatagtgagactccttctctacaaaaaatttaaactttagctgggcgtggtggcacatgcctgcaatctcagctactcaggaggctgaggtggaagcactgcttgagcctgggaggtcaaggctccagtgagctgtgattgtgcttctgcactctagcctgggcaacagagcaagaccctgtttctaaaaaaaaaagaaagcaagaaaaaagtagatatgccttcctttccattaacagggactcagaatgtggctgtttaaattgttaggtttttcccgtgctttgatgtgttttttatggctgttttcttgctttgtctgctaatgacttttctcgccttgtttcaggtgagtgacacagcgtgggcatcagcaatagcagaaccatcttctttaacatcaaggcctgtggaaaccactttggaaaataatgaaggtggagtccttagaactgtcatgtaatactattctatggttcagtggcatgctatgaaactattaaaaattaagatgggccaggcacagtggctcatgcctgtaatcccagcactttgcgaggctgaggcggggggatcgcctgagcccagcagtcagagaccagcgtgggcaacatagtccccatctctatcaaaaaaaaaaaaaactgaaacctaaaaatattaaaatgtagacccttctgtctttttttttttttttttgagactaagtcttgctctgtagccgaggctggagtgcgatggtgtgatctcggctcactgcaacctccgcctcctgggttcaagcaattctcctgcctcagcctccctagaagctgggattacagacatgcaccgcacatctggctaatttttgcaacatgatttcaccatgttggccatgctgatctcgaactcctgacctcaggtgatccacccgccttggcctcccaaagtgctgggattacaggcgtgagccaccacacctggccgacccttctgtcttaacaggaagaaatattcataatagactataaagtgggggaaaaatattactgaacatggaatataataatcatttttgtaaaaaaagaaaaacataccaaaaacgttctggaaagcacatagcaaattgttaaatagagagtgaaattactgaggatttttagttctcacttgatatagtgttgaagtgtctgaacttttataatgagtatgggttacttttatcatcaaaaacaaaatttcaatttaaaaacttataaaaatagttgatacataatgattcacatttggtgactttcttacaggattacatttattgtaaatatatcagttgcttacatattaaaaatcacttgtgacatgagtagtcagctctttctgttttaaagttgtgcatcctttgttaggccagaatgttagtgtaaattaacaacaaaaatgtaactttggacaactaagcagtgagttcatgggttatgataccttaagaagtgctggcttatataaactgagccttgaactactctaaggaacatagcgtaacaggaaagatgaagcagtcaccaaccgcgggttgggtgatggtattgagaaaatttctggcaaggattttgctggagggtaggagagtaagtggtatttatcaagaaagtagtcctaggagagagaggcactcagctgtgtcccagagtggagtcatgttgtaatgaaaaggagtcgcatagccaggcaggttgtgcacgcctgtgatcccagctactagggagactgaggcaggcagatctcttaagcctatgagtttgagactgcagtgagctatgattgcaccactgcactctccagcgtgggtgacagagacccggactctaaaaaaaataagaagaaaaagaaaaggagtcgcttcctttgtattgagttataggtataagggtgggaatgtctgagatttccatcaaacagtagaatgctgatttttcattttgctggtataggcgtagacatatcagtgaatcaggataagaacattgcatatcctaggtaacaatgggttatttgatgaatggaatttggacaagtgtctggcattttagaaacaaataataaaacaaagtagaatttcttctttactctttacacaaggctaaattcaggtagttcaaagatttacatgaaaatatgattatcctagaagaaaacatgggtaaagccttttttattatcctgaattgaggaagcccttctaggcatattcaaatctcataaaaggaaaaggttaataaatctgatgacataaaaatagaacatttctgttttgaaaaaatactttaaagtgaagacaaatgataaacttatatttgcaattcatatgtagacaaaaacggcttgtttccttactatgcaaagaactctgatgtggttgttttgtggatgatttgcaccctgtgattttttttttccacattctttttttaggcatatgaccgtagatgcctgcaaagaagacatttatacacctctaactggagtttagttttttgatttcttagccttacactatactgcagccacatttgcccttgggtgtttttctgcctgtgtttgctttttgttttgcttggagtgtggctctgccttgattggcatgggttgcctctttgttggggttcagctttaagaccagccaacgagcactcccagtcacaactgcatttgtacattttttcttcctcatagcatagcaaacaccagttctggaaattactgcgtttcttagtttgcatgtccactgtgtgtcccctctgctgagctgtgagctcttccagagagagattgttttttaagatgagaaatctacctgagccattgattgatttaccgttatcaatcagagagaagagaagaaagaattcccacaatctcctaacaaacaggaacagtgcgttatatatcttttgtgaaagtacagatgataatttaactattttcactattataatttattagcataaaagggctttgaggccaggcacagtggctcacgcctataatcccaacactttggatggctgaggcgggtggatcactagaggccaggggttcaaggccagcctggccaacattgcaggaccctatctctactaaaaatacaaaaattagccaggcatggtggtgcatgcctgtaatcccagctgctcagaaggctgaggcaggagaatcccttgaacctgggaggcggaggttgcagtgagccgagttcgcaccactacactccgcctgggcaacagaacaggactctgtctcagaaaaaaaaaaaaaaaaaaaaggccgggggctttgagattgagggttagccacaggagatatgtgtaacctctgaagtccggatgtcacagtttgttttaacagaaaccccagtaactaacacagaacaagaatttttttttttttgagacagagtttcactcttgttgcccaggctggagtgcaatggtgtgatctcaggtcaccacaacctctgcatcccgggttcaagcgattctcctgtctcagcctcccaagtagctgggattacaggcatgtgccaccactcctggctaatttttatatttttagtagagacgggtttcaccatgttggccaggctggtcttgaactcttgacctcatgatgcgtcccccttggcctcccaaagtgccgggattacaggtgtgagctaccgcgcctggccctcatctttgtattttttagtagatacagggtttcaccatgttggccaggctgatcttgaactcttgacctcatgatgcgtcccccttggcctcccgaagtgctgggattacaggcgtgagccaccacacctggccctcatctttgtattttttagtagatatggggtttcaccatgttggtcaggctggtctcaaactcctgacctcaagtgatctgcccgcctcgacctcccaaagtgctgggattacaggcataagccaccacaagcccagcctacactttatctatttttaaagtaataaataaaataaaattaaaataacaaagtatggttgggcgcggtagctcacgcctgtaataccaacactttgggaggccaaggtgggaggtctcgaactcctgagctcacgcagtgtgcccaacttggcctccgaaagttctgggattacaggtgtgagccactgtgccaggcttttaatgaaggcttcatagagttgctaaccaggatcactttttaggtaaaatagaataaacaaggcagatttcttggcaactgaaaatttagatttctatcactgatgtaattggtattagaatttccacatattaggccgggttcagtggctcacgcctgtaatcctggcacttcgggaggccaaggcgggtggaccacctgaggtcaggaatttgagaccagcctgaccaacatggagaaaccccatctctactaaaaatacaaaattagccgggcatggtggcgcatgcctgtaatcccagctactcgggtggccgaggcaggataatggcttgaacccgggaggcgaaggttgcagtgagccgagatcgtgccattgcactccagcttgggtaagaagagtgaaattctgtctccaaaagaaaaaaaaacaaaacaaaacaaggatttccacatattaacatacattgggtatgtatagtccacagaggtagtaagtatcttttgacaggtcacattaaatcaccagatcataaggtagaattttgaatcgtattagttgaagagaccactaacatttttatttgataaagccattggattaaaaataaacttctactttaatggacttttaagtcaaaattcttataacgttaaaatagaatatacagctaaaaaggtaggtgatcattgacaaaattggataagatatgtagcactgagcaagttgaattattatatattcaaaagcaagttagctgagtatattttctgcgctaatatcaatgttttgaattttcaggtggacaagagcaaggaccaagtgtggaaggtcttaatgtaccaacaaaggctactttaggtaatatgcttaaaatcctacattctgatttaaagtgtatgactcattaagaaaaaaataaatcctcttgcatttggcctgggcatctcacctgacggagtaatataatcatgaccgaatctgttaataagattttattaaacaaaagatactatatatatatgttttttattcatctctcaagcttccaacaaagatgctacattttaaccagcttgataatataaaatgcagcattgtggctgggggcagtggctcacacctgtaatcctaacgctttatgaagccgaggtggtcagatcgcttgagcccaggagttcgagaccagcttgggcaacacagcgaaaccttagctctacaaaacaacaacaacaacaacaacaacaacaaaaattacctgagtgtggtggcacacatctgtagtcccagctacttgggagactgaggcaggaggatcacttgagcctgggaggttgaggctgcagtgagccatgatcacaccactgcactctgccctgggtgacagagtgataccttgtctcaaaaaaaaaaaaaagcagcaatgtgcacatttagccaatatggctgctgatggttttgattcgtgggtttatgttgggctggctcaccttacggaaataagcagtggtcagaacatctacaccattcctttttactcaagaactcattttcttctctttctgattttattataggtgaacttaatcttaaatttttcattatcaaggaattataatttgtaattgttatatattccattgcattagttggaaagcagctgctttggtgaaaaataactaaactgttagaaatgctcctgacattttcatcatgttttagactcgtcagagtttgggagcaggttatgtgactactacaatacaaatctgaaagaaagtaatgaaaaggaaaactcccacaagcatctttttcacacttgaaatgtaatgacgttattctctactcacggctaaagattgttatcttttgctgtttctggctttatgctatcttttcctatcaaagcacattcttatctttatatgaaaaaattaagactttaattttgctgggtttcttagacataattctaaagacaatatataacctataagtaaaatgtactcagaaaatgatttttaagaaactttctctaaaagtatttttgtgcaatttagaaagtattgttattaaaataagagaatgctttatgtttcttttttttttttttttggagacagagtctcactctgtcacccaggctggagtacactggcacgatctcagctcactgcaacctctgcctcccggtgcctcctgggttcaagcgattctcgtgcctcagcctcccaagtagctgggattacaggtgtgtgccaccatgcccagcaaactttttgtatttttagtggagacggggtttcaccatattgtccaggctgttctcaaactcctgacctcaggtgatctgcccgccttggcctcccaaagtgctgggattacaggcatgagccaccatgcctggccgaggatgctttatatttattttggctaatatgataaaatctatatataagccaaggtgaaaaagcacgtcactggctgctttagttgtatacataatgcctagctaactttatttttattattgttattacttttttgagctagagtctcgctttattgcccatgctggagtgcagtgggtgcaatcacagttcactgcagcctggcccaagagattctcctacctcagcctcccaagtagctgggaccacaggcgcacgccatcacactggactaatgttttttgtttgtttgtttgtggagatggagtctccctatgttgtccaggctgcgaactttatattttcaaataagttttatgcagccgtaaaaaagaacagtcatgtcctttgcagcaacatggctggaggccattatcgtaaacaaactaatgcagaaacaaaaccaaatatcacatgttttcacttataagtgggggctaaatcttgggttcatacgaacataaagatgggaagagtagacactgaggactccaaaaggagggagggagagaggggaacaagagctgaaacacttcctgttggatactgtgctcactgtctgggtgatgggatcaagagaagcccaaacctcagcaccacgcaatatacccttgtaacaaaactgcacgtgtactccctgaatctaaaataaaaatggaaaattataatgatttttaaagtttttgggctgggcatgatagttcatacctgtaatcccagcactttagaaagccaaggcaggaggatcacttgaggccaggagttcaagaccagactgggcaacatagtgagctcccctgatgtctacaaaaaaaaaaaaaagaaagaaaaccaggcatggtggcatatgcctgtagtcccagctactagggaggctgagacgagaggatcacttgaatacaggagttcaatgctgcagtgagctctgatcacactactacactccagcctaggtaatggagtgagaccatctctaaaaaattgttagatttttaagtgttttaaagtttttgaagagtagcacttgataaaagagttgtggcatggtggctcatactcataatttcagcactttgagaggctgaggcaggagcatcacttgagcccaggagtccaagaccagtctgggcaacatagcaagacacccatctctaaaaaaaaaaaaaaaaaaaaaaaaaaatagccagatgtggtggtgcgcacctgtgatcccaactactcaggaggctgaagtggaaggctcccttgatctgggaggtaatgccactgcactcagctaaggtgacagagcgagaccctgtctcaaaaaaaaaaaaaaagttgttgtaatatattttttaaatgctcctgaagaaagtactgagaggggcaagctcaggctctatttctcttcagtgtgctgttaaaaaaaaaaatacattttctctgagtttggagactgcgtggaaatactgaggacaccattttgacaaagttctgttaatccaaaatatgcttatcaacttgagtcttctggatgagaaactaaagtggaaaatgttatcatctcttaaataataaagtgcagtatcttagaattttaaaagacacactaaaaaagaaaaattatttctattggtcttactttttaatttttattttttggcagaggtatcctctatcataaaaaagaaaccaaatcaagctaaaaaaggcgtgagtattatgtactttatatataaaaatctggtagttaagctttaaaactaaaaagccgcttcgtcattttagttttattcttttgaaccatcttgtaataaatgtagctttgatataaggagtctatgttttgttcaaagagattaatgttatacttattgaattttttctagaatgattatttaacattttttctgtctatgacaaaattctgaaaaaaattaacaaaggtcccctgggaatttgtctcctgcttgtgtagatcaataagcaatgacatcttgtgaggcttagagggtggttgtctggtgagttttcagatacagcgaagcattgcggagcaccagctctggaggcaggtgcagggtttgaatcctggccttgccatgtattggctgtgtgaccttggccacattccttaacttatatgagctttactttcctcagccctctgtatccaggggttctgcatccatggattcaaccaattgcagatcaaaattatttgggggggaaaaaaaaacaataggccaggcgtagtgactcacgcctgtaatcccagcactttgggaggccgaggcaggtggatcacttgagccccggagttcaagaccagcctgggcaaaatggtgaaatcccatctcttcaaaaaatacaaaaagtagccggatttggtggcccgtgcctgtagtcccagctactcgggatactaaggtgggaggatcgctttaccccaggaggcagaggttgcagtgagctgagattgtgccactgtactccagcttggtcaacagcatgagagcctgtctcaaaaaaagtaaaaaaaaataaaaagtaagaatacaacagtaaaaacaatacaaataaaaacacagaattagtaactattttcatagcatttacattatttaggcataataagtaatctagagatgattgaaagtatactggaggctacacgtgggttaaatgcagatactacgcccttttacgtaagggacttgatcatcgcagattttgttatccacagggtcgtgaaaccaattcccccatgctgagggactcctggaataatactaacttcacagagttctgaggactaagccacagaacaaatgtagagtgcttgtcacagtgcctggcaggtcctaacccttaggaaatgttagctgtagtcacaaaagctttcaaacagctcgtgtagactatagtcttatatatgttctagcttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaatgtaagtttaatttcattatattaatacattttcagggaataaaactattaactcaagattttgctttccaaatgccatgtatttttgtgtggggggggaagggagggtactgcaaaattcagttttatgaaaactgatattgcattggcatgtggattggaagggaaagagacgatgggggcagcaacactctgctgaggctgtaagggcaagactggagtgacatcagtgagaagggaaagacagagatgcatggaggtgtttacacatgaaacatgcttcacattattagagttggggaaatgcaaatcaaggccacaataagataccactgtgtactctctagggaagctataataaaaaaatcagtaacaggtgttggctaggatgtggagaaatttgaacccttgtacattgctgatggcaatgtgaaatggtgccactgttgtgaaaaacagtttggcagtccttcagaaagttaaatgtaaagtttccatgtgacccagcaaatctactcctaagtatatactcaagagaaattaaaacttacatctgtgcaaccacacacaaactcgtgcatgaatgttcatagtggcgttaatcctaatagccaaaaagtagaaataagctaaatgtctaccaactgataaatgagaaagaaaatgtggtatgtccatacaatggactattactcagccacaaaaaggaatgtagtcctgatattggccacaacatggataaaccttgaaaagtttatgctaagaaagaagccagtcataaaagatcacatgatatgattctgtctatatgcaatgtccagaataggcaaatccgtagagacagaaagcaacttactggttgccagggcctggggtgaggagagaatggagagtggctgctaatggtccaggcctgctttttggactgctgaaagtgttctggagttagtggtgatgatggcacagctttgtgaatgtgctgaaaccactgaatcatgcactttaacagggtgagttttacggtatgtgaattatatctgcataatgaaaaaagtatttataatctgaagccctgttggactctgtgactaaattctaaatacatgatggaagactatggctctggtcgtgtctccagaggttctgagcctggatcttggagagggagaaggaagagtttcagagaatgaagaaggtggaatgatcgtgtgtgtcgggggcctgcctgaagtggaggagttggaacgataatgtggagcaccttaaagtcaggctgtggttgtccacttacccaagagaaacagctccttcagcagtgctgtcatgaaggggcgtctcgggagaatgagttcggtagtgatacccaggccaggaagaggggaggagactggaagccaggaggccagtgaagagatcggttttccgtagacttttgtaaggctcttgagaggttttcatttgtgttgaaatcagaagagaaagatggccttctggaaaccgtgactgtaccaaagatcaggagagaagggcggagggtgcatgccacacagaaaggaaaagtaacctggatccctattttttatgtgtgtgttttttaatggtgttttctcttactttcatgtgtattttatctgttttagcttgagttactatagactgtatgatgaagaaaataacacctattttatgaggtggttttaaggattagtttaatagcttaaatgctcattgaagtgcatcaaacagtacctggcacatagtaggtgctcagtaaatgcaactacttttcgtactgtcttactgttcatactgacggttcgctaagatggagtttataaggtaaacccaaataatttgaagttgatagttgtttctccttgtcatttaattcacagaacatagggggcagcactgaactgtatttaggtcgaatatggtttgaaatgctttgtgtacaaaaatttacgttgacttgtcacagactttaatttctcttactaagctaagtttttgaccctggcaaagggaaaggttagatttgagtgtttcgatggcttctcttggtatttgggagtaggctctgtccagattactcatgcttgaggttttcccagagcgtgtgtaaaatcgggccctgatcagcttccttcctgcaagtaagctggatggagaagctgcaggtaagctggatggagtgaagtctggttgttacttctaatattaacatgctaatcttcctgaaaacaggaagcaacaaccagacttcacttgtatctttcattaggagtgtttaatacatcacaaaaacaaagatgcagatcggaagatttatgaatttgatttgagaagccagtttggcaactttcatggccttgttcagaacaaccacaccactgtgccttaatgaccaccactgccactcaaacccgtagaaagtacaggtgttttatccttaatacatgagtgttatgttgcaagttagtttgtttaatggctgtaaataaagttattt

SEQ ID NO: 12662 - DNA, 107750 bp, Human
actctaagtaggcattttttttttcttttgtcatacattttaagtaaatccttttttttcctttaaaagagtcctcaccgccaggcatgattgctaacacctgtaattccagcactttgggagaccgaggtgtgtagatcacttgaggccaggagtttgagaccagcctggccaatatggagaaaccccgaaagtaaaagtacacacacacacacacacacacacacacacacacgcaagcaaaattagctcggtgtggtggtgcgtgcctgtatttccagttgctcaggaggctgaggcaggagaatcgcttgaacccaggaggcagagatcacaccactgcactccagcctgggcgacagcacgagactctgtaggaaaaaaaaattccagttgagatgctttccagggcgctagtcaagccccgcatgcttatttgtgggagtgaaaacaccaatatttcgggattgttgtgaggactaaatagtgtctgtaagatgcacagagaaagcgtaaatagacgtcaatagcacttgttaggtctacacactccatttttcctctatattaatcgaattatttaaagattggttagctttttggggaaatgtctctccattgtattccacttattaggatgaactaccttttctccttgcttttcagctttctctgctatgaaaaagatggaaaattttttagcacaaggggactcttctcaagcagtaaatcattttgatattaaaaacagataattgcaaacccagttttatttcagtatgaattccgcagtggagtgtgaatatgtgtgtgtatgtgtgtgtgtgtgtgtgtgtgtgtgtgtgtgtaattacctgtgattcaaaagaggaaagggatcagtattaaaggtacttgtacactggaagcaaaaaaaaaaggaagtttagttcctctgagctccttggcaattatagctgctaaaggtagcttttacaaagaaactgcctttgtgcctaaagtatttatttccttgtttgtatttacccctttgaggaggaatcgctgtgtcttgagtgaaaggggtacgctgcttgcttgcattaaactgtgagggtccaggcgcattacggctgatttcagtaggtagagcagacacactttagtttatttttctctttctcactccccaccctcaacctccgatgtacacacgttttaagattccctgaagtcaggaggtgggagcggagagtttcagttcagatcttgacatgagagtacttcgaccaaggaaaagaaagggaagaaagagggaagcggggtggagaaagcaggagcaaggaaggaaagaaggaaacggggagggagagtaagaaaaaagaaaacgaaggagggagggagagaggacatttaaatgaagaaggaaggaagcttggattcagggaggaaagggagcgggaaagagagcgaaagaagagcgtgagaagaggcaagcattatagtctccggtccacaggggagagatggagccccctcaggactagagaatcccgaagagcccgtgtattgttttcttgaaagccccgaagctaagcaattctaaaaatgtttagcaaagcccttttgggaatggtgagatggggggtggggaggatgggacattttcattgccaccgcccgccccccgtctccccggccccctcacatgaagtgactggatttgggagacctagcggaaaccttcaggtcacccagggaactgctcctctctctggtcctgcagcggcgaggcggggtagggggtggggggggtgggccgtgagagcgccgagacgcgcggggcgcggagatgtgcaagtggcgaagcttgaccgagagcaggctggagcagccgcccaactcctggcgcgggatctgctgaggggtcacggtgagtctctgtgggtgcgggtcggagggatgcccaggtgcctcgtcgccccacggcccgggcggaggcgggtccggaacctcccccaagtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcccgaatcccactggtgagtcccaggagagcgagctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaaggtttgttttcattttggtttctgtcggattttctcatttgtaactcacttttctatttttacttttcttaaccggaagatcttttcattatcccacctcttcatcttgcttttaacctgatttcctattatataattaatgcttaaatctcacaagggttggtcggtgcggggctggtgtgtccttttgtagatgaaagtttaagacctcttaactggtttcagtctatttgtctggtttcaaaataagggtaattgcaaccaaatatccctctttagcttctcgatcaagtcgattcctcccccatatatgattcaaatggcaattttattaaactgaaaactagtacctgacttgcagcgtcagcatttggaaagtgcttgtcggcaaatcgactgtatgaaggcgtgtagcttcatcccctgccatttttgtgggttctagcactttaaaaaattgtctggtaatttcttggacttaaccctgtgtctttggttgtagagcagcactaaccaggggagtaatatggttggcacttcgtgtccagaactccgtatttcaggctgggaaacacctaattaatgtctgggaaacaagaagatgatttatcctgagtacctctgtcctcagcttctgcagacacagtttaaatatggaaactgtttctccttcttcctgtgcctcagtttccatagaacaaactgtaattgcatagcacagcttcaggaacctgcagatataagttaatgttataatgtgcagtgaagatgaaaactgcttagctaagtctaagtctgtaagtcaatgagatttcctttttaacaaatcagttatccaggtttcctgctttgactgtctgatatagtaatgcttatgctcaactggtataagaattgctgctttacattgctttgaaattaagcttacacttaaaatagtaatttattctgttggtaatattgtcgagctgaagtttgcaggttcttgttatcttagacctcctaattctctattctcgtctgtggcagtgtccacttttccgtttaaactttttatttaacacatcttcagttgaagtgaaatattttaagaatacaggtatgtttttgcgtaccctgctttatatgggactataagcctcaacttggtattttttttttttttgtattcttttgtttacttgtcccccttactcttctctatgggattgggtgtggttaagttggatattcaggtatttggggtttagtcatatgttccacagtgagattccagatactgtcccctgatgtcttaaagaaaaattgtgaaccttccagaattaactggaaatgaacgacaaagttaattaggagattaaacttgcatcatttctgcttttgctcaatgcttttgaaaaaaggctactaagagcaaaagacttcctttaagaatttacagggcatttacaagagggggagatggaggaagactttgcaggtgattcaaagattatattgttttgatgcagcttctgtcactgtcttcatttctctgtaactgtttctgcaaacttgggtgctgacccattaagagcccagctgcttcagtacccagtctcaagggtaaggaggagaagccaagggaaagtaacttacagggagaaagaaatgcttatccactagctttactacaccacaaggcatggagtttccacagagcacctgtaatttaaccctgaggctgccctggttcaccccttcgctttactttacagggacactgactgtcatttctaaggaagaactaagaaaaaaaaaagtccttttataccagtaaaacatttctctacattgtcttctgacatatgcggggggaacaatattcaggaaagggaaatactttagcaaatgtgcttaacattcaggtgttctttaggacagtcatgaaacatggggagactgggagaattattattgtttacctctctgtaaagtgtccagagtattattaaatttgttcccctctttcctttgcccaaccaatacactattaaaataggactacaatcaatgcaattccatatcataaccccaggggtggtgagactaagccagcatgccttacataaccattaagtaagacattttaacattcaggtacattacattccacttttatttagcagacacggttttcattgtgtaataaaatatttttatttgatagtctgtccttgcttatagcctcatgtaatcaaggggacagcatgtttaagactttgtatccagaactttaaggtctagctgtggttcgcttattaataattcactgggaaggttaatttctagttttctgctgggtctcccagaccatacttcaaatgtagaatatgtttcttctttctcctatgcctcagtttccacaaaacacacccttagagaattgtgtgtgttcaacaaagatctttaactataagagcatttctgagccgccacttcatcctgggaccaaattctaagagcaatttgtattgagctataaacagctaatctgctagtttaagatgttcttttatacagtcatgcagaaaaatggaaattgtgtgttctaatccttggagactggctgataaagtgtcactaggcccctgatgaaatttaatatttaggcttatatccccttaattttccccctaaatttctacagtacgcttttactgcatgatgatacagctttattttgaacagtgaccaaatgtgttctttacaaagaatattgacgagttgtgtagtcttgaacacgttgcctgacttctctgtgccccagtttcctaattctttattctattctgtggcagtgtccactttttggtttaaagtttttaacacatctccagttgaggtgaaagattttaggaatacaggtatgtttttgcataccctgctttatacaggactacaagtatcaacttggtaactttttgtactattttgtttacttatcccccttactcccctcttaaatgggattgggcgtggttaggttggatattcaggtatcttttggtacagtgagtgaccattttcagaatgttgtctaaccagttaatagatactggtatcagtagtagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaagggtgagtttaaaactttcttaatgatggtacagcaattatttgcttataaactgctgaattaatcctacttgagtatttaaccaagtcttactgtctaattttgctgagattttcagtgatataccaaagcaaaacaaaacaaaacaacagcaacaaaaaacaaaaggttgtgactgagacctgtcaaattcatttggctctatatactttgcattcagcaacaaaattttgacttctcaacagcaaaaatgtatttctattttaaaataactgagccttttacttttatccagccacattaagcatttggacattttcttttttatttatttgtttttcattattagtattttcattttttgcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatggtgagttactcccacacctgtgcatccataagtgcaaaagagaaggaaatcttcctccatgcttttaccatctatccaacgaatgtgttaaggatagaggcacttaaagactgacaaagagattcatttataaaatgtaacatcaatatgtcaaaataattaactttgaagtacggtgccttttatgtttgagctaagttattaattgcaagtatatttagtgcgctcacgcttacttatgaggaatctaaagtatggttttatttgattaaaatatacacaattttatggccagctttagtaatagtcattagtcaacttttgttgtgtcattgaaattctaaagggcttcacaggaatttaacaaatttaatttgagtcttggaagttttttacaacaaggatgaaaaaagattgattgtttaatggttaaaaaaatgattaccaagcaaaaacaactgattatttcaatttaataggcctggggcttcgttggtagagaagatataataacacatttttcttcataatcaaaattttaaatttagattttacttattttattttcttatattttttctaaccactgacaatgatatataatgttcagtttttagttcttgctttaagaaattgcttatttaattggcagtttttaaaagaacaaaagaaaaatagaaatttaaaaatttgtgttgccaatatttatgtatattctctcctttttctagatggtatttgcaagtcatcagactgcataaaatcaggtaagaaatggtttttacgtgtaatagttatacaactgatgtataatatttaaaattaaatgctaatcttaatttgctttgtttacacttttattcattgtagatcaattatttatgtgtctggctctataatcaatggaaataaaaatatatttaagtagtagattaattaacttgtttactctgaaaaatatattactattttcagccctgggctgtatagcagggcaatagaaaactatatcgctatttgtatggagcttgccatgtagttgaagaaagaaaatgaacacatatgaaatggtaagtttcgtatcattgtgttaaatgtctcagtgcacctcactaggtgggtgagaagaagggagtgagatgtaggcatgtaaatctaggtggagaagttaaaatctgggaagaaatttcattttatttattttttttattttttatattttgagacagagtctcgctctgtcgcccaagctggagtgcagtggcgtgatctcggctgactgcaatctccgcctcccgggttctagcaattctcctgcctcagcctcccaagtagctgggactacaggtacccaccaccacgcctggctaattctgtatttttggtagagacggggtttcaccatattgatcaggctggtttcgaactcctgccctcaggtgatctgcccccctcggcctcacaaagtgctgggattacaggcgtgagccaccgcacccagccttaaatttgggaagaaccttgaagcagggctagaatttagatgtggcggtgcagaagagggaattccaaacacaaaagaaagaaactatgttattgagaagtagtaaaagtgtacgcttgatagaaggacacattatggagaaccttgaaatccatgtttagccttgatattgtaatacaggagaaacagatatttttgaacagaggagtgatcaggccaaaggtgaaagatgattctgcgaatgtgaggttgactggattgagtgaaaaggagggcaggcaggtgggggctgcttctgtactccaagtgtaagctgaagaggttggcctgtggtgagagaagagtactattgagataatggggagggagaattgggtgactcagtagaactgacttgctaaataaaatgaatgaattgagaatgatgccaagttttaaaacccaagggactaaagagaatggaggcagcccacacagaaatagagaggttatgaggtggatgtggatgtgtttggtctaagatgaaaatagacaggaggaaggtagagatgaggtttaagaagctggaatttggatttgagatctgtcagtttaggagtgatagtggaagccttggaagtatttgagttctcaaaagaagagaagaggttcaagggctaaacttaagaagaggttcaagggctaaacaacatcaatgattagaagagaagaaaaataagtcagagcagaaaacagagaagtgtatgaagctatataaatcccatcaattggagtgtggtgaaaatgggagtatttcttctttcttcaagaaaaaggaaggtggtagctgagggcagcacctgggatatgaacacaatatttgtgtcctttaacaagagattctaaacctcctttctaacatctatgtgtcttataagaaataaataaactgttccaaataattttaaccattttctgctggatatttttaattttatttatttatttatttgaggcaggatcttgctctgtcacccaggctggagtgcagtattgtgatcacagcttactgcagccttgatctcctgggctcaaggcatcctcctgcctgagcctcctgagtagctgggactataggcacctgccaccattcctggctaggttgtgggttttttgttttttttgtttttttttgttttttttttttgtagagacagggtctcactatgttgcccaagcttggtcttgaactcctgagatcaagcagtcctcctacttgtcttcccaaagtgctgggattacaggcatgagccactgcacccagtcttggatattctttacttggatttttgttattcactgaactttgcaaaaaaatgacgggaaaatatctggcaattctaggttatagtctaatatcctgaatctgtgccctttggtttttttttttttttgtatcgttttttgatggatttttttgctctgggtcacaagagcaatgactagacaccctgagatgtgatgtggggagcgtgagggagacttgatttagatgttagccatttgctgctcgacatagtaagtttttcccaaaaacgaagtttctttattccccagggaaatggctgcacaggtaccttggctgggggatctccgtggtcatgtgcaaaagtcagcatgtgcccaagttgtcaaagttaacgtttacttcctccccagatcctcctatgcttcctctctctaccagctaccctattatatgctcaggctgtcctgtttcgggaaacttccacttacatattgactactaagggttaattcctctgtctttaatacacttgacatgtctctttggtatcttaatctatagattctctcttctctcactatttttcctttttctcttcttttccttgaattttattttcgaagaaactggattttttgactaggtaggtgtatttctataaacgacaagtgattttgcctcagagatctaggcaggtttttcctcccaaggagcaatgtgacattcagaatctggaatcttaaatgtgacttaatgtttagagataggatttttaaatagtgtttggcaagtctcaactcactaaaatgtatttaacctgtatcctttaattgtagcttagaaatcaaaccaaatgtaaaacaccttgcaggatgtatcttggcagagaaatgtatacaatagaaataacttcagtggtaaacaaggttgctgtatagctgtatatttttcttcattctgctctgttggttcacaagccattagaatacttgttcacattggtagttactattcttcctaggagaataaataagatgacacacaccctcatggatacactctgcatactcataaacacacacactcgtgcgcgcacacacacacacacacacagtcttctgctggttaggaaatcttttctgccacagaaaaatacaactatttcttttagaagttgttgcaaattaggaaaaccctagaggaaatcttggacaaaagcaagtattaaagaagagtggccagagtagagtagatggaaagaaaaagaaatgtgaaaagagaaggctgggcacggtggctcacgcctgtaatcccagcactttgggaggctgaggcgggcagatcacctgaggtcgagagttcaagaccagcctgaccaacatggagaaaacccatctctactaaaaatacaaaattagccgggtgtggtggcgcatgcctgtaattccagctactcaggaggctgaggcaggagaattgcttgaacccaggaggtggaggttgcagtgagctgagattgcgccattgcactacagcctgggcaacaagactgaaactccatctcaaaaaaaaaaaaaaaagaaaagaaagaaatatgaaaagagagatgttgaaaaaatataaaatatcttaccagcaagtctataggtcactttaagagagtgggtgggttcaaacctgagctcagaaattcttgagaatgggaaaagcaagtattgacactcagggtgcttacattatatgaaagatggccccaacttgaacctttcttccagtggaagggaatgtcatagcaaatgtacttatctttgattctttgaagtcaaggaatacagaagtcaagccataccaagacagaagtaaaatattgcagaaggctgtttcaaatctgtttggtgttacatatttaaaatctgagcatctaggatttaaatatttatgatgtacataaaatgatgtttatgtatactttaaattaacttgcctatatgtgtaatgcatcagtatgaaagattacaccagacctaaagtaaaacaaataccacttaagaaataacaacttaaggcagggatcaaaatgcttcaaagtattattcatcgcttatttaccctataaggtcatcaaaaacttagagttataaaacttgtatgtgattttgcagacttttccgtgtaagtctgaatcctgaaactgatttccattgcattgtaacctccctaacttagatttcaaggaatcttgtgctttaaatcagggtttctcaactcaatcactattgatatttttgtgctagataattcttcgttgtggatgctattctgtgtattataggatatttagtagcatccctggcctctaccaactagatgtccagtagcagtcctctcctagttgtgacaaccaaaaaatgtctctagccattactaaatgtcccctgcaggcagcacggtcacttatgactgggtaccactggtttaaacggtctcaagatgttatcaatgcttccctcttaacggtaggcaggataatggcctctcaaagatattcacacccaattcccagagcctctgaatatgttgccttatatggcaacatgcctgtaatcccagcactttgggaggccaaggcgggtggatcacttgaggtcgggagttgaagaccagcctggcctacatggtgaaaccccatctctgctaaaaatacaaaaatccaggcatggtagcacgcgcctataatcccagagggaggagaattgcttgaacccaggaggcagaggttgaagcgagccaagattgcacgactgcactccagcctggaagacagcgcaagactctatctccaaaaaaaagaaaaagacaacagagaattgaggggtctgcagaagcatatgttagaagtgtggtcctaaattatccagaggccagagaagccaagctaagacgtgatcaatacagtttacaagagaaagtgggaccacctccacctgtatagtcatgcaggttgtacactgcatatttgtcgatggcagccttgacagacaggcttgtggaacatcaagacctggatgaaacacctctcagaactgtccactccttttattttaattctgcacataccaagaaaacttttgatgattacttaattattaatacaaggagaggtggcattctgttacttgaaagatattttcatcatggtgagataatgcacagcggtccccttcttatcctctgaggatcccccaagacctcagtggatgtctgacactggactgaaccctatatatgctatattttttctgtatacatacctatgataaagtttaatttataaattagacaaagattaataacaataattaataaaaaataaaacgattataatattattccagcatcactattcttatggtttggggccattattaagtaaaatagggttacttgaacacaaacaccatcatcctgcaacagttgatatgataataatggagaaggctccttcgtgactttcatcatgctactcagaatggtgcgtgatttaagacatatgagttgtctgtttctggaattttctatttaatatattggactgtagttgaccatgggtaacaaaccatggaaagtgaaaccacagatatgggggagactactgtacgcacatactgatttaatcagatttgtgtgctttgagctatgaccctggaactgaaatgaagcttgcaaatgtctgcaagggccagatcatggtgatgccctaggtgatgcatcttggcaacagctagccttctcctggctgtcacaaggcatctctgccttcttgcctgttaacaccttgaaacctccatgaaggaaaacagcacaattaggtaaatacaggaaggactgatggctaactcatgggggctactggccctgtagcagccttttagtgtaggaaatgaggctatttcattatgtagttaagtttggaaaaaatccttcatggaataagaaagcagcagacatcttagtaggaagaccactgaagcacacctttgttaatttaaatgtggcatgtggcaatttgctttgtgtggcttccctggcacaattctcgtgaaaattgtgtagggatattaccttacatttatccagtcaaaattagcatctgtcaatcagatcctttccaagaaagggaatcagttatatcataaatacacaaatatataacatgtgttttttaccctccagggaaactttaagcaagtagtacaccatcattttttaatgaatggtcaagaaattgaaaacatatataagttgagttaagcagttaaagggaaagacaattagcaatgcctggtaagctaagtggtactccaaaggtttattttatagctacagaaattatctacatgtagagggggtggatacaaactagcttagactggggtgagaatcctggtttgacatttaacattttagaataagagatatagaaagattcctctgtagttgaaggatcctgttttgtcctactcataagcaaatccatggggtagcaaggtgctttctggtaagcctttgatatgatatgaagctcaagttgataaaacagattaattgaaggaaattgaaaaatacgcaatttaaaaaaccataaggagaatgttgcacaagcttttgaatcctgtaaattttcattctttaagaccattcagaaaaggagattttgtcgggggccagtggtggcttgttttgatcctatttctgaaccagctgaaaactagaatacgttctttctgttcaaaacatcctagatgggccacatattagtcaggccttctccagagaacagaaccaatggtatatgtatataaagtctcagtatccaaaggcccaagaacctggagttctgatgtctaagaacaggagaaggtggatgtcccagttccagaagaaacagaggatttcccctccctctgcctcttgttttatctaggccctcaacagattggatgatgctcagccacaatggtggtagagtgtggatcttctctactcagtccactgattcaaatgccactcttttccataaacatcctcacggatgcacccagaaataatgctttagaaataatgctttatcagctatctggatatctcttaacctggtcaagctgatacctaaaattaaccaccacaggctacagtgaaaaagatagttccaactgtgagtgaggatgcggagaaactgaaccatcatacattaatggtgggaatgtaaattttagtacatctggatcaacatgttagaaacattttgaaaaacagtttgataatttttacaaaatgttaaatatatactttccatacaacccagcaattctactcctaggtattacttaaaataaatgaaaacacatatcctcacaaggacttcattacagcataatgctgtttttataaataatttataaaagccaaaatatggaaatatcccaaatatgtattaacaggtgaataaacaaaatgccatatagctataaactacgataccacacagcaataaaaaggagcaaactactgttatgtgcaatggtgtagataaacatcaaaaacattatgctgagtgaaataagccagacacaaactgcatattgtaaaattcaatttatatgaaatttctataagaagcaaaactataggggcagaagacaaatattggttgcctgaggctggagatgaagcagggattggctgcaaatgggcataaggggacttcttggggtaatggaagtgttctaaaattggactgtgacaaattctcagctttttggctaaagatcaagtgtaaattggattgtggtgatggttgcacaactgtgtaaatttaccaaaaattaatcgggtgaattttatggtatacaaattaataacccaaagccgttaaaaaaaaaaagcaaacaaaaattcaccttcattctttcccccatctctccaatgtccatttttacatagttatctcatgttttgatcttatgcttgctattgtatgttgagtccattgagctccatttttgcagtttaaatgattatatgtagttttcaatgtagttttcaaatcttcactaaataaactcaagctttttagtttgagtgagcctctattatttaattatattagcaatatattgacgaaaagtctctggaaatagtaaatcaactgggaagttaaaattatttcaggattaggtgttggaagtcctgttttcaccccctggggtttcacttacagaggaagtcaaagacatatgtgtccaggtgtaccagccatctggatcaaagccagaccacttggtctaccacagagcagttagcagttcctgcttctggaaaaatgtgttggtttttcacacaggtgctgcgagatgttttccttttcaccttaactgatagaaagtcaagagccaggacgggcgttttggctcacgtctataatcccagcactttgggaggccgaggcaggtggctcacgaggtcaggagttcaagaccagcctggccaagatggtgaaactctgcctctactaaaaatacaaaaactatctgggcatggtggtggacgcctgtaattccagctactcgggaggctgaggcacaagaattgcttgaacccaggaggtggagtttgcagtgagctgagatcttgccactgcactccagcctgggcgacagagtgagactctgtctaaaaaaaaaaaaaaaagattgaaaaaaagaaaaaagaaaaagtcaagaaccaaatttgaatttaacttgaaattgtaggacttctttgtataaacttgcttcatcagctttattcctattcctcttttctttctcatacaatgtatattagtttattttatgtatccctctaaggccactttgaattattttaggaagaatgtaggttaataatcagatgaatagaatataaattccaacaactgatatgtgcaggagaagggctgttaaattataaactttatttcaaagagatgcaagtgttatgagtaacggaggcacaatttttggaagcttactgcttctttttccactaagccaacttttagcatgggagatctgggatgtaagttttggccacatcctgtgtgattggtatgagatcctaattaagtcagttcagctttctgcatttcattttcattatctacaaaattggaattgaaagtgtctcattttacagggaaacagcaaagactaacgacagcctatttcatgttacacgcccttcagggagatgcaccataggtataatgcacagataggattcatagacatcttatttcatgaaaattgcaaatgcactatttaaaattttttattgagaatcaaataaaaatcaaatcaaaaggcgaacagtgtatttttaaagaggaagttgtagccagaaacagagagaaagaaaaaagagaatgtggtacattttacatattctcaaataaaaatgtgtcatcctttatgaacaacatttgatttgattgctgtgctctgtcttagtatgggggtgacagttcaggctttgaatcaattagaatgagcacaatcagaaatgaacacttgaatctgtgtttcctgtaaagaaaagcctaccatcagggacaccttagtttgtaaacctagctaatctgcactcacccttgccagtaccccttttctcacctctgattaatcccttaaagtaagtaagtcagaggtctgcatcaggagaatgactagatccttggtattcaatgcgtggtccatggaccaacaacagcagcagccactgagaatgtgcaaaaatgcagtctcgggctccgcctcagacctactgaatctgtggctgcactttcagtagcctcttcaggtgatctgcaaaataaggttgagaagcactgaggaatagtgattttcaaatatggctgcttattacaatgatttgggaagcttttgaaatgtacccatactactaaaccttccattcttcctgggcacacaaagtttccatttcttcagtggagtagtttctgttatgtgttaggaggaaaagcaatttaagtaaatgaatagatgttaaggggtataggaattgcctggatatttgcatttttaaaagaaggtacatattgaccaactgattgctttaacaggttcaatttcagactgtgtgctcagtgaagactttaagttagagaggagtgaagactttaagtcagagaggagagacactgagcctgattttctgcttatcgtggacaagctgaacctggaatatcttcctaaatttccccagtgtaatgcaggcatgctatttctgtagagacattagaacaactttttgcctcttccattcattcatttattgatttatctattcattagttaattaattttattttttattttttttagaggcagggtctccttatgttgcccaggttgacctcaacctcttgggctcaagcaatccacacgcctcagcctcccaagcagctagaacaacaggcacatgccaccatacctggcattcatttttttttccacaaaagcattaatcaagcagcttctaaacattgaacactagacattggaaatatgaactaaaataccccctgccgtcaggaaaatgaaaacctggtcagtgtgacagacataaacaacattaccatatggtttgataagtgctatgatggtgataagatttgtgtgctacaggtgccctgagagaggagcacctaaaccagagcgggtctgggagtgggcagctaaagtgatagcaatgaggccgggaaagcagtcgcacttcaccagctaagttctgaaggataattgaattgcccaaccagtgggagcagaggagagcatgtgcatagtctgtatgcaagatggaggcaagagctcaggaagtttaggacctactagtggttcatgatggctgggatgtagaagctagcaagacttgatactagagaagtaaccagggcccaggtcacacagggtcttatatgccatgataaatgggttgcattatctcccgaagtctacagaaaatgaataaaattaaaatgccgcaggggacatctaagggattttaaatagggatgtgtgacattgtcaagattggctgctgtctagctcaagcctggtaaagtggaggcaaagatttacccaaacaaaggaataacattttggtgcccctggtgtgtgagagagcttggcaatattgagaaactgaaagaatatctgtaaggctatcatagagggtgtgtatgaagatatgagagtggaggcaaggagaagtgttcactattggcaaaagaaataagcaggaattggattttgtagtctgtgttaaagtgaatgcacttccttctagtagcggtgggaggtcacagaaggaagggttttaaatgacgcatgactttatcagaattattgagaaagatcactgaatagaaataaagaatggctgtgggcaggaaattgggctactgcacttatttggatgagtattatggttgcctggatttgaatggcaacagtttttattgttgttgctgttgtttgtttgtttgtttgttttgagacagggtctcactctgtcacccaggctggagttcaatggcacaatcacagctcactgtagcctcaacttccccagactcaggcgatcctcccacctcagcctcctgagtagctgggattacaggcatgcaccaccacaccccgttaagttttgtaattttctgtagagatggagtttcaccatgttgcccaggctaagaaatggacagatttgagaaatatttactgggaagtagaattcataaggcacaatgtttctgtaaataggtgaggttgtgaaaaggaagtgaggaaaaggtaactcaagtttctggcttggtaaattgggtgataagtcagctgttcaccaagctagggagcactgaagcagagcttattgggtaataggctgggaccaatgcagtgaagagttcactgtgagatagtttaaatttgagatactggtacatattcgatgtggtagaattcagggaagatggtgttggaaataaagattcgggggtcatcagcatgtggatgatatggttgagatttcttagggaggaaatggagaagagaacccagaattgcatcacataaagcaacatttaaaaatgagaagaggaagaaactccaaaagaaaccgagaagtaatcagagaggtagaaggaaaatcagcgaagtgtaaaatcaccaaagcaaatggaggagcagctgtccaaaattagagagtgatcattggaattaagcacagctgagaggttgagtaggctaaatgttgaaagcagaaaggaagacattgaagattcaggtgaagatcaggtggaaaattgatggattttgtccagaggaagtaaaagaggatgtatatccagagaaaagaatataggatgattccgagataaaggatggcctcctcctcccccttttatttaatactagggagaaagaagccaagatggctgaaatgcaaacatgtttggaagctaggagggacaggaagttgaatgggtcatcatccagttgcctttgtgaagtaacaaacaaaaatctccgcctgggagtgagctggtagagaaagtaagtaaggagagtatgaagactggaaagtgtccatgtgaggagtgggccatgcacacagaactgatggctctgttgaaatggaaggctataacttgaaatggcattaaaccaggcagttgtggggtttctccagcatcaccgataatggcttcaacagatattgtcagcactgttttagatgctaaggatacttagcacctaaacgcagagtgagcaacacaatgtccctgcttacaggagcttacagcagtaaaggagacagtaaataaacacacacacatataaaaaaacattattagatagactagagttggaagggaaaaggaaggcagctggatcaattcagggtaggctcatttgcagggggcaagggaatgaaatactttggtgagatgatggtttcagggatggcaccacaggatgtacactggacagaagatataaaagaaaagtaaagtaaaaaatagagtggctggctgggcgcagtggctcacggctgtaatcccagcactttgggaggccaaggcaggcgaatcaccaggtcaggagatcaagaccatcctggccaacgtggtgaaaccccatctctactaaaaatacaaaaaaattagctgggcgtggtggtgcccgcctgtagtcccagctactcgggaggctgaggcaggagtatcacttgaacccaggaggtggaggttgcaatgagccaagatcgcaccactgcactccggcctgggcggcagagtgagattctgtctcaaaaaaaaaaaagagtggccatggggtgagagttttcagtgaagtcgaggaacaggtgtagagggaataaagaaatgaaacaaacaaacaaacaaaaaacacttctaagaatcagaagattcttattggagaggggggttactcgagatgaagatttcagaggtacaactgttctgggtgatgagaacattaagatgtcgtcatgaaaatgtgtagactaatgtgaagtgaaggtgaaagttaggagagttcagatggtcaagaaattcttaagctagagtgtagcagaggttgtccacagggtctctgatgttacatatcaagatggtagaacttatgtggaagggcagactgcacaaagtgccagagtcttaaacaagcagagatgaatgcctctggagtcagtagaagacagagataaagtaggtgaggcggggatggttgactggcagaagcttaaataagcagagtggacagtaaggatttggctattgcaccaagtgataacagaaaactagttttgcttttccatgttggggcaaggtggagggatatgccacctgatgggattagttcatatggattagtattttcagtacacgtgttgtcatatgtaattatcactcaaaagggtaagcagcaactaataagaagaggtgctggagggccacctgtctggcatatagtgtgggattccatttgatacaattacaaatgaattcatttttactcatttttatcttttcactatcctagataaaaactcaaaatgaatcaatgagttcttatcttaaaacaatatgttctgtttaaacatttctcagcggtataatcttcctttaatcttacatttcttcaatccagaggagtccaactacagtgccttcaccgtgaagctaatgaaaagggagttggtccactgtgtagactagactagatgattgcgaagttaaattgaagtaattgagcaggtacccaatagccagcagcggatttgtttctctgttcttgatgcttaagtaaaaacaagcaagccaagtattaaatggtggagctcctgacaacacagcttcataaaaaagaaactgcttgactcaaggagtgtgtccttgcgatagtttgccgagaatgatggtttccagcttcatccatgtccctacaaaggacatgaactcatcctttttatggctgcatagtattccatggtgtatatgtgccacattttcttaatccagtctatcattgttggacatttgggttggttccaagtctttgctattgtgagtagtgctgcaataaacatacatgtgcatgtgtctttatagcagcatgatttatattcctttgggtatatacccagtaatgggatggctgggtcaaatggtatttctagttcaagaaaaccgaggcaataccattcaggacataggcatgggcaaggacttcatgtctaaaacaccaaaagcaatggccacaaaagccaaaattgacaaatgggatctaattaaactaaagagcttctgcgcagcaaaagaaactaccatcagagtgaacaggcaacctacagaatgggagaaaagttttgcaatttactcatctgacaaagggctagtattcagaatctacaaagaactccaacaaatttacaagaaaaaaacaagcaaccccatcaaaaagtgggcaaaggatatgaacagacacttctcaaaagaagacatttatgcatccgacagacacatgaaaaaatgctcatcatcactggccatcagagaaatgcaaatcaaaaccacaatgagatatcatctcacaccagttagaatggcgatcattaaaaagtcaagaaacaacaggtgctggagaggatgtggagaaataggaacacttttacactgttggtgggagtgtaaactagttcagccattgtggaagacagtgtggtgattcctcagagaaataattttaataatgtttgagtgaatcaaatatacaaatagtattgtgatgcagtgtacccacaatcattaactcaactatgaattactcaaagcactgtagataatagtctagcaaggatctgacaatatgttgagaagaaatgatgcacatgaaaccttgaaagtcaccttaaagaaactcatatcatgcaaatatgaatattttaatagctactataaaatagtagcagctgagtgctgtggcacacacctgtagtccagctactcaggaggctgaggcagcaggatcacttgagcccaggagttggagattagcctgggcaatgtggcaagaccccatcttcaataaataaataaataacttagtagcaattggtgctatgaaactttttgatgtagcttggatatttgtcctcgcccaaatctcatgttgaattaatcctcagtgttggaggtggggcctggtgggaggtatttggatcatgggggcagatccctaatgacttggccctgtctttgcaatagtgagtgagttttcatgagatctggttgcttataagtgtgtggaacccccccacccactctcttcctcccgttcttgccacgtgagatgcctgctcctccttcacgttctctcataagtaaaagctccctgaggcctcccaaaaagcagatgctggtgttatgcttcctgtacagcctgcagagccatgagccaattaaacctcttttctttataaattactcagtctcaggcatttctttatggcattgcaagaacagcctaatacattttgcatggtgcatatcaactatggtaataaagtgaaaacaaagaagtgggaagctttgaaaagttgacaaattggttgagtaccatatggaactccagctgtaggatcagtcccattccaggcccaggcactcactggggccaaggtcagtagctcaaacattccacttccagtcagccctactcttggtgatctgcctctgaccccagctctagtaaatgggtttctgccttctcccatagggatttcactcctggctcattccccacttctggaaaatgagtttctttttttcttttctgtcttctgggactgaaatctagcttagctcttaacctcatgaccttttgccagaccacggagaactgaagtttccttggatcaacacacaccatctgctggttatagctccctcctcacagctgccgtgggtgccctccctgtgtgacttatttctgttgcttgtagctgagaacttcttctgttgatggtcctttatagtttaactaaaccgggattcagtctcactgggctagtcaaaccacttctaccagagcccagtttatgtgaatgatgaatgttttacatggaaaaaaaatgtttcttcatttactgaggaaggagcaccttcactgattttgtatgccaacacagacagcgaaggatcctgcttgtccttcacctatcagccatcacacctattaggaggggggaattggtcttttgttttgtttatttagtaaaaggaaatctaattatatattaaaagttaaaaaaattttagatcctgcctacatgactttaaaatgagcaataaaagtcattttttattcagggatagtaacaggaaaaagaagctagtatcagaatgttttaagattccgatacagtgcatatgcaggttttagtttacaaatagcagatggtgatgatttactataagaaggtgtaattaattgagaatgaaggatccttttggagtgtccattatgggctagtcattgtgctaggcgtaggaattagaatcctttccctgggtgggggtatacttaaaattattgcttttgtattctatggattaccttgaaataccctttgagtcatttctcaaaaattgtgcatatcataccgatctgataactcattgcactgttgatctgaggcttcatcccctcacctaaccacatggtcatccattttgcagtccacaagagcccttcctggattcatggaaagaacttgctctcacttgggcttgagaaagcataagtcaacttggcagggcatgtgttaacaagatgatttagaactttgcgaccagccagaaccataaagacagcttgtaataaaagtaaagctgttctcatgagatgcccatgatgagggcttctagggcaaggctgctgtttcttgctacctcagcaagaatgaggtctctttcccatgatcatttccctccccttcactgggcagggtgacaaagaccaggcctctgctcccaccagtcaacaacaggcagggctcccagcatgccgaaaccttgagagctacctcttcctcctttatcccttcttcagagggtagcctacctgtccacaccggcagagagtcactctgcatgtcagtcctctttcggttgcctcttttgtcaaaaacgtcacctactttcactgcctgggacacagctcagaacctgactcaaatatttgttgaatggccaacggaatgaatgaattgccctctctcctctaccttcaactggtagctcccccttcattcccagagcatcctatacgctttacctataactcatatcccacttgttattagttgttcaatgtctggtttttgtccactaaaatgtaagttttgactgtttctattttattcattattctatttctagcacccagcaatgtgtaagttaccaataaatattgattgaataaatatactctcaggttccttaccttgaagtcacaaaactattgatgcctatgcaaggtgacttgtaagcatacctaatacacaaatatagctgcctcaaggaaacgttttcagtctagctaggtcctgcttatgtcagatttctcagttcagtatttctgtatcaagcctcctaggtttagcccctttctatctgatccatcttctttgctagcaataaagtcaattacgctcttctcagttgtctaattcaccttgctaattctaccctcctaagctagaactaggttaatgaggaaacagtttccggatgtgtttctatttcccactatttttctgtttaagggaaaatttcaactaattttctacttgggtgtaagcatttccagctctctaggagcaaagtctctatcagtctggtttttcttttccaactgtggtttgttctgaattcctcccttctcaataatttatttcttctctcttttaacactctgtgttcttcttctcttgaacaccattatttagctaagtgttgctgttcttcaacaaccaccatcctctaaaactcctctgtccctgctcacttcattcataacacacaaattcaaattcctagccagctcacgcatacatgcataaactcacttatggaaggacattacaagagactccttacctctaggttaggaggagctttacttatcaactgaatacagtaggagctttacttgtcaactgaacactgagtaagtttgagaattgaaaatgagacctgagcatcacaaaacaacctttcatatctagatatagttaccatctaggagttcacgtgcattataaaagaaatggtcttgtttaagatgaaaccctgcaagctctgtgagggcagggattatgtctgtttatcacaccatggtatgttcagttcctaagagtgtcgggtatatagaggccgtcaatatttgttgaaattaaatgaaaagtttcagtcttttcatgcttcacaagaagaaaatcttttggagaaagccaatgatttaacataatcttctggatcttctatgacagaaaatagctatttaatccgtaaaaaatataaacatatggagccaaatactgccttgtgccaatcaaatgtttggtttattaatagttactaaatttattagtgctctctagaaaagagcctttttagaatttgatttcattttaggcagcattcgagaagcactgtcgactcagctttcctctggctgttgtctttttgtaccactccctaaccaaaattgatgcaaaggcaggatgctttgagttactctcagtaatcacatattattgaagtcagctggttattcttgacagacaatatgatccaaaataacacaatgtttaaacagaaggaacatgggtgtggacccccattgctccctcttcagagatgtctgccagggtccagggaacttgggatctacctgaagagtgttactaagggaacaatgtagccttttcatgaccttctatagctttagtttaaaaaaggaacattatcatcatttgctaacattacaatcaacagcagatctgataactcattttaagtgatatattgtatttaaattacagtataatccctaatagctttttgccagcagagtctttcaggattcaaaatgcaaattgcacctgaaaaagaaaaattatttttagacttatggcactttaacttaactgtaacacagttagaatactttttattattattattattaatagaatatgtttcggttgcgaattctggaggaatccctactggaaaataattgccagtcctcccttggctgtgagccattcattgaaatggactatgagataagactgaagaatttcactaatttcgggagtgccaactgaagtttattattgtgaatccattagacatgagatttctgtgattatctcaatgagttctaaaatccaggtccaaatgaggtggaaaaattttatatgactatatacatgttatagagcaattaatattttaattgggtgtcaagaaaagcagtggttgctctataacttaatttgggttcctctgcctctctgtagagtttctgaaaatttttaaatgtcatttggagttaaggcagaatgatactgtggaaaaagcatcagcttaaaattagacctaggctcagctttagttgaattccttaaatttacattggtgacgttgagtttgtaaccaccccatacctagattttcttaaaataggagtaatatgtcctactttataaagcagttctaaggaagaaaaatgattagaacccaaggcagtttcacatagtataagatcccagacgctggccaccaggtttcttgagttcaaacccactgcattatcctttgccaactatgtgaacttgggcacaaatcacttaccgtcaatttctatatttggaaaatggggacacaaatatagttaccatacaaggttaaaagaaaacaaacattaaagaaagcatttaaaaaacagccatcatgaagttggcacttggcgtttgacatatgtcaagtgttggcttctattgttattattattattacatttaagcgtctttggctaaacctaaatgaaaatcctataatttacattgtatatttaaatctgatagtgaatttatctgatagcaaatggattctaggttgattattcatatgcttgtgcctacgtgtgtgtatgcatatttgttgtatgtataagacctatggatttaagataaattagtcacatgtatatatgaaatatagttataaactaattactccccaaactagaacagcaaaaataggtctccttacttaagagtacagctgtacagagtaaattcactatgcttggaaacttctttcatatctatttgtgtaagtctgcagctagtttctgaacagttgtatagtgatggtttcatggtactcaccaattagacaagtataagtcatgaccttggctttcttggaacgtaaccagtggttgacagggagtgtttgagttaaatgataaactagcagtccagtttacactcagcatctggtatcccccactctccatctttcttcaaccaaggcatcacaaaagcaatttgggggcaggcattttcatttaaaaatggagagtggattgtggaagcatcctgagtgtttgtaatgaaagccatttggtttttattagcattagagtctacgtgcttgctagttttcagtcattttctcttcaaaaatggttccccagattccagttttcacattgctgccttttgaattgaatcctttgtgacccgttgtgattacattgcattttccttgtgttcttttaaaaagttctgactttctctgaattgtggttggggggatggtgggaggagggtggcagcaagggaatagggtcacttgtacttttagaatgttgtcaaaagagatttttaaattgtcaaaaattgcctagaagtaatatcaagcttagtgtctgctaataaagcaaggatttacaacagaaggttcggtcagaaatgggtgtcctaaggtctttacaaaagagcatttgctcctgggttccccaacatttctctgacctctgttggacaattctagaacagttataaatcaggctaattataatgatgttaggatactggtgttgtgtgtttggggttaggaagctgagagcttaggcaatttgaagacaacaagctgaaaacagctttgttcatataccattccctaaacattaattcagtgcagattaagaatagtcaatggagggaccgggcgtggtggctcatgcctataatcccagcactttgggagactgaggcgggtggatcacgaggtcaggagtttgagaccagcctggccaacatggtgaaaccccgtctctactaaaatacaaaaattagcctggcgtggcagtgggtgcctgtaatcccagctacttgggaggctgaggcaggagaattgcttgaacctgggaggtggaggttgcagtgagccgagatcgtgccattgcactccagcctaggcaacagaatgagactctgtctcaaaaaaaaaaaaaaaaaaggaatagtcaacggaggaattttgtcatggcactgggggtatatatgtggtatgtatgttgtaaatagatgcctaacctatttaaaacgtggctaatttatagtgaccaagagtttttaaaatagagtagtaattgagaaagaaatggtttgtatctttttcccacttaattttctttcctgttttgtacatttttctagatgcttcaaaaagacccaaagaaaagaggaatataagcacagtcattactcattatttgtggattctctgtttgctaattcacctactccctaaaatgtatttattacccccaaatcactatttgcagctctctcacagtcatttacagacatgcacagactggtgaaaaaactttgagtctttctacacacatgtactcagctgagattgaacaagggaactatagacaaggatcctttttgtagtccatttagtcaacgttttttgcatttttgtgctttttaatgatgatttcactgttaaaatgctccacaaccatagtgtggaagtgctatgtagtgttttgaagcacaagaaggctgtgatatgccttacagagaaaatatgagcaatggataaacatcgttcaggcatcagttatagtgctgttggtgtgagttaaatgttagtgcatcaacaaaatatattaaataaggtgtctttaaacagaaacacacataaaacaaggctatgtattaatcatctgtgtgtccagaagcccacaggaacctaaccttgtatttcccctagggtcaatgattcagtattcactaattcagtgtagtagggactttatatagaacaaaactcatataaataactagaataaaccacacttgttttttaattcctgtgaaataattcatatgggaaaccatcaaagacctgctaagtaatgatgaacattaaaaaaattaaactgggccgggtgtggtggctcttgcctgtaatcccagcactttgggaggccgaggcgggtggattacctgaggtcaggagttcgagatcagcctggccaacatggggaaaccccgtctctactgaaaacacaaaaattagccaagcatggtggcgggtgcctgtaatcccagctacttgggaggctgaggcaggagaatcgcttgaacccgggaggcagaggttgcagtgagcagatatcgcgccattgcactgcagcctgggggacaagagtgagacttcatctcaaaaaaaaaaaaaacaaattaaacccatataatagtactacagcacaaaactttatgctatctattttgttcatttgctgtttgtgactatcatatttatgtcaactttaccctgttttattgacaagtacccaggagcacttgaaaatgtagaaattcctttaaaccctcccccctccaccagaaaacaagcctccagggaatgcacatatataaatattaagatagttgttgtgtatagtgcccaaaatcctattttcagttagcaaactattggtaatgttggaaagcaaggcatccagataagaaaggggagatcttgtggcttggaggccattcaaaggcagacttaaggttgcgtcttcttaagggagacatgtagtgggggtcccgtgtaactggaatttcaccatgtctaatcgtgtctagcagaccaatggaatgctgtgcctcaagtttcttctgagaggcctatgagcctcatgagatatcaacaaaaatgtttcttggccatcagaagagagaagtgattttgaatatagtatagtttttgctattataatcactccaaaaccaggcctgttggtgcttgtggttcttgagagaggaggccatggggggtgaaattcaagagacctgtttacctataggcacaagagccctcctcaagacttgagacaatgaaagatgaggaagggaggtattttccctgcatcatccagcttcagcacccagcgggaactggatcatgggtggtgtctgggtaggaggctgtggaggctaaagtcagtggagcagagtggaagccttggggtcgtgggcttatgcatgagacacatgtgaggttccgtgcaacactttaccagccaattataagggactgaagtcactgcaaaacataggttgccatgatgtaagcccatttgcatttgcagactgaaaaggcaaaaggaaatattcctgattcaagtaagtatgggactatacttttttgatattggatctgttggtcctcatttctatgtttctcgattgtctaatgtggtggttccccctgactgcacattagacccactctagaaaaccttaaaaaaatgtctggaccccctccaaagattctgactgaattgatcaggagtagaattctgggcatccgtgtgtctaaaaggcttctcagatgattcacatgtttagccagggttgacaagtactgtcctaaaacatatttctgagatttttcacactccattttccaatgtgctccaaagatagcttaggcaggaaccctgctacatggccacttcaaaaagatgcacccctgcatgggcctttgagtgcatccacctagcgtggcctccatgccacttccctgtctggttactccactataaaaaattcatctgcggactctccaagtcctcaagctgtacattgtcctgcctttgtcccaacaagaattgttggtgataagtccgacagtggagaggctgtggctgcagagtggcaggaaagagagtaagtaaaggagaagacaggacaaaggaagagtaaaagggtacttgaaaaggactggaaaggagggccctgcaaggtgctgcttctcacgtgctccccaccagccttctgcattcaaagcagggagggaagagtgtgggctcagagccatacatgcttaagtgcaagccttggggccccataatttactagctgcttgatcttggaaaaattacttaatcttgtacagctaaaaagtggtggagctctgggattcagaactggtctgtctgggttaaaagagcccaaacgtttttcccagcgtatactacatctcccaatccatacacacacaatagacttttcagtgaggaatacagtaattaataacttcccagatggtagttgaacttgcttttaaattcctatagtcaaataagttgggagaatgttacaagaagattagttagaaagaaaatggtgtcatttattatcagctcgaaacattcagaattgtcatttgtaagaaataagctcattattaatagaagattacttctcttgtctttgtgtgaccattttcttaaattaaaaataacttttttcccttactgcaaaagtaatgcatgttcatctaatacaaattggaaaataaaggtaagcaaataatacaaaattaaacacactcttaatccctccgcccagatctaactgctgtaaatatgttagtatatatccttctagattttctgtgcttttatacagattttaaaaaatcatagtatatgctctttcactttacaatatctggtcaacaacattccatgtcaatacatttgcctttactacattattttttatatctgcttattaaggtgaacaatttagtctgattttaaaccacatttgtttactcagatgtcagagatccacagataaggaaacatctgaagagcccaggtgtggctatgtggagaggttgagtaattcaaaacaaagtacaaaacataaaaacaattacgaccagtttgacagttgtacgtctgtttcctacggccttctacccacaagtctaccgctgacttcaaagaaaagtcagcacagaggaggtccagaggataaggtgcaaaacgagaatcaaacccacgataagagattaaaggaaggttgatcaaagacccagcataaaagtgctagcccgtgacttgccttggcccatggccccaaaatattcatcagaacagagagcgctctttgaagtgattggatgcatccatgctcagacaagctcggtggtcaaagggaaattttaaagagtggccctggaaggagttagcaaagttgcctcttcctctctctgctctgcacatccctcacaaactgaatgttatttctttggtttgttgtgcagatgcaagtaatttaactgtactttttgccccctgggagatgtgggaagtacagttgcttttacaggatggagaatttgcactcatgatcagagaactgaaacttccagccatcctttttattcagagtgtttaaggaccggtggtatttccaaataggcagtagggcttgttcatgctctgcttgttcattctgcttgttcattaattgttcactacttttctgagtagagttcattgctctgtgatgtcgtgacagaagctttcatttccccagaaagaggaagaaaacagaagtgccccctccaaatggcatagccttcacaacattcagtttaaatgtttttaagtatcttaaaagagaagagttatatattgctaagtgtgttcttagaatgtctgtagttagcacttctttcaggctctagttttctggtttttcactttacataataatcctctatgtatttaggatctttatttttcacctttcccgttaccatatttttatttccttcaaaattcgagggaattgcttttttctctctaccttttttagatcagtttcctagtctttaactgaggtgttaaagttggagtttttactggcaagtcttgactgagcacagtgttaggctctgtgagagagaatatgcattttctattttcacagagccacagtccaggtgaggagataatgaatttgcatgcaaaaaatgaatatgttgtgagctgatacagacttttgtcaggccagtctttcataaagaagtatttggaatgggctttgaaaatgcctgaaattccaaaatgaaataatatgaaataatatttattagtacgtataggggctgggtaacatgctcaaagttacagaggcagaaaaccataaggtgtctcacagaaactgaatatactcatttaactgtgacagatggctcatgcgagaaagtagcaaaggagaagcttcattcgttctattagtgttagaatgtgctatagaatctggattttattatgattgcaaaaggatggtattgaaaactttggagtggaaaatgacattctgaagtattttgagaatatgaatctgcctgtggagtacagaatggacataggtaagaagaggcctggggccacaactttgtcaaaagggcacaaatagagtctgagagaaagagggtttgagacagaatggaaacaatgggaaagatggaatggactctggaggcaatgaactgagaacggatctgacctctgtggcaaggggagaggaggtgagtgatgggctgtaagagaaggtggtaagaagactcatagatgattcagtcacacataaccataattgcacccctgttacctaggtgctaggtgatacaaagagattaatcacatcaacaaaatggttaggtagacagagtaggtatttacaatgaaaaactcaaagtagtctcacattgaagacagagtgaggcaatgagctctcaggagtcaagagaaatattccttgaagtttggagtcacagaagcatcagggaagagatggaacatgagctgaatgttgaatgatgggtagaatttggaaagaatgacaggggcaatcaaagctgtgggatgaggaggttaaagcaaagacacaggactaagaaaacacaaggagtgtttgtgacacattgacgagggccatctggttggaacagagtttgcataaaccaccaaaagaggaaaaggggaaggtagggtgatacgtttattctggtaaaggtttagacaccaagctaaagattttatttttatttctgagatagtctctctctgtcacccaggctggagtgcagtggcgctgtcttggttcactgcaacctccacctcccgagttcaagcgattctcctgctttagcctcctgagtagctgggactacaggtgcctgccaccatgggcagctaatttttgtatttttagtagagttggtgtttcatcatgttggccaggctggtattggactcccaaagtgctggaattacaggcgtgagccactgtgccctgccaagcttttataatttaacctgggaaatgtcaagccactgacatttttcagcaaggttgtggccagtgtcaaagagtctttcgggaagtttggtttgtggaagatgtgtagaatatatcaagatgaagaactgggtgacttctagtcaaaaaggaatgatgatataaaccaggtaccaatcagaatgagaggtatggaagaggggcaaaggaattaccagtaaaccaaggggaaatagaaatacagttttacccaaagtttcaaatccaggaggctatgatagcaactgtgctgtatactaaggcatacaactcatgagatgactggtttggtaacagtcctgagcgttttgttttaaagagctgggtcctgaggttccagacaagcaaacatgccaaaaaagtggttcaatgggggggcttgaggctcagctggaaaccatgtttaccataccaagtttaaaaaatccacacagctcagcaattgtttgaagtttttaattaattaattaattcataaagtgaagtattttcaaaagctcatctgagagcttatattctcttgatacagatgaattctcaattgctcttttgttttcattgcaaaacagttcaacttgtatgagactcaaagtggggagggcaggagcagaattttctctgttccgggtatagacattatgggtattgggccatattctcctcttcgttggtaataattcctattttatacatctttctatcaattgcagctcctaccagagtcaacgtcttgattgtaaatactcagtgttggttgatttgcattttcatcatagtcctgaaagataaaagtggacctaagaaaaactaataagcttacagccagttttataatgacagactctatataaacaaatgcaaattggatgtcaaatttgaattacaaaatttatttgagcaaggtccaggaagtaataacagtgtcttcagatcttttctaaaatgataaaaattcattaacaatcttccatggcttggagtctcagagactttcaaaagtcacagcactttgaagagcagagttggcaactaaagttatcagagtgaagaatggcatgctaacctcaggtgcaggatggccaactcaaagtagacctctattctttgttcttctgagataggaactagccagaaacttagttattcaggggtggggtgggaaggctgtgggacccagggtggaaggacccacacagttcaaaataaaacgaaccaactatagtgaaggaaaagagaactatacacagatagtattcctcatccccctgaattgacttatataaaaaagaaaacggagcatccgacaaattgatgcaatcaaaagggagcaataagcctttttctccttttaagcctcttaagaaataaacccatcattttatctagtgttttctctgctcttgcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaaggttagtagagattgtgtctgtgcatcaaagatttctctcttaatatgttcattttttaaatatacaattgttagccattacaaggaatgtcacagaagattaaaaagttaataatccttccaggatttgtgtaccaccaccaagtcactctgatagtggcagacactgaaattaatgtgttgacatctcttagcattcctgctttcatttgtaggtatgcaaataataaagcggtatcatctctagagatggcaggtttggttttttgtttgtttgtttgttttttgagatggagttttgctcttgtcacccaggctggagtgcaatggtgctatctcggctcactgcaacttctgcctcccagatttaagcaattctcctgcctcagcctcccaagtagctgggattgtaggcacctgccattacacccagctaatttttgtatttttagtagggacggggtttcaccatgttggccaagctggtcttgaactgacctcaggtgatccaccagccttggcctcccaaagtgctgggattacaggtgtgagccactatgcccagccaagatggtagttttatgccattttacagaagaaaaaaaattaaatgattggcacagaaacctacttctgtagtctccctacccaaaccctgtgttaaagttactgtaagatgttactaagatttgccttcccagcacaggtatattctaacctggctaagactgtctccctgagaagttaagaaatctagccaagtccctcctatcctttgttctctgttctcccctcttctagaagttattttgtagaagaacaatttttgctactttttaacattgaaacaagtaggacaattcaattcattcatttggagcatgaacggtacagtcacacaaagataattattttccagccatcaaaaagactattcatactaaattccaaattcctctgtgttattgtttttttttaatctcaatttcaagaaaagtaactgttacctatggcagagccgtatgcatcactgttcataaaaaaaaaaaaagataatctagtcaaaaggactttcatctaaattggctgattaaactgactcccagttctgtgctaggaatgataatctggtaaggggtttggtttttcctataatgttttggaactggggggaggaaatgaatgtacctccagaaaagcaaggtttttttttaactgaacccactttgcaaatgttaattactgcaaatgagcaattatgtttgcatagtgcaaatgagcaattatgttgatgcattttattaaatgtcctatttcagatgtccttcaagaacccaaaactgaagatatagtagcagtgcagaaagcaaaagcattgtacaggtcttgtataaatgaatgtaagtgctcttcatttgatttcattaggagtatatatatatatatattggtgccaaactatgcctagatttctaattgaatttatgtttgttgtttccaaaagctgctattgatagcagaggtggagaacctctactcaaactgttaccagacatatatgggtggccagtagcaacagaaaactgggagcaaaaatatggtaaggcaattttcctactaaaaaagaaatttccatgtaaaatctatgttataatatcattagtgaactaaagcttctaaagatatattttatcttttattgctttaggtgcttcttggacagctgaaaaagctattgcacaactgaattctaaatatgggaaaaaagtccttattaatttgtttgttggcactgatgataagaattctgtgaatcatgtaattcatgtaagtttgtgtgtcaaataactaaagttacctttaaattgtaataaaacttccacatacattgttgttattgatatttagaaataatgctattttcaattgaattgaataagcaaggaggtagtatatccatgctctgtccctaatacctggagttccaattttgaaagtattttcttaatgctgttttcgacattcaccccttgcttctgctacctctgttttagatacctctcccttcacaaaacaaatgataagaagggctccaggcccctcctattcagaaaaagttcctaatttctttgtatagtacttgaaaggagcatgctttcgtttatagaagtaatgcaggtctagaaaccaaaaaataataattgctttcaaaaagaacacagaaaagggattttaaacatcatttttttcctcactaaagagtatctgtacttttttctcaactaaaggtaaataaaatgcctttcttttaaaatggatttattgtatttttacaaatgtaaacaatttgatttaggtgtcacctaagactagattaatgactatgtttggaatgtactgaaaaatataaagagtttttctttcttcctttttttttttgtttttttttttttttggtttcctgtgtaagaaattatacaaaaaattgcaggctactgaatcacctaatcatatctgtgtcactattgcataaatctttatggtcgtttttgttaaaatcatgaaaggaattgaacccaaatctcctgcagtgggctctctctcttctgaaactttctccttgcaggatcaccttgaggaccagggggtggggaaggatcagggcccttcatgtggagatatcttctggctctttccataccagttctttgggttatgttttcttttctattggcctaggctctccacagctgctaggattctctctttaacccagaaatgctctgtttggcctccacactcatgttgccatgcagtgagtaggaaacaatcttgcaaagctgcagtatgcccagatagctcccacttgggtattaaacatggaccagacacgttagcgcaaaactgagtttcctctttcacacccttaactgctatctgggtctactgaggttcttctgagcagagcagctttgaggagaaccaaggagaagtcgcctccattcccttagggtagagaatcttaaaaaacattttctggcacaagttacattagctaaaagattctggagttaccttagaggttttccacttctccccttctccccatccatccaaatcaacttgaagaatattaacccactcccaccaatgaaaggggatcccaactaagggtggaagcagatgagaatgttcccaggggagcacattagaatctcaggaagctgagaaatctgtgaatatgtaatttagaaatttccacgtcctagaatctaacatgtttttgttcacttgcaccttctgctctgcattaaaaatccctcctagtaaatcttttgttcactttcttttgttttccttaaatatctgcagcacagtcctccagattatctaactgcccgttagtataacacttacaagtagtgtagaaagcatttcctaactaggtatttattgagtgtctgatggtcaccccataaacagcaagagtaggatctttcacatacatagatagacatgcttgtatttttcaaacttttctatattcactgaatgatttattttcttttatgtatattttttatagattgaccaacctcgacttggcctcccttctagagattactatgaatgcactggaatctataaagaggtaaaaagaaaaaaaataatcaaaaccaaactacaaaatgatctggtgtaaacctacaagtaatgaaaaagataaagccaaattaaatttagccctctgatgtttttcattcatgacagggacttaaaatcacacataatagtgagctgtctttgatagaatgaacattctcaatagaatgaatgaaggtattttacaaaactaggaaacttgaaattccttatttgtatcttggtttttagtatttaaaacatatgatcgattttgaaaagttaatttaaaatattttaatccacctgtaaactgcattatttaaaaaatgaaaagatttatcatggtctagggtggtgctggtgaggaccagagggtcagtgagagatacactctgcagcatccttctggaaccatctgatttgactgtcagagaactatgcaggtagtgacattgggctcagacaaacttttgcagctaccttgtgactctaacattggccaggtagccagtgggcatcatatcccatagtggacgtttggatgttctggagtgctttcttattgtctcacaaccttgcctcccttgggctgatgttcacgtgctctttttttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggatgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttaagttcattgtagattctggatattagccctttgtcagatgagtaggttgcgaaaattttctcccattttgtaagttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaagaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatgaaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcttctgcaaacagggacaatttgacttcctcttttcctaattggataccctttatttccttctcttgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcttccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttatagtattctctgatggtagtttgtatttctgtaggatcggtggtgatatcccctttatcattttttattgtgtctatttgattcttctctctttttttctttattagtcttactagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagttttttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatgtgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactgtttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatactggcccccactctcttctggcttgtagggtttctgccgagagatccgttgttagtctgatgggcttccctttgagggtaacccgacctttctctctagctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtataccaatcagacgtagatttggtgttttcacatagtcccatatttcttggaggctttgctcatttctttttattcgtttttctctaaacttcccttctcgcttcatttcattcatttcatcttccattgctgataccctttcttccagttgatcgcatcagctcctgaggcttctgcattcttcacgtagttctcaagccttggttttcagctccatcagctcctttaagcacttctctgtattggttattctagttatacattcttctaaatttttttgaaagttttcaacttctttgcctttggtttgaatgtcctcctgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtgcttttatctacttttggtctttgatgatgatgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgtgtgctgggagaaccactgctctcttcaaagctgtcagacagggacatttaagtctgcagaggttactgctgtctttttgtttgtctgtgccctgcccccagaggtggagcctatagtggcaggcaggcctccttgagctgtggtggactccacccagttcgagcttccgggctgctttgtttacctaagcaagcctgggcaatggcaggcgcccctcccccagcctcgctgccgccttgcagtttgatctcagactgctgtgctagcaatcagcgagattccgtgggcgtaggaccctccgagccaggtgtgggatatagtctcgtggtgcgccgtttttaagccggtctgaaaagcgcaatattcgggtgggagtgacccgattttccaggtgcgtccgtcacccctttctttgacttggaaagggaactccctgaccccttgcgcttcccaggtgaggcaatgcctcgccctgcttcggctcacgcacggtgcgtgcacccactggcctgcgcccactgtctgggactccctagtgagatgaacccggtacctcagatggaaatgcggaaatcacccatcttctgcgttgctcacgctgggagctgtagactggagctgttcctattcggccaacttggctcctcctccttttttttttttttttttttttttttttgagacagagtcttgctctgtcctgtcacccaggctagagtgcagtggcgcaatcttgggtcactgcaacctccgcctccctggttcaagcaattctcccagcctcggcctcctgagtacctgggattacaggtgcccgccaccgcgcccagctaatttttgtatttttagtagagacggggtttcaccattttggccagtgtggtctcgaactcctgactttgtggtccacctgcctcggccccctaaagtgctgggattacagatgtgagccaccacacctggcccatgtgcttttcttacagaaagtaaggaacagcaggagacaaaactaataatcttacacgttattagatattggggaaaggtgttggttctacaaaggtttgtcttataattattttgtagctcaaaagtaagttatctttgatgatcctaatggctcacagtgtagtgatgtgactaaaattacattttagttaaaattactagctaaatatgtttatgattggcatttattttgccaaattatgaagttcgaataacatggaatgaattcactgtaaggtatctttttgaatgactacacaacactgaaatgaagaaaaagatatatcatcaaaggccacaattaatagcacagataaatacatgggtatgggatatttgagttcagtacaatctagttgctgtgtggggtacagctactggctttaagagcaatgcagctgctttctgttacagatttgaaagtgattgaggaattttggttcactattgtacatttttatcaccatgaactgggatgcttttcatatttaggattgtgttcttatatcaaatttttcaaatcctatgatacatattttttttacattttaattctgatatcaaggtatacctggcagtcgatgtatatatttaaggcagtaaaagctttttttttttcattgttaagatgttgcatttttgcattttatactcaatgctatcccataatctcaaacaggtcacaaactggcagtctttggcttgaatctgatatagaagcatttttgtttaacctgtagtgtttttttttaaattttgaattagttgtcaatatttttcaaaattgaaagatttcatttgagaatccagatttcttagtaagtcagtagaatttgagcccctagcttgcattcttatatggcagcaattgaccagagtggtgttgtggttgctccttttagaaagggcatttattggctgggcgcagtggctcatgcctgtaatctctgcactttgggaggccaaggcgggtggatcacctgaggtcgggagatcgagaccagcctgaccaccatggagaaaccccatctctactaaaaatacaaaattagccgggcgtggttctgcatgcctgtaatcccagctacttgggaacttgggaggctgaggcaggagaatcgcttgaacccaggagataaaggttgcagtgagccaagatcgtgccattggactccagcctgggcaacaagagcgaaactccatctcaaaaaaaaaaaaaaaaaagaaagggcatttgttctccaggtttgaacagttttgaacagtcctcatcaacatgattcatcgatttatattgacttatcggctcctgtaggcacttgattttgcatattagtctggtcttggctaagccacagcagtaaaaacacaaatacagtagctcaaacaagaaaaagtttacttctgtctgtcatgccagtctggaagtaggcaggccatccagatgaggcaggaagctctgctccatgggaatgtctgggagccggctttctttgattttttgctctaacatcaacctcctctggtgtttttcttagtctatttggtcaaagttggttcaccagtgccctattcacatgtcaggccacaggaagaagaaaagagagaaagtggtagacaaatagttaacctttatgtaaatggcgcagaacttgcatacattccgttgcttaaaacattgtcatgtggccacaactaaatataaaggaggcaggaaaatgtagtcttgagcagtggccatgtctgtgtcttgttaaaacttggttggcagagaggaaggtcgtatcatttaaaagatgaggagtacatataccaatgtcatttagcatactctgccacagtttacatccactgatctagggaatactgtatttgtgatcaaataacacagtggtgatcaaatctagaatcagtaatatgtttatagagtttatgagtgagaaatctgagtctcagaagtttgctgtcaacactcagcagaacagtagtatagtggcaaactttggtccttctctcttcttcattctactacattattacaatttcttaagagttggtacttcatactagtagagttctttgaatgagcaaatgatagaagaaactaacctgcactggcacttacagcccggaagttattctcagcttaaattaggtgctcttcaacgatctgaatcagactagcaaacacgcagcatgcttgctgccttgctcctcttccataactatgtacttttggtgacatccttctttcctgctaacctgagatctcagaattcttcttaaggtagtgcttcaagctgtaagcaatctcctttcagtggaagggagttgcataaaaataaaagttacatgtcatcccagaaatgggtaattatctgaatatttctgcaccctctccctttttttaaatccattcttttgggcatgggggtgagagcgtgtgtagttacagtaagaattccaatgttacccttatttttcccatgatattttctactctctcctaatccctaccacctgcaatccctcagtttcccctgcatttctggcaaaattctagtttttccactactctgctatctttgaaagatgtcaaccaccttaagtatttctgtcttgtgtcttattgcttcatgaacaaaaaatggtgcgaagtgtagaataacaagtttaccttcagtagaggagttataaatctggaaggaatgttaatgtcagtgtatcattggccttcaatgattttctcccttataggcttttatatatgcttttccctttgcctagaacttgccccccacacacaccacctgcctacactctttcctctaatatagttttcctagcacccaggtttctgtatacttcttatttaatgtctttttttttctataaaactgtaaatgaagtggaagcaatgctgtgtctcattgccctttgctctttttctaatacctaccaaagtttctggcccttaaatactacagaatcagcaaatgaatgattgagggggaagatagcagggaagagaggaaacaaaagaaagaagaacccaatcttttggaagccctccttgtttccttcccttgattccgggaaacatgagctctagggcatcaatagctaatagcatacatttctttagcattttacaaactctgtgttctcttttctcttttcaatccccagttacttctttgctaaactcagtttgcctgaggtatatttatacaatcaatgggtatcatacatttgcagtttacattattttattggaaataatcaagagaagttttgagaattggcatagggtcaccaactttttttgtcaaagaaagatggtcttagaccagagaggtctggcttccttgcccgtcgctttagcctataattttaaaactttagtgtggggtctaccttctgcagatatgcctcagaggctgaggatcacagagggtcacattccctcttcagtcaaaagtactctaatcgtaggtctcctttatcagattattaactcagcctgtttccccaggtcttctttgatccttccttccaggatatccaggtcatccagaggtatcatctcccataatcttaaaaccaaacttcttatcgactatgaaaatagcccccacaattactaagaagatcatttcactttatagaagtcattttttttttgctttggataccctcataatggaatttttgtattgtaatatttgattattattataatctagaaagggaaagtgatagagaacagttgcatcatctcagaaaggggcccacattcaccgtgtctgctcttcctaacaaactgttctcaagatgttctcatcaaggagcttcttgtgctatatctttgttaaagagatggagcctgagttctgaggtattctgattatctgaagagattacttaatgacacaatgctatctcaaagaacagaagtagggagattcaagacaattctattccttacagaggtacaaatttctatgctaggaaaacaatacgaaagatacacatggcccataaacataaccattcccattcacaaaatttgtaagtgaaaccaaccagcaacctcatgtgagaatgttcttctatattgattcactgagagaaatgaggaccttaattttcttaagaaatcacccaccttcagaagagtctgaactctgtattgggggtgaattggaattggtctcaaagcttccctttctctaccttcttagcttttcaagagcaattgttatcttactttgttgtccttcataaggaaatctgaagattaggaatccaaaatatttgagcataattacataatagatatgtttatgctctgtactgatgtttgcctgagaaggagcaataagtgaggttagtggtttccaactctaaggactactttgtgtgtgccaattacagggctctgtgcagaaacacctcacatgtacacacacttcaaaagccactatgatttatttttacttgtgcatttatacatccacaaaacatttctttgagtagagcatttcaggtctaaaagaaaagtaagaaaaccactcaggctagagtttgagagcataaggaggcgggaaaggaactggagagtagaagctacagggtatactgctgcagggcatggctagggagaagaagccagagttataaagaagtgtagagccttcacaaaatctgaggttcataaaaatagagacattttagggatgaggatagaggacttggaacatgggcacaatggactgaagccagaaagcgatgacccagagtctgtgctcctagatcagaaaagccaggagaagtctccaaattatatgtacctgggaaagaacacaagctgagattggctatcctgtagatgagcaggtgcaagctggaactgggattaaacaagaggggattttctttgtccacctacccaatgtacaagctgagagaaactgttcaggacttgagctaagaatagaagttccgaggaaataggaagtgagagaaacttaatatatttacaatttaacttcatttttttttaattcaacagatcttcattgagcttatgctatgtgacagatacttttctaggcagtagacattccaaggaaacaaggtccttgttctcatggaactcatgttctaatgggaagagatagacaataaataaccaagtaaataatttaaggaaatgagacaaattgtgagtgttataaagaaaataaatcaaggtgatagaataataagtgactggggtaaggcatgggtgattcaatttggcttgctgaaaccatctctggctgttgtttgtagaatgtgttttaatggaagcagaaagatcagagaaggccacatggtaattcatgtgaaagataacgatggactcagatggcagcaagtcagatagagaaatctgagcagacctaagataatcttgtgtaggtggctctatcattatagggaaacagtttgtgtactttaaactgctcggccaatatgtgcctcagtgatacgtggcggagcttgtctcactgcataacacagctatgacatgataagacaggccctgcaagggaaactgctgacctcactttgtcctttctgggtaccaagtgactaatagtcagaaggtttcactcagttcagtaatctgtgtttaagaaaacaaaagggggcttttaaacatgagatttagtgaatatgacagagaatttttgagatcaactgaactcagtttgtaaaaagagctagattcagccccccaagcatggaataaaccttggaagttatgcaagaagttgtacaaatcttcaggttcttattgataacctgatgaaagccccaaacagtccctatgctggtccaagtttgggtcctcttaggtcccacgttcctcctgctctagcgtcctgctccactgggggctattttttatttccagtgcccagaaatggctgtgtgactatatgtttgcagtctgttggagggaagcaggtctctctgctaacaactgcacactagctgacatgctgcttaaattgagaaatgtttctaagcttttttggtaggaaataatctttcctgcttagtctccctctgtgttcccccagcaaacttcttgtgtagcattattaaatattccccaacatcagtggccaagaatgacacaattctgtgactcctcagtcacttcatgctccacattaagtggagtttcttcctagaatggggaaggcagaacattggtaagagctaggtgtctcagaatctttggaaataaaatccctgatccataggtagttggctcgctaggttacccagatatcaatctgacaggacagttttctgttcctccctgggtcttgattgtcattcattaggaatgaaattaaagtttgaaggacagtagtcaaatggcattcatttgctctcttcctctttggcaaatctaacaaacatcaggctttttccaggcaggaagagcctcatttctaaagagccaatttataaatatcattacctgattctgcaaaatgaagatagtcctaactagagtaactatccatggtgttgggtgttagtaaatatcatctcattggtagtgtgtgattttaaaacccacaaaactgctattatatggattttatctaactgtttaaaaccgatgatcacctttgaaactactgttacgagtactaggacttacaattttttttttaagaaaagctacataaatgttttggtggattcttcttcacgtaaacaatcattgatttgctatctcagagcttcaagaaatctaccttatgactgtcaaaaatgagagctgactctggcctctgttgtaataactaattgctctctcagtcacacacacacaaaattaaatttgggtttaaaaagtatcctggccaatctactttttaagtgttaaaatacatgttgatttgcctgacgtggtggctcatgcttgtattcccagcactttgggactcagaggtggtggatcacctggggtcaggagttcaagaccagcctgaccaacgtagtgaaaccccgtctctactaaatacaaaaaattagccgggcatggtggcacatgcctataatcccagctaaggcaggagaatcacttgaacccaggacgcggaggttgcagtgagccgagattgcaccattgcactccaccctgggcaacaagagcaaaccccgtttaaaaaaaaaaaaaaaaaaaaaaatatatatatatatatatgtataaagtttcttcccaaatcatgacaattatcatcatttcacattttccatatctggaagtatcataataaagaaaattaaaaccttaaggtagaatcacatctcgtacaatggatttagcacggcagtaaccttaagttctgacaccagataaatttggaagtcaggaaagatagtcatgatactaagacatatgttttaatcagttacattggagtagttaccaggtaatggaattcattaaaagaagtggtatattccatgtagctatattaaatactcgagcatcccagaagctagtgatactatatgcttccagttttctgagaaacttgaccagtttagcagactagaagcatcatccaaagttcttgtgcttgctttatatcaaagttctatagtctttaaatacatcggtaaggataaagagactggagcagaatcagtttgctgagtcaacaaagtgcccaagatgattactgttattgttttctcacctcatcaacaaaaagcatcccatatatatatatgtatatatacatatatatggtgtatatatatatgtgtatatatatggtgtgtatatatatatggtatatatatattttccaatatcaattttccaatatcaatctactgagatatatctcagtagattgatattggaaaattcgaactaccattttgtttatagtcagtagtaataccctgctaaaggtcgattgatttatatgctttgggaatacagttaattcaaaacactgcatgcttgtactttggaatagttggtcccatgaggtatgaactcagacatactcgtttacttcaaagtgaaacaaaaattctgattaccttaaatagaaaaaaattgagttgctgagaatatacgtaaaattgtcttttcatttctgttactttagtgattagagttttttaaaaatataatttcaagttttattttagattcagggggtacatgtgtagttttgttacatggatatattgcatggtactgaggtttagaatatgaatgaccccatcactgaggtagtgagcatagtacccaatagttagtgtttcaacccttgctccactctctccctccaccctctattaatcctcagcatctattattgccatctctatgtccttaaatgcccaacatttagctcctacttataaatgagaacatgtggtatttggttttctcttcctgcattaattcacttaggataatgacctccagctgcatccatgttgctgcaaaggacatgatttcattcttttttatggctgcatagtattccagggtgtatatgtaccacattttctttatccagtctaccattgatgattctctaggttgattctacgtttttgctattgtgagtagtgctgtgattaacaaatgagtgcatatgtctttggtagaatgacttattttcttttgggtatatatccaataatgagatttctgggtcaaatggtagttctattttaagttctttgagaaatctccaaactgctttctgtagaggctaaactagtttgcattttcaccacagtgtataagtgttcccttttctctgtagcctcaccagcatctgttcatttttgacttttgataatagccattccaactggtgtgagatggtatttcatcgtggtttagatttatatatctctgatgattagctatgtttaatgttgtctcgtacatttgttgaccacttgtatgttttcttttgagaagtgtctgttcctgtcttttcctactttttaatggggctatttgttttttgcttgttgaattgtttaagtttcttgtagattctggatattagacttttcttggatgcctagtttgggaatgttttctcccattctgtaggttgtctgtttactatgttcatagtttcttttgctgtggcagaagctatttaatttaattaggtcccacttgtcaatatttgtttttgttgcaattccttttgaggacttagtgataaactctttcccaaggctggcatccagaaaggtatttcctattttgttctaggacacttagagtttgaagtcttacatttaaatctttaatccatcttgaggtaatttttgtgtatgatgaaagttaggggtcccattttattcttctgcatatgactagccagttaccctagcaccatttttgaatagggagtcctttccctgttgcttatttttgtcaactttgtcacagatcagatggctgtaggtgtgctgctttacttctgtgttctctatcctgttccattggtctgtgtgtctatttgtgtacccagaccatgctgttttgactactgcagcattatagtataatttgaagtcaggtaatgtgatgcctccagtcttgttcttgttgcttaggattactttggccatttgggctcttttttggttttatatgaattttagaattgttttttctaattctgtgaaaaatgacattggtagtttgataaaaagagtgttgaatctgtatattactttgggcagtatggccatttgatgatactgattcttccagtccataagcatgaaatatttttgtttgtttgcttcctctatgatttctttcagcaatgttttgtagttctccttgtagaaatatttcatctccttagtcagatatactcttagatatttatgtaatgtgtatgtgtgtgtgcctattgcaaatgagattgtgttcttgatttggctctcagcttgaacattattggtaaatagatatgccaccaatttttattcatggattttgtatcctgaaatttttgtgaagttgtttatgagttccaggagccctttggcagagtcttcaggattttctaggtatagaatcatatcattagtgaaaagagagagtttgacttcttttcctatttggatgccttctctttcgttcttttgcctgattgattgatctaggtaggacttccagtactgtgttgaataggagtggggagaatggacgtctttgtcgtgtttctgttctcaaggggaatgcttccacattttgcctatccagtatgatgttggctgtgggtttgttatggatagttcttattattttgaggtatgtttctgcaatgcctagtttactaagggtttttattatgaaaggacattgggttttattgagacttttcccacatctattgagatagcccaatggtatttgtttttaattctgttgatgtggtgaaattgattaggatcttaatgcagattcacagatgaaaaattgttctattgagtagcaaatccatggatagcaatcacagctagatagtcacagcattacagagtatccatgaaaagaactgtttacttagcatttagtaaaagtcatagaataccagtatataaacctctggacttacaaattgataataattttgtacatttttcttaagttcttgcttgatcgaatatttctattttcctattagttttaggtttgattaatggatcactgtaaattcagatgcacctttgcactcacagtgaatatatggatgttccttccacttctaattgttccataaggatgtaaaatattcttaaaactgtgaaaatgttaaagcacattatagcacactttatagcctttctttgtatttaccctgcaaacaagtctttgaagcatagaaatctcacctatccataatcacaattgactgctttactaaattttaaaatgaggtggaatcgtaatgtattttaattgctaataggtaataatggctaataaatagcaattggttcaaacctaacaaaagtgggactccatttcctagtgttcttgccactgtgaacttgaatgaggcatttatatattctgtaaaaggttagtaatacaactattctatagtttacttttgcaaattaagatgtatgtgaagataaaatataaataatttgagttatcagaagaaaactaatatctaaatctatggtatcgtatagtgaaattttacagtaacaggagctatttatggaattaactaaaacctacaggtgtgtgttggtggagctcctgacaacacagcttcataaaaaagaaactgcttgactcaaggagacagataaaaagaagtgtgattatattatatgagtttgtggtcatttttccatgaatagttgagaaaatgactatgaaaaagagatttggtaaagaaatgtattattatggctgagcatggtggctcacgcctgtaatcccagcactttgggaggccaaggcaggcggatcacaatgtcaggagtttcagaccagcctggccaacatagtgaaatcctgtctctactgaaaatacaaaaaattagctgggtgtggtggtgggcgcctgtactcccagctacttgggaggctgaggcatgagaattgcttgaaccatagagatgtaggttgcagtgagctaagacagcaccactgcactccagcccaggcgacagtgtgagactctgtctcaatgaaaagtaaaataaaataaaaaaagaaatgtattattattcagcgaaaaaattagtatatgttattgcttatcaagtgttttgcaactcattctaatcaaggcaaaataactttattgaaaattgaaaattacagtctccataaccaagtggttatacattacttagtactttcaaagtgatacctcattgctctcctttaagctcttattcaaagatatattgactgtctaagaatctgtgcaggtcatttctttaaatacttagaaaaggatttttattttactaaggttatctattaccaaaaattaatattgaaatgaaaataaattttaagtaccatgatgaatatttagagctactccaacagtttagtgctatttttttcttgcaggcttgtacagcatatgtggattttatgatttctgtggccagattgattcgtcaggaagaaagattgcccatcgatgaaaaccagcttgctttggaaatgaataaagttatggaattggaaaaagaaattgccaatgtaaaacacatttttttttctgatacactgaataatgtcaaccgctttttttctttcccctctctatcatactttaagagtaaaaggtacagcactttaaccaagtagtaaaaatgcatggcttggtaatagatcattgacttcaaaaggacctttgaaactaaagaattttatagtaaactgggttcctgacatttaaaagacacactaaattggacaaatattaaactagaaacacttaattgccttttataagtggattccatcagaattctaccatttacagtcaaactgttgttagatgcccttcagactcagagcaaatgcaaagctgttttagttttgatatgtatagaatattactttattttaaagtttaaagtgatcacagagattgtctctatttctttgctaagaagtattaacccctgaacatagccatgtggcaatgtgatactactgagttcaaattgtcaggctgctgagctgacggagggtaagacaataattttgcaacaaagcccaaggagtgtattcctgaatttcttctggctctagatcaacccttggagtctgagttggcactttcttccctgatgattctttgatagggcactgcagtctcaagtgagtgaactctgagtctaagcagcatccaggttattgattaaacccatcgtcagagtcagtctaggacccacagagttctctttgtcattgcaaacgacaacctgcatccctgactccctatctgcttgcccctgccatctaagctcatcagaatcttgaagagttaagatcatggagggcaattttagctttcctggggctacgtgaaaccaaaaatctcctatcagaaccagggtgttcttggagctgccactgaatgaatggcatttgaatgggttacatgtggttctgtgttggaaacagacttgctagaggagaaatgtttcctgctctgggtttttgccacttgcaccttcccagaccatgcgctcctttgaccagcatcagctctgtagtgttgtgtcttacctcagcattatgtgtctatattctcactcttgtattagattcttgtattagattggcatgaggccttagacgtctttgaatcatttatgcatctctaacaaaatccagcatagtattgcacaaaggacatgctcaataaataattgttttcagtaaatgaataggtaagtgacctaaaggggaaactggagccattgtcactgagaaataattccaattttaaacctttaccttttgtctcttctcacttaaaattgcttttactcatttcagccactagttggggagttgttattgcaatttttctttttaattcagtgaaagaaataaaattggatgctgctggtctggcaggataggagaacagtcacaaaggtccatgatgttgccattctcagataacttgcaaccaaattgtgctctgtactaggaagtttctctgttacttgcgataaattcttatagaaactcttgcacctttttttccttgctgaattttaactaggacaccgaatggtaatggtgaagatgggagagagagtatttaagagagaaattggagatgactatatcaaagaaagttaaaatatgaaacattcacagacacaactgaactggccattagccatagctcataaatattgcttatatggcttggcagttgtcaaaatatagacagattttttaaaaattttaaacttgaccccacagccaaatctcaataattcttactacttctactccaaaaatctcttacatttcactttttttgaaatgacaaaacaaattacaaaaacaagtacagaataggacttaaattatgttgtacctatcctatatttttaccctcatatgtagttatatttttctaaagaattcttaattctaaaataatgattaaaaattaaatccataggctacggctaaacctgaagatcgaaatgatccaatgcttctgtataacaagatgacattggcccagatccaaaataacttttcactagagatcaatgggaaggtaagtggtaagttttttgtgctctcttattgtgccgttttctaaattataacattgaaatactctttctaaaattcgtcaagtttttatttattgaagtaaatgggacttcaattccttttttttttttttttttttttttgagacagggtctcactctgttgcccaggctggagtacagtgacacaatcttggctcactgtaacgtccacctcccaggctcaagcgattctcctgcctcagcctcccaagtagctgggactacaggcatgcaccaccacacctggctaattcttgtatttttagtagagatgaggtttggccaatctggtctcgaacccctgagctcgagtgatctgccggccacagcctcccaaagtgttagccacaggtgtgagccaccactcttagctggtaaaattccttttaaggcagctatacaataatactagaaactcccataggaaggggtttgaaaaatactaaaactgaaaatctttctgagaggccattatgtagtcatcagacttggacagtcacacaataaaagcactagatttccttttaactccaaaaaaggataatttattcatagaacttcccatgtgctcatcaaggccatctacagaggtgttcagaacaataattcagaaataggacacaaataaaaagaaaagctctctcatagattccatttataaacagcagttgacttctttttccttacctagtatccaataatctctttttgtggctatgcatttattctcgtgtattagttgatgcacacagccaagagatgaagcaatatccatgggaaaacctacaaactaccacattcagcgatgacattctctttggcactaattctagttaacaaggacttttccaaaggcataaactattgagttagacatcttacatagaattttttaatataataagtgtttaataaatacgttttgaaagaatgacctaaaccaccaaaggaaatgaagaaaattgtatagcatagcaccctatactcagtaagtgatgtgtgcttgtgtctgtgtgtgtaaaatacaacctaagatattgatagtcttaaacattatcaattcccatttagaaagacaagatttcatcttttggcaactccgtacttagcttctgaagtataaacatggcatgcctgtagacccaatatcgataattgaaaagatgctgttttctttgacttcataacatcactgtaccactgctataacagtatattttcatctataataggatttccactgagatgtgttactgtgtttgaatgaattgtttattaatacccacttttaaaagctaaacactttacacacatttccatttttgcataaaccaaaaaagctttatttttaaatttaaatttaaattatatttttattttctgtattggttagacaaagaagatgacattaagcctaatttctaggtatatgttccttaagcttaaaggctttgttttcgctcttaaatggttggcttaattatgctaggtaaataatcatgttgcagaactagtttttatttaaaaactgattgaaacaattgaggaagaatcccaagtgaatatcaaactgatccaaccctctaactataactgaatcttggacccaagaagagaaatccacaatttctgaatgtttcatgcctgcttttttccagccattcagctggttgaatttcacaaatgaaatcatgtcaactgtgaatattagtattacaaatgaggaagatgtggttgtttatgctccagaatatttaaccaaacttaagcccattcttaccaaatattctgccaggtaggtatgtcacagtccccatgtcctcaaagtttgcatttcatatcactcttcagaagctttgcagcctcatcttttctgttgctgggcggtggttttttttatacagagatcttcaaaatttaatgtcctggagattcataatggatcttgtaagcagcctcagccgaacctacaaggagtccagaaatgctttccgcaaggtgaagaaaaaatctctcttttcttaagacttaaagcataaagtgatacatggttatgaaggcttaccatgtacactgctaggacatggtgaactttgcaaagggacaaaatgccaaagttcgttatcttgcacatatttaggacatgttgctgaggaagataaatcttcatgggctttaccatcttatgatggtctatgtggcacgatgattgcattgtcctgtaaggagttacatttggttatttaaccagttcatgaaagaatactgtctggattttttgttgttgttactgtgttaaaagtaatttcggggttatctattttaattaatttgattttcaggtgctcattgcacactggacatatacacagatggacaatattgatgtgggcagtctattgaaagtacccctacctggagttaaataagaccttttcttagcctatacctatattatttaaacaatcactgttttggtactatggtgaggggagtaggcagtagggattgaggaaggagagactccagcaaacatgttagttggagtcttggaaagaaaataacgtggactgattaaaatttctagtttttatccttaaaaagaaaatgtagacatctttttaaaattaaagaatgcaaaaatgtattgtgctaaatctcccttacttaggttatcctgttattcttaaatttatacacatacaggttctgtaagtactcagagttcagctaaaaccttgaaaagcagtaatgtgttttctcatataccatatttcccccattacatttattgaatatgacttcacatttatgtttgtgcagtggttacagtgttgtatgtttttctaacgctttctacaatgatattaagttgtaatagcaaaaagttctactggggcatctactgaaaatatgcctagttttcagatcatatataagtaaacaatccatttggattacatttcatcataggctaggaacatgggccttgtgaggagaagtgatgaatatttcaagaacttagatgagacatttgtgaaatgtgtgctcttaacatgctccagacctttccttctggtcaaatgccatttcctttttcttttccgtaggccctttatggtacaacctcagaaacagcaacttggagacgttgtgcaaactatgtcaatgggaatatggaaaatgctgtggggaggctttatgtggaagcagcatttgctggagagagtaaacatgtggtaatgttttcagaataatacactgtcagttatacaggacactatcagtttgttcacactgatgagcaattacagttctccatcatttggctaaaattttattaatttaggcagagaacctctgaatcataatatgccattgtttcccaataaatcttcccttgccttccccaagagtctagttatgtttctgctcctaatactgtctagtctgaaaccaactcaccattttccagaagcagtgtatttggagtacccagtaacatgttctattgatatagtcatttataaactcttctattatcaaaattgcccccaaattagtattttcttaaaaacatagaaagtaaaacaggatttatttggagtataagaaatgtgctttatttttcattgttaggaaaatgaagacagtggaacttaatggtatggtgaaagaatttattgaaatgctactttatgcttagctaaaccactaatggtaatgacagccctaatattttacattagttcttccagtatgatagtgaaaccattatattctgaaaatgatttttaccttaatgcatatattaagacctatttaatcaagagtgtcgataatagcaatattgcttttaaaatataatggtcccatatatctgttagcttaggtcacagtttgtctataaatttacgtttattaacatattaagtcatacaaagatagcatgtagctctatttttaaaaatctgtgttacaaagaatgaattaatgacctatatttgtcttctgttctgatttgaggtcgaggatttgattgcacagatccgagaagtttttattcagactttagatgacctcacttggatggatgccgagacaaaaaagagagctgaagaaaaggtaaagagcagacagctaactagcaaagaaaaatctttgctagtataggaaaaattaactttaaaaacatttagaaaaaaatataatcaaagattgcataaaaacttgtaagctccttcaatatgtagtgtttccagaaagagtttttgtggataaagatatatttctacaattttaatcttttatctctgcaaccaatactctagcaaggtgaaaatattaagtttctgttcaagcaaatgtaaggtggtgcactattggtgcattataagatctataattaaagagatgttgaagaagcttttttataactattcatgcccacccataatgtgcagcttttattgagacttttactgagtttcataagaataggtctaagatttctcaggaaatcttaggtttaaatttactgtgatcatttgtctttataattatataataactagggggaacatgtcctgtgaaaactgttaacatgctttatgagcaacattcacatgcatcctgactaatctctgtagttaggttggcagaaaaagcagacgatttggattgatagaggagacaataataaatgtattttaataagataatcaaccttggtctagttttcttttagaattaaatcacatggaaggactatcttttttcagctctcaaagagccctgagtgggttaggcctagaacctctgcccccagtattgctatctttccatcactctggccagctcttcagacattcaggttggatttgctcctttcatgtcacagctgtgcatgacatggctctgcttggtaaagccagttggattgttctggatcggcatttccaaagtggtgtcacaaaatactggacatgcaagttattccacaagaggctcatggtcaaaagagtttggtgaacacttcttgtaggaaggcttccctcatctcaccctaggctgggttacatgctcctagggtgtgattttattatcatacgtgggagttaatatttatttcactgcttatcattgctgtttacaataagctctttatggttgggggcaggggggcagaaaatactgcctagcattatatcctcagccctttataacatacctggcccttggtagacccttgaaatatattgagtgagtaaattgataaattaatttcccatcctggacatttataataacttatgattctaaccttataatctaacccatttttaattgtaagaagtcctgcaataaagaaacttgcttaatgtttttgcgacagcatttacccgaagtaattcacaataatttttttgtgtgtttactaccttatactttctgtagaatttgtatcctttagaacactctttaaggaaatgtcttacagtaaataaagtatcattaagtgggggctggattgtcatgactgatggcaaacctacaagaaaatgggtttggcctcagtgacttcagtgatacatatgaggcctgatccactgactggggaaatcctgggctcatgtgacagatttgtaataaaactgcatccatttgatgggaaaccatgtaactcagagatacaggctaaaccccccatgaaaaatttaaattaattaaattatttaagagtgatacgaagtggtaaaatcaaaagtcaagtatcattgagaaaatcaagagagaaataaaataaaaatagaaataacaagtagtaaacaagtgataatgaaataataaaataagtaaaataaaccattttaaaataattaaaaatgaactttagaagtagtgataaataggccaggtgcagtggctcactggtgtaatcccagcactttgggaggccaaggcaggcagattgcttgagcccaggagtttgagactagcctgagcaacgtggtgaaatgctgtctctacaaaaaatacaaaaattatctgggcatggtggtgcatgcctgtagtcccagctatttgggaggctgaaatgggaagatcacttgagcccaggaggtggagattgcagtgagccctgattgtgccactgcacttcagcctgggcaacagagcaagaccttgtctcaaaagaaaaaaaaaaaagatagtagtaaatacataataaatatgagctggaataacaaggaaaaccccgttttccacttaactaattaatgtcatttattgaacttgagaagataggtacactgactttggagaataaaggagaacataaaaactccaggaaccaatatttaggactagtattagcagtaaacctataagcccatatctgttttctcagtcaaatcaatgaggcagaaaggtaattataacctgctggaatggaagctgtaaatattacttcttctaaaaaattgaaaaaaaaagctttgagagaaaaagttcataaaagtacaaaatatgtggaacaatgagttttgtcagtttttatgttggttttcttgagaaagctgcagcctataaggataaggcattagaaactcaatttcagacctgattttcatttattcttgaacctcccaggaaagagccattgcaaagatctctgtttaagtatgtcagacactcattttatgaacagtatggatcaagttattcaattgctagtcatgggcagattataaatttgtatctgaaagttatataatcatcttcacattcaatattataattttcataggccttagcaattaaagaaaggatcggctatcctgatgacattgtttcaaatgataacaaactgaataatgagtacctcgaggtaagtctctataaaatagactctggactactgatacttagggctggtagtagtgtcatttttagctatggggtgcctgaaattatatgaagtagcctgaaaccacaggttgtattatataaagccttcaacgctggtgccagaatgatatttgttttagcctttttgttttcattagccaggactatatttggttattgttcatttggtttccatatattccattttaagaaccgtaagtaaaatctggtgtcctttaaagagtatcaaggaagggatagacatcaaggtggtgaacaacaggcaggcttcttatcacattttacacaggcttcgagtttccctccaccttctaagttttcctctactggaaaaaccaattcatgcctactgtattttaaaaacaaaacaaaacaaaccctgatatttgagaactgaaaactattttgttctgccctggtaatgtaacagttaaaagagcagagagttgcttaaagtcactgcagtgctgatttcagactcaactgaaagtcttgctgctaactctgcagtcaccacaactacatgataccctgatgacagcgaggtgatccttgcccaggtcctgggatgacagtgattcctcattcattgattactagtctagcatggggatttgcaaaccatactgccttcttctctctttccatttgcagaagaaacttgactttttcttttaaatgagctggttatagcttgcaagacccaggggtccttatagcaggagcatagtggctacgaacacagactcaaaaccaagttccttgattccagatcccagttccaccactcatttaaacttggtcgagtgactaaactatatctcagtttccttgactttaaaatggggataggagcccttagttcatcggtattaaatgaacataatattagattctattagtataatagaattaaatgagtataatgtaaaatttaaagtacttagaatagtacttggcacatggtaagtactaaagaagaatgtgctattatccacatgtgttatgtgaagattaatgtcattaatgtgaggtttgtttgacacttggtttcatttgattattataaaataatacactgaatttgtgatttggctggaatactgacctgtgatatactaatagaattaggttaactggaactacatccttttttggtaagttttttaatgctctcttttaactttattgactgatataatttaagaaaatccctatgtttttagcaaaaatttagaagataccggttttaatatttcttcccaaatcttctttataatacagttgaactacaaagaagatgaatacttcgagaacataattcaaaatttgaaattcagccaaagtaaacaactgaagaagctccgagaaaaggtggacaaagatgagtgcgtatattctcatttctaatgtgatcatctagaagcaggtctttccctcctttctttgttggattaagtgaaagagcctcagttagaaaaatattaaaaagtacaaagtcctctttttattgagaacttctaaaagcatctaattatggtatactaaagatatggatcaagactttaaccagattaaaatacctttctcattaaggtatcctcaaatttacatgtctttagtttcgtcttatgtcattgcctatcagctcaatttatttgtgaacaagattctcaaaaaccttagcttaagtaagccaattcatagctcctttaagccttctcttaggccttactctgtgtccagaattttcttctgctgacagccccaccttttttctatcagtcaatcccacaactccatccccttcatagatagttaatgtaagacttttctaaccctgtggtagtcaaataggagatactaggaaccattcttattcacagtcttcttatgctcttaatctctgcttattagtgacattagtatttcctaataactattagtttagattttattttttctattaaatagatataactaacatatttatcagcatatgtgtttatgcaccgaaattcctagaaccacttatgttgactttttctccctaggctcttagcccctagacaacaggggctattccttttgaccataaagtctcagcatctagcatactgaagaatctcagttaaaacaaaattaatgagtgagtgagcaagtgaaaaataaatatactaacttgatttgtgtggtaactaacacagtaacatgccaaagaggtgcttgtttcattcatgcattcatttatcctttcatgcatttattaacattttggaacacgaagtccaggtgtcattgggtactgggagaatcaaaggtgaactttgattacattacaagagcagaaggtagacaagacatggtgtaataaactgcaccaccaagagggaaatgtcgtgccaagcaaagtacaaagtgctgtgggcttatttgatgataagactgttctgttctcagtaaaccaagtacaggttggacaaaactgctaatggaaatgccagtgcattttaatccttactcaacatgttgaactcttgcaacactgacgtgtcctgaaagagagagcaactcttttgctgacttctaagttcatattggaacaaatattgtgttatctgatgctaaaaatgggattgcaaatattatagaatgtttagtgtcccatctgggaaagaaagagagtgaatacacatgcttggcattataatcaagttaccatatcctgtctcttgaaacacacaaaaagttatgcaaaataattatctgggtgaatttatgatctgagaaatttcttataagtctgtatatttgtatttctttaaaaatagacatactaagatttaataattgttagcactataaaatatctatagacaaatactgtcaaatattatttctgaaatggccaaattaaccagtacccataggacatcaggaaatttcttcataattctagaaatagttgttgaattattgcttgatgttttcttttgaggttaacgtagtgccagtttcataatcattttgtcatataatttacactgttcattccctttcatcatatgggctgattttctctgcattcttctctttttaagatagataatcaaaagccaaaagtgtatacaatattttaatgaatgaatggtcaatagcacacatgcttcagtagtactttttggtcctccccatgagcttctgatgatcacaaatgcaatatgaattctaaggtcttctctgctatatggagccagctttcctttctttcctatagtctgcctgtataccagatacaaaggttcaaaactctagctgcacatgataatcacctggggaacattttaaaaaacactgattccccagctcaagcaccctagaatgtgatgtaattgttctgtagctggaacccagatactggtattctttttaagtaccacccaccaagtgagaacccctgagttagtgttatttcccttttgtgtgatatcgttcctgttcatattcaattttatggaatttttcacaagatgatgcctttaatttggcaatttaggtttaaaatttatttttatcttccaaaataatcagaaaccctctgacagtaattgcatcaaatcattaagactgagccctataggatacaacatgatcgaagctcctctcattttattaaggtttcttgcagggaaagttactgacttattttgaacctgcttaatagtaataaagttggctggacatggtggctcaggcctgtaatcgcgccactgcagtccagcctgggcgacagagcaagaatccgtctaaaaaaaaaaatgtaataaagtcattactcttttttcttttctctttttgtggagcaccaagttcaagtccttgctgtgtatgtttagacagataatttctgttgcttctacttgtccacatagcccgtagttacatcttagagaattacattttcagatgctcaagatcctcactcccaaagtcttgaaagagaaatatgtgtgcatacccaaaactgaagggacagagttgagacttttgtagggttgtattgtagggcacttcagagaaatgatgatgcattaaattttcaagacagcaactaatgtaaatgaattcaattagccaaatagtaaacttctagacacttttttcccccaattcacatgctctcactgggcaaactcattttacttctcgacatcttctatcatcatcatgtcagctgaatatttgtatttgactcagatccatttactaagattcaaatccaaatgtctacatgcttatgaaacatctccatgtagatgtcttattgaccctaaaaacacagcatttgtcatttaggcaaaaaataatatctgcccattttctaaaaacctccattttactgctaccaagacagaaaccaaggactcattttaatcatcctagacttatccctttctgttattcctgacatctacagtgatagttaattcaaatctccattttaaaaaaaaagtctgcatccaccagctgctatttaaatattacgtaggaatgggaagaggggatctctagctcaccattcccatggtcacttctgtaattcagacatttctcactgttcattgactcatctcaattattatcctactttttttaccaaccaccttctatatcttcagtttatcctccacactactaccttagagatttttttgaagacacaaattggcattttatttcctgatgaaaacacttcagtgtatccctgttgcctgtctcatgatgtgtgactgttttgaagagaaccaaggctcttcataccccacactagcactccagagttccttcacattcaccctacacctcaccattgtccaaagctccaaccatatgaattacttccaaatcctttctctgtctttcttacatccttgtctcttaccctggaccaccctttatgccctggttcatctaacagaaacctacacatgatttgattaaactttaagtgtcacctccttcctcacagcaccccattgcatatttctcttcaccttgggctgttctacactttgcacattttggtcaaagtaccagtacattttactacgtttagttggactagcccctattgaaagcaaaaaccagatatttgtgtcaccagagcttaaacactaatgaacagaatgtagctctttatgaatgtttatgggaagaataaatgataaaattgccaatttgtaataatgataataaaactaactcagctgctaaaataaaaatggtcacatctggctgggcccagtggctcacgcctataatcctagcactttgggaggtcaaggtgggcggatcacttgaggtcaggagtttgagaccagcctgggcaacatggtgaaacctcgtctctactgaaaatacaaaaattagccaggcatggtgccatgcagctgtaatgccagctactcaggaggctgaggcaagaaaatcacttgaacccaggaggtggaggttgcagtgagccaatattttaccactgcactccagcctgagcgacagagagacactccgtctcaaagaaaaaaaaaaaatggtcacatccaaacatttcactatcatggctggggaagatacacaacatcatctttaacaaattcaagaaattgaggaagtcaggaagtctgcatgtgagacacccaagttaataatttagctaaaagggcctccctctgctcttatgagtggctggcacctgcaaaggacagggatttacttttttttttttttttaagacggagtctcactctgtcacccaggttggagtgcagtgacaccatctcggctcccacctcccaggttcaagcgattctcctgccccagcctcccgagtagctggaattacaggtgtgcaccaccatgcccagctaatttttgtagttttagtagagacggggcttcaccatgttggccaggctggtctcgaactcctgacctcaggtgatccacccaccttggccttctaaagcgatttaaattttaaaagctcttgattcatgtggtttctgatgcctagtatgtgtttccaaaatcatctcaaacattatgtcttttaaggattttgcgccagtttgtaaagaattttaaacatgtcattataacatagaaatagtgctgaatcgggaatataataccctttggttacttaacaatatttctaaaatatttacttctagtaacatgaattttcatttagagttcatagagcaaacatgaatctctaaagaaaaagatgtacaagaacaaaacaaaatgagtctcttgtttttagacttgatgttattttgttagtttctcaggacagaacttcctgtgatataattgtgatgggtgttgctagtgtttgtgaatcataactgttgagccctggagttaactttttataaagtacaaagaggaatctcattggtgcatctctcttgctgttctgcatcaaaatgaaagcatactgacattgacaggagccaagtcaataaacatttattgagcagctagcttgtgcagagcactgtgctaaacaaaatagatgacaaagaggagaacaagatgttgccctttactcgggaggctatgatcttaaggggcagatgattaaaaattaaatctgatgaaaggcggggtttggttgctgctattaccaggaaacaaagtgctagaacagcacttttttcaaaccacaaagctttacttattagtaaaacacaatttttcaaaccacaattaaacctttacttattagtaaaacattctctggaatcaatatgtcagcatttaaattaatattgaggtgagcagaggattcacaaaaaacaaaacaaaaatgattggctcatttctgtctgccccttggttgcttcaagcatggtgttttttttctaatctggtgcaattggatggtggcacacctctgaaataagtggaacccctaaagctggcagctcaacatctgtgactccgtggtgcatatagaaagttcctgaaaggccagcaccaccaaaaatggcagagcagttggcaccctgggaagtgacactgtagttttgccactgcaatgagtgcctaatactcttttagtgttccagttctgccattcacaacctgtggccttttaaaagccctgtggtttccttatttataaaatgagtaggctgtgctagactgtagaatgtgtctgaggttctttctggcactaaaattctgtggaccttactgtgaagttttcataagagccaggaagttttcctccttggcttctccgcatcaaatgacccaagagaaaaaaacacattcttgagtggcagagaagtacctcgcttctttctaaaatatcccttctgatttttccacttcactaatgtttctagaaccaaccttctttctaactaagttctgtatagttcaacttgagtatcaaaggaaaaataattatgcagaaattatatgggtaaatatgatggcccagcagtggaaagttgatagtctctcgagggtgggcaggcggagcaccggacacttgagacaaatgactctccataaatgtagacggagatgatttgtaaaaaggactatttgactcagcaagtattagccagaaagaagagatacactaaacttgaacaaatcagtttaatttcccaaggcagtatctgccatggcatcctcatgttttgcacatgttgtaacagatgaaaattttagatttttacgttttatgcttccattaagccaacagagtctttgcagattttcattgtgttttggggttgttagcaaaatgtgttctattggcaaaaagatttctgctttttagtcagcatttgatgagggattctgttttgtttcgttttgttttgttttccagagggggaaggggaattagaaaaggaagccgaataatttaaaggctgaaattttaggtagttcttttttaaaaacaaaacgaaacaaaaatatcatcttcaaacaacacaattaaaaggtcctaaacttccatttaaactgaaagaactttgcaaaagaattctgatacatttatttcagtgtcatctcttgaaaggacaacattcaacggtgcacagtttctgacagccaccactctctatgacgtgcatagcaatggtgccctctgccctcctagagtcacaggatgaaatgggtcagcactctgggagcttggaggacccaatgctataccaaggcccaaatagccaagtgcctactatgctcccaccactggtcttagccttaggattcaattaagaacaaaacatggaatattcttgccttcatggaattaccttctaatgagctaggtagacaatagtcttatgtcaagttatgtaagtactgagggttatacagtatggaacaggtttcagttctttcctggaagttctcagaattactttaaatcaggagaaaagtcaccaaagaaaattctgacagaaatgatccacccacccaagtgtctccaaaattaggaatctctccgaaataaagcataccaagtgtgtatgcacatatatgtgcatgtacacatatataaggttagcaaagactaaaaagattgtgccttgttgccaaacagaactacacacaaacaactggtaacatctaggaaaacagtagtaattttccattaccttttgttgaaagagaagtggcttctcccagtttagtgtcaaaatcagagtcctagcctcagacagattcaggtaagtcacccagagtacttcagttatgttaacaaccatatgcaacaatagaagttctttggtcctactgtgcttttgcctttgggtaaaaagttacacttatggatcattgggaagagcctgtgctgtggagtcagggggtgaggggagtagacctgagtcagaattcctgctttgcctcctaacctctgaacctagaatttttcctttataatctggtgataatgacttcacttttgtcctgcatggttgtgttctacgttgtataatgcacctagaacataacttaggtgctcattaaatagtaaccagtgtgacacagtagtaagaaatggtcatcttcatttttaaagaggatggcaagaaaatggcattaatccctgtaatgaaattttgtgtatggtgcagatcaacagcttaggagtaggagatttgattggaaggtgagcaggttcctattcttcttagtttaaatataattttcccagttatataacgtagtttgtaggtgtattaggaaagagattaataaccatattgtgcctcagtttctatacctgcaaatatatggatggtttgaaagatgaataaaagtatacagaaaacttcgaagtcttgatgagagaatattgataattgtaaaggattagagtgattattgtgattacaaggtaagaattctttccacccaggcgactggaggaagacacagaaaatctatcgtattgcactgctgatttcaaaggagttgctttgagactactaaatgctgagaaattgaacactggcagtaccggctcactaacaattttgttgttttcagtttttaagttacacaagagtgggtgaaaaaaatttattctaggtgcttttgcaatctagtgggcttataatacccaaaaggctataggatcagtctgttgtcttctgcttttcttcccagctataaaaattatttctgcacactttcatcagcactaagcttcttcagggcaataagagatagaagagaaacacctggttcctctgtcaggtatatttcagttctattccccacccacattgttagctcagctttgagggccatactgcttctagtggcccctctttgttttactgccaaatgcccccaaacgagaataagcttacctgacaaaattacatctcataaattaaaaataaggtttcttccttcctgcttccccactcttcactttataccacatacatgcccacatttgtatgcatacagaccaccagaggaaggatgagaaatggaagaacagtggttcatctctaaagtctgatactgctctgtggaggctgttagtgtttggcctccacactttaaaggtatcttcaggtaacctacactatctattattttaggggcaagaatcaccaccatttcactttctctttgtgaattttctcttctctgtgctgccagtcagcatcaaatttggactgcattccaaccaaaagaacttacagtttttgttacatcactgtttagttggccctgttaatttagtttttatattaacattgagatattttgtgattgatcacaaatattagacattcagtctatagttgttatcatcaccttatttaagatgtaatgatctaatcacagtacttccagaggttctgattattaccagggacaaaatgtcctgtgcttttggtaattcccagactggtttgagggcacatcaagaaagatctcaaagaagaaaaggcaaatactacacactagtgctgtgtaaacccaaccaccataattctaattttatttgaatgtttggtggtcataaatagctacctattttctttaaggtataattcacagtggacattttaatatgcaaaactctccctgctggaaatttgcaaacataaatcaaaatgcagtcttaaagccctcaatgtaatgtaacagaagagcagaaaagcactaaaacaaaaggtatgacatttatttttacaaaagcaatagacacaagatggataatatataaacttcattcgtgtcctacttttgtgatctattgttatctgaaacattaatttcatatatcctgttcctctcctctgtaatcacagtttaaaaacaacttggattggcaccttttctatttcaatattaggatttttgactagtccagagccaaaaaatatgcaactgttatttgtaattacctgtaaaacccatgtagaattcactgtcactaaaccagaaagttcgcaattgagaaactgaaccctaaaaccactgggacctagatacctgttaaattaacttttatagcagttaaaactttaataactataagctgtttacctaaaaaatttgctgccacgtttgctatgaaaatgtcgaggacacatcagaattacctttcagaagtcatgcaaggaacaatgtttccccctaggagtagtaagagcacattttccattttgactttcttgccagacagcttggaatcgtatctgaacctgaattatagtaactgtctgaatatatataaacatagtcataatatatttcctaatcatgatttttgtttattttcttttataatacttcgtagtcacgtcaacgcaatctatttgttctacatcgtttctgatctctcaattttagtctaatatccctgggtttacacatacatgtttttcttgtgagtcaacacaaattatgtgggaagcaaatagagtttaattaaaataaataaaattatattgttgtaatcatcaacctgcaagaaatactaaaatactgatgactcggctgtaatgaaattaaggaggactgatattatcagtccccccccatcctgtttaaaaatgctttctcgatttaaaacaacagcagtaacaaactaaggaagaaacatgttgatcaatcattcttccccatctccaagctttttttcttcctaaagaaaaattaacagaaatgttaactaaatttttttaagtcccaaatcctttatataaaaagtcttgataagttgttgtagacaaaacccattcttagaatttatcagtcagttgttatatattgccctgtgctagttatttttaagagatcaaaataaaattcacttctgacagcccaaaatagttactgacattgtaactaaagcaacattgtaactaaagcctactttgtacagctcacctggcagagcagggtctagaaacagttctgatgtaacctaattgtgctaattactgtacaccccttctgtgagtaggataattgtcatactaacagttgccatgaaagtagaacaactgcagtgaagccattagatgatgatctctgactaccttaaatgtatgcatgtatgctgacatttaagaggttatctgaagtcaagcagtatccatttttccaatgagcaagtaacgatatatgtagtagtctactaagatgagaactttagtcctgttgcgcaaaatttctgaacacatgattattaatatgcagtcttcataacatctgagcagagagacatgggaactttggctcctatcctcatccctcaaattatcatctgggagccatttttttccattttttcattcagcctatagttatttatgcatttttctcatctcctcaactaaactagagtctcctgaagtcaggaactgtattttataaaatctctgggttctatacagagccttagacatggtatagacagacagacagaccgacaaatctacttaagaatgacctgggtttcattttaaagtcatacaaaaatatatctttgctcaattagctggaatgttgtattttttgaaaacacttttaaatggcaataatcagagacatattactctaagacaactacttgagatatcttagttcccaaaaaggttctttgtaaaccaggaattaactatttttaatatacttggatctgaagttttaatgacccacacttcagtattctgtcaactgctccagaatcgttgtcatagttacctagtatcaggaacataaagctaaataaatttcaatacaatcttaacccattgcaatttctgaagtgatacattttaataggttttgcaacatcagaggcctccataaaaatccatgcaaataaaataaaagattacagacttgaatatatgctgatgtttttcaagaaatagaaatgctttcaaatgagctctcacctagtgaactaattttaatttgttgatcatgtttcaaacagaaagttaagattcatctaggaatggtaataatgctttaattgtgtgagtgggttgaatcagataatgcagtatcatttgtaaagagttcttatgttttctacaggtggataagtggagcagctgtagtcaatgcattttactcttcaggaagaaatcagataggtaaggtgtattcttaaataattatttaatatttctctatcgttcccaacctgtagtgcattgtatgaccaattacaatacctctaaacaagcacagctgaggctgagttattgctctattgaatgcatttcttgaaagtaaatgcatccgtgtaccttctttcactatagtgggaaaattcagattggtacaaatcacgttaagtagttttgtttcttttacaatattcttatttatatctaaaatggtttatcttatttctaaatatttttattttatttctaagtaccttttttaaagtcccttgaatatatctatataaagtcatattgactttaagactcattaagcattagcttcttaaagtggtttaaggtttcaagagccaacttttcacagatccagtcctcctggcaattctgtatgctggctctgtgagagatgatcctattctatgtcatcttcattcaggaaggctccaaggggtttagaaagttggaatctcaattatattcgattgaatcgtatgaaattgtatttacctagccacaattgatcaaaaaagaaaaaatttcgtaagttcgcttatagtattattacagacatatatatacattaacacatgaataagttatcatatatgatgaataactgaatgacataatatgacaaaaatattttcttcttcttgggaaggcctggacatctttgaacatacattggctcacatatatcacttatcacatacattggctcattttttttcagggggtttttagcattagaaaggtactcaactgattcagtactgccagaaatattctaaacaaatagtagagcaagcttctgcaggtgcactcagttctccaggtacactcagtcctgcccttcatttctaaacgtggtctagaattaagagagatgataatctcagcattattctaaaccattcttcttatagctcagagtctgttgtaagcctcatttttattgaattctattaccaattagattagaaattataaaaaatcttacaagatatttatcattggctaaaaaaaaactaaccttaaaataaattgtatatttttaggttaaagtttgattatacctttccccgttgctttcaagtctaaaaagagttaggttaagaagttatctacagtttcttctagtatttttatgatttctatttttggagtaaaacctgaatccatctggaatttacgttggtacatgacctgaaactgaattatataaagtaaccagaaaagactgttttgtataacatataaataataagtaagatatgtttacttggcttaaaattacttagctcaaagtctaagctaatgctttctggctagggaaatgattacccaaacccataccagaacgtgcttaataatcaactcctcagaacctttgcagtcagtcctttataatatattatttgaaaccattcaaatcttgttttaaaatgcctttatctctagagagtcttcactttgaagccctctttttaatattcagtagttctgtcagtgtctagttcatttggtactgagacaaacgtaataattaactttcaatggaatcccaagtcaaagcaaggcaacttagactccttagtgctgcattagagcagaataagggatgcagcttcatttcagtccagcccagggaggaccctggatcctatcggagctcatgctggtgcatcctcagtaggaccactctggcatgttcagtccttcagcccttctctagagtaggctcaggcatttatgccaagcaggaccttgtttgattctgaattaccccaagcccctggaggtggctccaaattggcccacttcagggattccccgatcagagaagagctgaaaatattttcattttgagtataatgtcttgaaaccaaagaagcacacagaaaaaggaaaaagaaggtaaaagtggcccaatagtggtctatttcacaaaataaacaataatcctctggtaaatcaagaattagctataataacaattctgaatatataaaaaagaccttttccaagatccttaaaataaggatccaatggaaatataaaataagaaaacttgttaacctcttttcatatgcttgtctggttcttgaacagcagaagaagggaaatccttgaaatgtacactttttttctttcacaatttaaatcttcaaagtggggattgtcttaactaaaaatagttgaagagtcaaatctccatcttttttcttgataggaatgtttatgtgggctgggtgtggtggctcatgtctgtaatctcagcactttgggaggctaaggtgggtggatcacctgaggtcaagagttcgagaccagcctggccaacatggtgaaaccccatctctactaaaaatacaaaaattagcccagtgtggtggtgggtgcctgtaatcccagctactcggaaggctgaggcacgagaatcgcttgaacccaggaggcagaggttgcaatgagctgagatcatgccactgtactccagcctgggtgacaaaacaaaactctgtctcaaaaaaaaaaaaaaaaaaagaaagaaaaagaaatgtgtatgtgtatataaatacacacatacctacctatatacatgtcttctgcaacactgtcttaatggatttgggataatgtccattataaaattagggttggtatagagtaatatgtgccacgtaagtgagcccctccctccatacacacacatagacatacaaatactccaaattagactgcatacactttctcacgggattggtcattttatgttgttatgttaaaaaaagaacttgttttgttatatagagacttactcatatcaataatttctacttcttaattcagttttcaccattttgttagaactcacacatgtaggctacattccaatttgtatgcattcctactcttcatatcaacaaaaaagtcaatttccaagaaagaaggcaaactaaaagtgcttaatccactgttcctcttccttgcatgtttacttcatggagctctagaaggcccctgtgccatgacattaggaaagctgcgcttcaatgttttgtcatatggttctctgtaagttctaggtgctgttcagtcatcttattaaaccttaaaatcgcagtcaaggaaataatttagtgtattctcctttttcattaaaattgcagaaaggatcttttaaatcaatttttttaatttctcaaatgtgtaagttcttcagtgtgttcagtctgtgtcgactataaataccttgagatagttaaattttctaaattgccttatttattcttaggagttttattttcagacttgaaaattaagactgtttccaaacatattgttactccatttaatataaaaagaatgtttagactatgcatggtggctcatgcctgtaatcccagtagtttggaaagctgaggtaggctgattacttgagctcaggagttgataccagcctgggcaacactgtaaaaccccatctctaccaaaaactacaaaaaattaactgggcatggtggtgcatgcctgtggtctcagctacttgagaggctgaggtgggaggatttcctgagcctgaaaggtggaggttgcagtaagctgaggtcacaccactgcacttcagcctgggtgacagagtaagaccctgtttcaaaaaaaaaaaaaaaaagaatgtttaattattttccaccaaaaaaattacttaattgctgccttaggctacatatgaaatattctaaaattgaattgctagcagccttcagaaaataaaccacagaagttgtgctggggaggcaaaaacagggggaagaggagacatggtcttttgcttcatggcccaatgacttatttaattaactaacttgttgacaatcatgaacataaaaaatgcacaactaagcagttggttataaacaacagttgtgatgcctactaggtaacagcaataaggctagtggggaaaatcctccttacagagatttagctgacaaagtaaaaggggaggtcataattagcaaagttgaacttgaagactaatatttaataagaaccataaaagtcttatcacttgcctgaagaatggcatatcagggtatgattaaagcagcaggatctttgtagttaatatttagtcttgatagcacatttcataacagcattttatataatgggtggattttaatcaaagtacatagtgtgggagatagtattcactttaacttaataaagtactgcacataatttttatactttaaggtaaaaataagttcatggctccatttagctcaggctgctacacgtgaggtataactttcataaaaattctctaaagacaaaagtacttttttgttgtcgtgtcatttgaatgttatggcaactttccaaatttttgtagaggtctggggagcaattaaattgctcagatgctttttgaagtcttctctgtaaatatctaatatttatccctgaagcccatgcaaggttatactgtgttcagcccacctgaaagacaaagaaataacatgtgctactctgtgttaactagatcttaaatttcttaaggtcagggcccttgttttattttcttaatgtcctgcatagcaatgacccagggctttgcacttaataggtattgatactgaagggtttttttttaattacagaaagtaacgtttcagttattcagtggatgctagagttttaagccattaaagatagaattactaaactatgaacatttaattaatttaattttaatttctttctaaggtcaaagattagttacctccaaataacatgacccaaaatttgattaaacaggggaaatatattccaagggaagatactctccatcttttattagtatttaagacacattattagtatatttcagaaatagtgaaatatatttcatgagagtatatattataagaggatactggaatggggcagggaaggggagggtatgatggaggtggagaggtgggagaggaccctggggccataggccagaaagatgtgtttagctagagagcaatggtaagccttccaaagatttttagcaggagaatgatgatgcccagagttgtctttaatctggctacaggatagattcagagagtagattagatttagaatagattgtagttgtgtgagacagaaagtgggagactgattaggaaattaagtcattcctgagacaaggaatgagagtatgtgtaaacagtaatactgacaggagaagataaagatgctcctgaaagctacctcacccagcctctgcctaagcagacttgtaaaagactgtaaaagaaaggaggcatctaagataagtagaaacatttacttttgctgatagagacccttcaagggccattagcagaaataatacaaagactgagggcctagaggggaaaatgaatttgatgtttgatgcattaaatataacacatttgtgagacatctgaatggagaaagttagcaagttaatgcagatgtcagagtagacatactgaaaactacaattcatttatttattcactaaactctgtaggacacattagtaagttagggtgatcattcatttatttatcattgattattcattgattcagcacatttcctgagccctgattatgttccaggtactattctagttttaggcattgttcaattttaggcatttagataatgaactagaaaaatgtatgaaattaaaaaataaacaaatatatgtacagacacagaaatctctgctctcaaagggctaatatttgaggagctggggtaggattagggcagacaagaaaaggaaggactgtgatcataaagaaataaatagaatatgaggtagtcataagtgccttgatgaaaataaggtaaggttatgtgattgaggtataccttcaattgagtggcaatacttatttaagatattattgtagatggatacaatttctgcaataacattaaaaataatattggtgttactgagtaactatttcttccaaatatttataaggcagaaaggaccttctgaatgaaggttataacttccctttgcttcaaactccttacagcacaaaacaatcttggattgtaaagtgaatcgtgatgataaatcatagtttatagcaccactccaaggtgaactctgttgtcatccataataaaatgcctgcattggtttctattacagaaggtttttgtatataactaagtgaaactgacatagtgaacagcagcttagcaagcacaaagccaaccccaagcctgccatcactgaataatgccatggtggcatgcgcctgtagtcccagctactcctgaggagggaggactgtctctaagaaaataaaaattttaaaaacttatgccacaaataatctctaactatcttctctccttgtagtcttcccagccggcattctgcagccccccttctttagtgcccagcagtccaactcattgaactatgggggcatcggcatggtcataggacacgaaatcacccatggcttcgatgacaatggtaaagtgcagttgacattttcctttggctgaggtatatgctcataaatttgattaagagttattataatttattactacaaagctacatttattcaaacatgtatcatttctctaattttcaccacactttcaattttccctttaaattgttgcttaaagagatcagaaaattctcatagtgagttaagcaatgtgtgctttacactctggcagaatgaagtaaatattcccattgggaaaatactatggtgtttgtcagcggcagtgataatactaggtcttagtttcctggttgtatatgacgtatcttgtcatactcttaaaggacaggctgcatgtctatgtcttaaaatcagatgtaaaatcagaaaatattgcctctccaagagctcaaaagactcttaagctgcttaagagaccttttttttttcgtcttgtacctactacctagttcaagtctttgcaaacagttaggcacttaaatgccaccctaaatggaaaaatcaatttagagtttcaatcaaagctgaattcctgagaggaataaagacgtgaaatatgtaaagaggtgatagttcaatctatgacaaatttcattcacaaatggaaagtagagaacaatagagagaaaatacttaatccccattttagagagccagagaaagaaaaagagacagaaatgttagaattcttaaaaagacttactaagtgtctattaactcaaactatgcaacagtctttacaggtaggttctaatactgtttctgttttccaagtggaaaaaaataaaaacacatgaaagatttgcccaaaggtaacaaagataggaactggtagaaccagaaggtgaattcaagtaggttggctacatagcccttttcttaatcactacgtcataggcaaatatgaaaaagatggtaatattgtgtcaaaacacatgatacatataaatgcaattggagctcaaaagggagaaagatcgatgtagtttgtggttggcagggaagctgtaggagaaaaagactttttttgtgtgcttgaagtagagggaaactatgagtccacagtgtcctatgaagggtccaggaatataaaaatgccagaataaaaatgttggccattttaaaaatctcaaaatatcaaactaaacagacttgggtcaggtaaaaaccattcaacagaacaaggcataacttcaagaatattttgtctggcggcctcttctgagatatcaagagccaaatgggtgaaatgtctgggtcaatgctgagaagcattagcaaagaaagctctggcagtccaggctttgccaactctgtgatgaggagggatgacagtctctctcatcgtctgcctaatttaatgttctgtcacacagcagtatttcagtccttgcactttgaattaaacatatcttataattcttgttgcaatgagttcccattttacttaaataaatatattataggcagaaactttaacaaagatggagacctcgttgactggtggactcaacagtctgcaagtaactttaaggagcaatcccagtgcatggtgtatcagtatggaaacttttcctgggacctggcaggtggacagcacgtatgtcattagcattctcttgaaaagttttagacatgttcaatcttaagtgtattattggtggtttctttttttaacaatcctaataaagtgtcttttttaacagcttaatggaattaatacactgggagaaaacattgctgataatggaggtcttggtcaagcatacagagtaagtaaaaaagattttctttccattttagtgatttagagtgtttctcatatttaataattcatttaaaaccttttgcaaaaaaagaaactcatataagcagtaaatgatgaatagaaaatggaaaaaaatatgagaagaaagagtggtgaatatgctaaccataagggtcaatacattgatgtgacggagctgaacacttaagtttgcaaagagccaagaagaagagaaaatatggaatattatatcagctgaaatgaggagagagcaggttcacaaaggaggcaacatttttctaagaaataatctctggaataatttttttagaagaaatgtcccataagaaggattatttcagggtctttgaccaatataagaaacaggaccttcagttttgtagcaggtgaagtagcatttgggaacaaaaatcaatgtaaaccacaggcatattaaaccatagttcatatatgatacagtaagggactgacgtgatatggttccagcacatggccttgtagtcaaccacactattatacacagaggactattaacagtggagcatccgttagaatcccatttagccttccattcattcttgcattcaatacatattcattgaggcttaataggtttggcagtattcaaagagctggagataaagcaatgaatgctttatgaaaggtcattatttgaggatctgagcaagggttaaaaaatagtctggtggatgccatgtgcataagaaaaagcagggaatttcataaaagggtggaggaatgatggtctaggaagcaacaaaaaggaatgaagatgattttgagtgtttttctcaactatgaagtagcccatatgtaggagaaagagcagcatctacttgagatgtcacaaggaacaacttgttcctaggctagaactaggcttctctaagacaaggatggatggaatgatcagtggagtgaatgaggatgtagaatcatttgttcattatagaaatgtttggattagagtggaggaggtgaacatcaatggttggatcagggaagaggaagcaccagagaagtggagaaagaggtgactgatggggcctgcagtttgtcagtgaccaaagatgatcagagtgtgaagcttgggagattaagtcagctacaaggtttccaaaagaatgagtccaaccagttccagggacatgggagattgctgctactttgaatgtttagtaatttttttgttcgatgccagacattatgcattttacctcttttttttgagatggagtctcattctgtcgcccaggctggaatgcagtggcacgaactcggctcactgcagcctctacctcctgggttcaagcaattctcctgcctcagcctcccaagaattgggattacaggcatgtgccaccacacctggctaatttttgtatttgtagtagagatgggatttcgccatgttggccaggctggtctcaaactcctgacatcaagcgatccacctgccttggcctcctaaagtgctgggaacacaggtgtgagccactgtgcctgaccgcattttacctctttgggtctggatgttcttttgttcctgtaaatattcttgagctttattctaggatacagttaaattccttgaaaatggtttgatctttttgggtcttccttttgtaacttttattggttgggatggggacagtgttcagtctagggacattattctcaactgctgagataagaatctactctgtgaatcttggggatttccattcttgtcctgtgtaagtaccataaattattatctctaatccttttgagatattgttttcctagcattgggtattttgctcacacacatcttcagatcaagactaagctgaatgcttgaggatgaccatctgtaatctctgaggttctctttttgtgtagctttctcctctttagtaacctgttcttggtgtccctgaactctcagctccttatcctcaactcaaggagtacccccagctctgactggtttgctcctatgatatggcctgaaaactctcaggacaataagctcagcagtcatgggactcactgagagtaaagtttaacatctctcaggggtcattctccttttgcctgatgttcagtgttatgcaaaccattgttttaaatattttgttcatcatttagttgtttccacaagaagttaaatccagtccctatcattccatcttggctgaaagtggaaggcattggcactcaatattcccatggtgattctaatacacagccagattgagaatcactgctataaaatccagccaaagttgggattgatagtactcccatggagaacctcacctagagcaagtacagaattgttaatgatgaagcaaattacaattgtgcaaatattttattacactttgaaaatatgtaaattcttaacgtgtaatgccttgcccccctgctagattgcgagctctctaagagggagcaggtgcaagcctttcccatatccccagcatctttacatagtagaggttcaataagtctatgttgacggtaagtggaagaaatgaaatatattttctgctcatctagttggtcacattcctttgtattaaattggaaatgacacatctcagaacgtttattatgaattcgttttaaaagtttatttagtagaggaaaactcatttttttcagtagcataaatctttaagaattaagaggattttctgacattcaaattacctaaatattttccttcaaatgtacctgaggctcagtccattttgtcctgtcttcaaaagaccagaatagttgcattttattatcctcagactcattggagactaggcctctaagggatctcaagagaatcctttgacttggcaagaatcactcgatcttagtctggtgagtctattttgctaagatagtagtaactaagttaaatgtagcaattgcagacttccttggcaattcatttgtcctgactggtcttattcatcaatttataaaacaacatttagataagtttttcatcacttatttaggtcatccattcattcagttgacatttattgatcacttgacatatgccaggctcttgtcatctactattcagtagcttcttcttttcaaagcatttgtaaataaatttgatttgtctttctaatccataaaatagttgtaggttaccataactaaatgtattatcagggtgattttaacataaaatgttaattacttggtggcatgatcttttacataggtttatatataaccttaggaattaatattattgtttttctattttatcaactgcctaggcctatcagaattatattaaaaagaatggcgaagaaaaattacttcctggacttgacctaaatcacaaacaactatttttcttgaactttgcacaggtattgtgtctttcttgattgatagatatgaaaaccattttgagttataatttcacagtaagttagatgtcacatgctgagttcccttgttttacagagcatttgacttgattcactttcattgtttataatagactgttggatcatattaatgataaataactatgttcctggttgcctttcattgaacattatttgaagagcaaatggttgaggaatgcagaattccaatttaatttttctccttcccctcaacttgctcaaacaaataatccttgattgaacctgagtacatgctttgcttttcctattcctatctctaggtgtggtgtggaacctataggccagagtatgcggttaactccattaaaacagatgtgcacagtccaggcaatttcaggtgcgtggatatgaacagcaatcaaggtgctcttatattgggtccattgcttccacatttggaatttagacttttctaactctgattcttttacatttggaaattcagtgctttttttttttttttgagagtcaaaggtaggatcgagagaacacatcggagcattctacataagcatagccttggccactctctttcttagaatctacaataattataattccttagaatctacgaggctcagggcttgatctattccaacaaagatgtcgcctcagaacagtggctcaatttaaagctagcacaaagatatttctaagaggctgtgaatggtttaggcccagacccaatgagctccaacttgcaaagaaaaatttcaatataaaggaaactttctactaattagaggttcttcaatatggaataacattattcccaaagcttcaggagagagtacattgaagcacagcccatcaaggatgtgagagaaaaatgctctacagagtagaaaactgagctagaagaagttaaagttcttcccaaattagaaaatcaaagagaacaatgattgaagagagtcactccaaccaacatttgaatgttaaatcatagatcctatgtatttgtttaagaactgaattcctaatgctacccctttcccatgtactagaacacttagtcactcatttgctgatcaacaacacctctcaggcaagaaagttaaaaaaaaaaaacctaaaaattttgtagggtagttggaaaatgaaatttgagaacaaaagagaactaatgggctaaatttcaaaagctctacataaaatgaatgtaagcatactgcccagatcatttactcctgggaaaaaacacattcgattatggagaaaaacacatttaattatgaagcaataaagtagttcatttaaaaattaaagaatttattcagcttgctagtatcatcgttgtcatcatcatcatcatcatcatcatcatctagtatttgccctaacatttctttcaatattcattcactcaataactgcttatggtatgcctattatctctgtaatccaagctaaatttagttctgctaagatattcaaattaactgctttataggtaatgagcaacaaaagtgactggattaattcccattgtggtttattcaaaaaacttttagttttaatttttttaaagttgtctttttccttactaaagtgaacttaagctttgaggtaagaaacacttgagttccaaccatggcttcaccatttactagctgttaatgtaacctctgtacctcagtttcttgatatgtaaaataaggattaaattatcatgagagttgctagaggattaacgttaatataaatgaagagcctattttgtgtgtgtgtgtttgaaagtccatactaggattatttgtagacaagaggtatgaacagaataagaattcttatgcattttgtaatagttccctatcagtcaaggcttttttggtgctcatttcttatgttctgcacatttcagaatgttagtaactgatcagcagttaagtaaaacgtacataagtatataactgttttctagctccaattttaaactgaaaacaatattttgctataaattagttaaattatttgtatctttaagtctttattgttgttctggttccaaagatccctcatcgactatttttcattcataacaacagaagcgtgtgtgtgtgtgtgtgtgtgtgtgtgtgtgtgtgtgtgtgtgtgtgtgtgtgtgaagggtaaatggaatgggtaaatggaatgccaaccttttgtcaaggaaattattgttttctctggaggtaaggagattttcttggcaaaaggttgagcttacatttagttttggaaacaggccacttcctggctgtacaaagtaaaacatattttttaaaaaaactttaaaaattaatagatatcgagttgctatttaagaattgtgcttggtggttatatagaaatatttctgaattagagagagatttgtaaccttatgtttaaatagccatagtattaaaacaaaaggcaaaatacacttgatacaaagctgcatcataaaaccatatttgctatgtctaacctattgttgttttattcttcctgactaaagctttatttatgtactttaaaataaactttagaagttaaggtataagaatctaattctaaggatagcagctagcatttataagctcataaaaaccaccatgcaacctaatttgtcaagggtttgccctgcatatctccataaactaaaacataagtcataaaaacctaggtgaatttcagtaatattattgtaatacctagtatatctaccatcctcagagaatgagaggttgcaaattaagttttgataggtaaagtttgtctcttttaagtattaacatttttatcttaaccactggattaaaaattatctattaaaaacacatttctaccttcctgccttaaaacaatatcctgaaaaaaaaagcctaaccttttttaaaattttgatgacacagactactttatgattattagttatggttttactgtttattaatttagtctgtggagctatttattcttataccaattgtgatgctttttgacttattttgggtttttattagggtttttctgtgtgtttgtttctttcctagttttctttcctattattgtattgcctgcctttagttccctaattcctccattttgattagctcagaaaacattttgttaaatttaaatggtatttaatccaaaaacattcttcttttaatagtctagaaattgaatctataatttaaatattgacttcattttggaaatccagtttttggttagccatctatagtcatttcagggaatatttattataatatttatatgtaatctataaatatgtttctaaaattatttagctgtaattttctatataatatgtaagggtctgataattttgtaaagcaagtccaaatagacaaaatgatttaggtgcttagattactcaacattatcttccagtcaggaagaaagggcacttttagaactgacaccactatcaaagcaagaaatgtttctcacagcttaatttctaatattttgaaggaatattttgtctagtgttttatatagacatgttcaactaatatggctattttgttccttcataactctgtaatttagcatgctaataagccctctttgaaattcttctgtttcttccatttcccttcaatattagcattggttcctgatatttatagatatcaatatagattttagtgagttttgcagaatttctgttagcccctccaatctttagctgataactagaaatctattacagcatttatttatttatgactgtatagcagaacatacactcatcaatatgactttgctttgaaagaatcataaaaattagttaatgatgaagattggataccttattcctgaatgaaggcagttaactatgtagccaagtcattcatttacaagaattaacaaaaggttgtctgaggacccattaattgcaaacagtaattcagaagtccaattgtagtaggcaggaatagtcagataggatataaagtccattcttggtcccaatgccaaatctcttagatgtttttaatgcaagtaactgtttgccaagggaataaacatcagcagtacaataagttattttacataataaagtaaaaatttcaagtaaatcaccttaagaaataattaataaaagctttattatcttctgttattagaaacacaagcacacagttttgtaaagcatgaaaatcatgtacatatcttctaataacagaggataattcatgtaatgtgatctcactcttagaaaaaaagtgttttattaataatggattcacttttcaaaatagattatctaggcctggcacagtcactcacacttgttaattccagcactttgggaggccaaggagggaggatcacttgagctcaggagttcaagaccagcttgggtgacatagtgggacctcgtctctattaaaaacaaaaaaattacccaggcatgctggtacatgcctgtagttccagctacttgggaggctgaggcaggaggattgcttgaacccaggaggtcaaggctgcagtgagctgtgatcgtgcctctacactccaacctgagtgacagagcgagaccctgtctcagaaaaaatagatgatctattcaaagatttgatgtcataaacaccaaatgttaactaagaaagtaagtgaagccctagtgtgttgttgatctattcaggatcaaattaggtagagtctttggatggaaagaggatgggcagaatgggcatggagagctgagtgcacaccaggctgagtatttctgcagtgcccactctctgcggtgttatctgaagacgtttctttcttttaggtgttttttgtttgttgttttaacttaattttgagatttataaatataaatcctaaaaatactttttaagaaaaatatagaattaagtcgtgggtttggacattattaccgaagtacttgttcccatatgataaaatctaagaaaaaatcctttggaaaaaattaataaaataaaaacaaaaacatgcagctcttccagtcagtgatgctgatggcttaccctgtcaaccagggagcttgctccctagtgtgaggaatgcccaggatgacaggatgactgtctttagccagtagctaggcatcctgaattgggaagaaggttgcattaatgaatcaaagctcctctctaacataaagaatccttgagtcccgcaacctgaaagactaaagaccaatgcaaattcctaatttctaagctcttttaattcctacataaacagtcacttttgactacattatagaagtgatttttttttggctcatgaacaatggaaatttgtttctcacagttctggagaccggaagtctaagatcagggtgccagcatgatcaggttctggtgagggccatcttctggtttgcagactgcagacttctccttgtactctcacatggtccaaatagtgaatttgtttttcaatatttcagatgtaagaaatggacatttgtttttttcaatcaaattaagccaaactctgagctcttagaccaagctaggagatgagccatttactttcagtggtttttcaacgtactctttcagggttattcaggaatctgatatcatcacacaggcatagaaattagagaatagcctccatcttcagcccaccgtggtcactgctgagatccctacagtccaaatgctccagctggagtcagtggttccatttccttccaatgctcatgagctccagagcctccactcttcatgtccaggttctccaacaaccacacgccatgctatcagagggcctctcggggccttgctcagagcaggaagcatcttcttgtcattcacacaacctgccattactggaacctaccccattcttgggaaggccaatcatctccctgacaagtggactaatatataaattccccagcttctgactccacttcacctcaaccctcccacaccaggagattatttttcgtctttaagactcatctaggaatcctaaaaaacaaacaaccagaaaagattacatcctccatgaaagataggagagttgtggtggagagggatagagaagttagttgatgcgttgatgggtgacatattagaaagtcagacttacaaaaaatccatatggatctctcttttctggaatgaggaaagggaaagaaaatgctttctttctcttccagttggtccataatatcaaacaaacaacagaaacactaagtcgtgtttttcttcctaataccctattgcttctctacaggtaatcactgtgaccaaccaggtcacaggttaattcattcagtatgtactgagtcctgtgctggactttgggggtgcagcagtgagcaagacatacacagtacagcatcttccctcagcatctgtgggggtttggttccaggctccctgcagatatcaaaatttgtggatgctcaactccttgatataaatggtgtagtatttgcatataacctatacaccttctccctcctatactttgtcacctctagattacttataatacctaatacaatgtaaatgctatgtaaatatttgttatactgtattctttagggattaatgataagaaaagtaagtccatacgttcagtagacaaaatatttcccccacatatgttcagccgcatttggttgaatccacagatgtggaactcaaggatacaaaggctgtattttgccctcatagaaattagtctagtgggtgtgtcaggaagtaaaaaaggagaacaaatcattgtaaatgtggtaagtgctttgatagggatagtccctgtaagaggagttagtttagatggcattcaaagaagggggccaaggaaggaatatttaagcaaaggcatgaaggctgaggagttagccatgtactgactggtgagtaactttccagggagtagggtctgcaggtagcaggaagctctgaagagggacagggtttggctggtttgaggaactgaaggtaggtcagcatagtttgagcctaaggaggaacaggaagagaaatgtaccacgaggaggctagagaggagactggagccatcaggaggacattggaagccatggacaggagtttagatttccttcaagtccatggaaggttttaaatctgagattatggaatctgatttaaattttacagatcattctgactgtggtgtggagaatggttggaggagagagaagtcctaagatgtacacacagtagtacacctgccacgtagggagaattccataaatcaaaatggactcacctgtcatttgtgcctagtccttccaaaccagtccacttgtctctgggcccctcctcccaacccaagcaaacgtggtaggctggccttagcaggaggagaagggaaggaggtggttcagggttcagggtgggtgtgaaaacatcacctctgcatcaatgtactgacccatctctcccctcaaacactgctaggtgcagatagtgagttggactgtgttgtttttgcccactggggtcagagataagaggaaaatggcattttgccagccctttccagttattcaagctgaatccagcttctgatatttaaggagcccttttggaaaaaaggaaaataatcctctataaaagcaacaaaaaatatctatttaaagtctattatatttaagtcattatgtgagccctttcaagacatagtgagaaatcatgattatattctttgaccaaactcttattataatacaactccaaatacctgcattttcaaatgtgaattattcatgttttacaaacacatataatgcttataaattattaactctccatgacaaccttaagatgcatgttctattgtgcagaaaccaaggcacaaagaagcttcataagcaggattcaagccatgtagtctgtctcccaaattgcttttaactcctgttctttgttacttctccatttaaaaattctgttaatgagaaggcactgactcattgtaccaggttattttaagtttaactttaaattccaaattcattcacttgacctgcagagggaaatgcttcagggctccagtgtggtatggacgtgagtatcaaatgctgacggtgactttttttgtttgtttcaaaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgttctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctgttccaaactgccaactcctgtgtaaatctctaccccatttatttcttgaaaaatattaagattaaatggagcttttatctctgtagtcttgcatttcccactagcttcaaattgaatttttagaaaatgaatgatataagctttgtatccattatgtccttgttttccccaccctttttcaaagatcaccatgactttctgattggattttttttcaaaagtgaaatggccatcaaatgttatatggagtcactagcataatcagatgacttaggcaaaagccaaaagtaagtgtctttatccacagtctctagtctgaagaagttgaccatttggttggtcaagtggacagaggagtcacatctgactggtggtcaaactggcacatgtttatcgcattctaatcttttatctaacaatggtttcttaatttctgcttctttgtattttgcatttcctctaaaacagtgagaaacactactttcactttcaacctcatagacaaaatgttgtgcttctattttgcttgacaaaacagatcttctcagttgtacaaaggaagtctggcagaaaaataatcattggctcttgccagaaataatgatgagtttccaacttggggaagtatagaaagactggaaagactaatatttatgataaatgtttatactctggattttccttctacccagaaactgacaattttgcgggtattaggcatattagcatcccatttcgctcttataaatacacttgatagaatctccaatctgacatttatgctatatccaggaagacaaatggagccaagtatctgtattatcgttttaccttggtgtaaatccttcttacatgctatgaatgctctatgtcctctgacatactgcatcaaagatgtaatgctaagacgtatggcagctttataacaccaaagaaatagggattcaaacactaactagggctgggtgcagtgcctcacacctgtaatcccagcactttgggagtctgaggcaggaagattgcttgagcccaggagttcaagaccagcatgggtaacacaaggaaaccccatctctacaaaaagtaaaatacaaaattagccaggcatagtggcacatgcctgtgaccccagctactcgagaggctgaggtggaaggatcgcttaagcccaggaggtcaaagctgcaatgagccatgattatgccactgcactctagcctaggcaacagagcaagactgtctcaaaaaaaaaacaaaaaataaacagaaaacctgaccagcagaaaatatttagatgtagtaaatgaaaatagaaaaaggacacaatgttgagtatgcattatcatatcaactatgttaaaatattattccatagaaaaagagttggaagaatatatggcaaaaattaaccagggctatctctgggtggtagtattataagcagttcttattttccttttttggttttctacattttaagtttttctgtgataggaaaatgttactcttaaaaagtcattttaaaaatattatttggaaagaaaaagaaaaggaatatgaaagggaggggagtgagggggaaattgacccaaaaagaaaaatataatttccctaaataaaagggttgttaattctttttaggacctattcaatttgatgtctcaggcaacttagacccaaggaacctggtgaagtagattttggtcaagagcttgctgcctccaggacaggccagatctgtttataaagtaactttgacacacactgtataacacagaatggaggaagttgctggaccttcctctggtacttaaagtgcttctgtgagaacaaagcatgtaatctagaggaggttttgggctttttcctgaaaatgctaaaaggttgactgacccagccacactctcccacctggtcctccgcacctccccaacccgccccaaaccccagcatttgccaaaccctgacccagat

SEQ ID NO: 12663 - DNA, 107329 bp, Human
gccccgcatgcttatttgtgggagtgaaaacaccaatatttcgggattgttgtgaggactaaatagtgtctgtaagatgcacagagaaagcgtaaatagacgtcaatagcacttgttaggtctacacactccatttttcctctatattaatcgaattatttaaagattggttagctttttggggaaatgtctctccattgtattccacttattaggatgaactaccttttctccttgcttttcagctttctctgctatgaaaaagatggaaaattttttagcacaaggggactcttctcaagcagtaaatcattttgatattaaaaacagataattgcaaacccagttttatttcagtatgaattccgcagtggagtgtgaatatgtgtgtgtatgtgtgtgtgtgtgtgtgtgtgtgtgtgtgtgtaattacctgtgattcaaaagaggaaagggatcagtattaaaggtacttgtacactggaagcaaaaaaaaaaggaagtttagttcctctgagctccttggcaattatagctgctaaaggtagcttttacaaagaaactgcctttgtgcctaaagtatttatttccttgtttgtatttacccctttgaggaggaatcgctgtgtcttgagtgaaaggggtacgctgcttgcttgcattaaactgtgagggtccaggcgcattacggctgatttcagtaggtagagcagacacactttagtttatttttctctttctcactccccaccctcaacctccgatgtacacacgttttaagattccctgaagtcaggaggtgggagcggagagtttcagttcagatcttgacatgagagtacttcgaccaaggaaaagaaagggaagaaagagggaagcggggtggagaaagcaggagcaaggaaggaaagaaggaaacggggagggagagtaagaaaaaagaaaacgaaggagggagggagagaggacatttaaatgaagaaggaaggaagcttggattcagggaggaaagggagcgggaaagagagcgaaagaagagcgtgagaagaggcaagcattatagtctccggtccacaggggagagatggagccccctcaggactagagaatcccgaagagcccgtgtattgttttcttgaaagccccgaagctaagcaattctaaaaatgtttagcaaagcccttttgggaatggtgagatggggggtggggaggatgggacattttcattgccaccgcccgccccccgtctccccggccccctcacatgaagtgactggatttgggagacctagcggaaaccttcaggtcacccagggaactgctcctctctctggtcctgcagcggcgaggcggggtagggggtggggggggtgggccgtgagagcgccgagacgcgcggggcgcggagatgtgcaagtggcgaagcttgaccgagagcaggctggagcagccgcccaactcctggcgcgggatctgctgaggggtcacggtgagtctctgtgggtgcgggtcggagggatgcccaggtgcctcgtcgccccacggcccgggcggaggcgggtccggaacctcccccaagtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcccgaatcccactggtgagtcccaggagagcgagctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaaggtttgttttcattttggtttctgtcggattttctcatttgtaactcacttttctatttttacttttcttaaccggaagatcttttcattatcccacctcttcatcttgcttttaacctgatttcctattatataattaatgcttaaatctcacaagggttggtcggtgcggggctggtgtgtccttttgtagatgaaagtttaagacctcttaactggtttcagtctatttgtctggtttcaaaataagggtaattgcaaccaaatatccctctttagcttctcgatcaagtcgattcctcccccatatatgattcaaatggcaattttattaaactgaaaactagtacctgacttgcagcgtcagcatttggaaagtgcttgtcggcaaatcgactgtatgaaggcgtgtagcttcatcccctgccatttttgtgggttctagcactttaaaaaattgtctggtaatttcttggacttaaccctgtgtctttggttgtagagcagcactaaccaggggagtaatatggttggcacttcgtgtccagaactccgtatttcaggctgggaaacacctaattaatgtctgggaaacaagaagatgatttatcctgagtacctctgtcctcagcttctgcagacacagtttaaatatggaaactgtttctccttcttcctgtgcctcagtttccatagaacaaactgtaattgcatagcacagcttcaggaacctgcagatataagttaatgttataatgtgcagtgaagatgaaaactgcttagctaagtctaagtctgtaagtcaatgagatttcctttttaacaaatcagttatccaggtttcctgctttgactgtctgatatagtaatgcttatgctcaactggtataagaattgctgctttacattgctttgaaattaagcttacacttaaaatagtaatttattctgttggtaatattgtcgagctgaagtttgcaggttcttgttatcttagacctcctaattctctattctcgtctgtggcagtgtccacttttccgtttaaactttttatttaacacatcttcagttgaagtgaaatattttaagaatacaggtatgtttttgcgtaccctgctttatatgggactataagcctcaacttggtattttttttttttttgtattcttttgtttacttgtcccccttactcttctctatgggattgggtgtggttaagttggatattcaggtatttggggtttagtcatatgttccacagtgagattccagatactgtcccctgatgtcttaaagaaaaattgtgaaccttccagaattaactggaaatgaacgacaaagttaattaggagattaaacttgcatcatttctgcttttgctcaatgcttttgaaaaaaggctactaagagcaaaagacttcctttaagaatttacagggcatttacaagagggggagatggaggaagactttgcaggtgattcaaagattatattgttttgatgcagcttctgtcactgtcttcatttctctgtaactgtttctgcaaacttgggtgctgacccattaagagcccagctgcttcagtacccagtctcaagggtaaggaggagaagccaagggaaagtaacttacagggagaaagaaatgcttatccactagctttactacaccacaaggcatggagtttccacagagcacctgtaatttaaccctgaggctgccctggttcaccccttcgctttactttacagggacactgactgtcatttctaaggaagaactaagaaaaaaaaaagtccttttataccagtaaaacatttctctacattgtcttctgacatatgcggggggaacaatattcaggaaagggaaatactttagcaaatgtgcttaacattcaggtgttctttaggacagtcatgaaacatggggagactgggagaattattattgtttacctctctgtaaagtgtccagagtattattaaatttgttcccctctttcctttgcccaaccaatacactattaaaataggactacaatcaatgcaattccatatcataaccccaggggtggtgagactaagccagcatgccttacataaccattaagtaagacattttaacattcaggtacattacattccacttttatttagcagacacggttttcattgtgtaataaaatatttttatttgatagtctgtccttgcttatagcctcatgtaatcaaggggacagcatgtttaagactttgtatccagaactttaaggtctagctgtggttcgcttattaataattcactgggaaggttaatttctagttttctgctgggtctcccagaccatacttcaaatgtagaatatgtttcttctttctcctatgcctcagtttccacaaaacacacccttagagaattgtgtgtgttcaacaaagatctttaactataagagcatttctgagccgccacttcatcctgggaccaaattctaagagcaatttgtattgagctataaacagctaatctgctagtttaagatgttcttttatacagtcatgcagaaaaatggaaattgtgtgttctaatccttggagactggctgataaagtgtcactaggcccctgatgaaatttaatatttaggcttatatccccttaattttccccctaaatttctacagtacgcttttactgcatgatgatacagctttattttgaacagtgaccaaatgtgttctttacaaagaatattgacgagttgtgtagtcttgaacacgttgcctgacttctctgtgccccagtttcctaattctttattctattctgtggcagtgtccactttttggtttaaagtttttaacacatctccagttgaggtgaaagattttaggaatacaggtatgtttttgcataccctgctttatacaggactacaagtatcaacttggtaactttttgtactattttgtttacttatcccccttactcccctcttaaatgggattgggcgtggttaggttggatattcaggtatcttttggtacagtgagtgaccattttcagaatgttgtctaaccagttaatagatactggtatcagtagtagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaagggtgagtttaaaactttcttaatgatggtacagcaattatttgcttataaactgctgaattaatcctacttgagtatttaaccaagtcttactgtctaattttgctgagattttcagtgatataccaaagcaaaacaaaacaaaacaacagcaacaaaaaacaaaaggttgtgactgagacctgtcaaattcatttggctctatatactttgcattcagcaacaaaattttgacttctcaacagcaaaaatgtatttctattttaaaataactgagccttttacttttatccagccacattaagcatttggacattttcttttttatttatttgtttttcattattagtattttcattttttgcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatggtgagttactcccacacctgtgcatccataagtgcaaaagagaaggaaatcttcctccatgcttttaccatctatccaacgaatgtgttaaggatagaggcacttaaagactgacaaagagattcatttataaaatgtaacatcaatatgtcaaaataattaactttgaagtacggtgccttttatgtttgagctaagttattaattgcaagtatatttagtgcgctcacgcttacttatgaggaatctaaagtatggttttatttgattaaaatatacacaattttatggccagctttagtaatagtcattagtcaacttttgttgtgtcattgaaattctaaagggcttcacaggaatttaacaaatttaatttgagtcttggaagttttttacaacaaggatgaaaaaagattgattgtttaatggttaaaaaaatgattaccaagcaaaaacaactgattatttcaatttaataggcctggggcttcgttggtagagaagatataataacacatttttcttcataatcaaaattttaaatttagattttacttattttattttcttatattttttctaaccactgacaatgatatataatgttcagtttttagttcttgctttaagaaattgcttatttaattggcagtttttaaaagaacaaaagaaaaatagaaatttaaaaatttgtgttgccaatatttatgtatattctctcctttttctagatggtatttgcaagtcatcagactgcataaaatcaggtaagaaatggtttttacgtgtaatagttatacaactgatgtataatatttaaaattaaatgctaatcttaatttgctttgtttacacttttattcattgtagatcaattatttatgtgtctggctctataatcaatggaaataaaaatatatttaagtagtagattaattaacttgtttactctgaaaaatatattactattttcagccctgggctgtatagcagggcaatagaaaactatatcgctatttgtatggagcttgccatgtagttgaagaaagaaaatgaacacatatgaaatggtaagtttcgtatcattgtgttaaatgtctcagtgcacctcactaggtgggtgagaagaagggagtgagatgtaggcatgtaaatctaggtggagaagttaaaatctgggaagaaatttcattttatttattttttttattttttatattttgagacagagtctcgctctgtcgcccaagctggagtgcagtggcgtgatctcggctgactgcaatctccgcctcccgggttctagcaattctcctgcctcagcctcccaagtagctgggactacaggtacccaccaccacgcctggctaattctgtatttttggtagagacggggtttcaccatattgatcaggctggtttcgaactcctgccctcaggtgatctgcccccctcggcctcacaaagtgctgggattacaggcgtgagccaccgcacccagccttaaatttgggaagaaccttgaagcagggctagaatttagatgtggcggtgcagaagagggaattccaaacacaaaagaaagaaactatgttattgagaagtagtaaaagtgtacgcttgatagaaggacacattatggagaaccttgaaatccatgtttagccttgatattgtaatacaggagaaacagatatttttgaacagaggagtgatcaggccaaaggtgaaagatgattctgcgaatgtgaggttgactggattgagtgaaaaggagggcaggcaggtgggggctgcttctgtactccaagtgtaagctgaagaggttggcctgtggtgagagaagagtactattgagataatggggagggagaattgggtgactcagtagaactgacttgctaaataaaatgaatgaattgagaatgatgccaagttttaaaacccaagggactaaagagaatggaggcagcccacacagaaatagagaggttatgaggtggatgtggatgtgtttggtctaagatgaaaatagacaggaggaaggtagagatgaggtttaagaagctggaatttggatttgagatctgtcagtttaggagtgatagtggaagccttggaagtatttgagttctcaaaagaagagaagaggttcaagggctaaacttaagaagaggttcaagggctaaacaacatcaatgattagaagagaagaaaaataagtcagagcagaaaacagagaagtgtatgaagctatataaatcccatcaattggagtgtggtgaaaatgggagtatttcttctttcttcaagaaaaaggaaggtggtagctgagggcagcacctgggatatgaacacaatatttgtgtcctttaacaagagattctaaacctcctttctaacatctatgtgtcttataagaaataaataaactgttccaaataattttaaccattttctgctggatatttttaattttatttatttatttatttgaggcaggatcttgctctgtcacccaggctggagtgcagtattgtgatcacagcttactgcagccttgatctcctgggctcaaggcatcctcctgcctgagcctcctgagtagctgggactataggcacctgccaccattcctggctaggttgtgggttttttgttttttttgtttttttttgttttttttttttgtagagacagggtctcactatgttgcccaagcttggtcttgaactcctgagatcaagcagtcctcctacttgtcttcccaaagtgctgggattacaggcatgagccactgcacccagtcttggatattctttacttggatttttgttattcactgaactttgcaaaaaaatgacgggaaaatatctggcaattctaggttatagtctaatatcctgaatctgtgccctttggtttttttttttttttgtatcgttttttgatggatttttttgctctgggtcacaagagcaatgactagacaccctgagatgtgatgtggggagcgtgagggagacttgatttagatgttagccatttgctgctcgacatagtaagtttttcccaaaaacgaagtttctttattccccagggaaatggctgcacaggtaccttggctgggggatctccgtggtcatgtgcaaaagtcagcatgtgcccaagttgtcaaagttaacgtttacttcctccccagatcctcctatgcttcctctctctaccagctaccctattatatgctcaggctgtcctgtttcgggaaacttccacttacatattgactactaagggttaattcctctgtctttaatacacttgacatgtctctttggtatcttaatctatagattctctcttctctcactatttttcctttttctcttcttttccttgaattttattttcgaagaaactggattttttgactaggtaggtgtatttctataaacgacaagtgattttgcctcagagatctaggcaggtttttcctcccaaggagcaatgtgacattcagaatctggaatcttaaatgtgacttaatgtttagagataggatttttaaatagtgtttggcaagtctcaactcactaaaatgtatttaacctgtatcctttaattgtagcttagaaatcaaaccaaatgtaaaacaccttgcaggatgtatcttggcagagaaatgtatacaatagaaataacttcagtggtaaacaaggttgctgtatagctgtatatttttcttcattctgctctgttggttcacaagccattagaatacttgttcacattggtagttactattcttcctaggagaataaataagatgacacacaccctcatggatacactctgcatactcataaacacacacactcgtgcgcgcacacacacacacacacacagtcttctgctggttaggaaatcttttctgccacagaaaaatacaactatttcttttagaagttgttgcaaattaggaaaaccctagaggaaatcttggacaaaagcaagtattaaagaagagtggccagagtagagtagatggaaagaaaaagaaatgtgaaaagagaaggctgggcacggtggctcacgcctgtaatcccagcactttgggaggctgaggcgggcagatcacctgaggtcgagagttcaagaccagcctgaccaacatggagaaaacccatctctactaaaaatacaaaattagccgggtgtggtggcgcatgcctgtaattccagctactcaggaggctgaggcaggagaattgcttgaacccaggaggtggaggttgcagtgagctgagattgcgccattgcactacagcctgggcaacaagactgaaactccatctcaaaaaaaaaaaaaaaagaaaagaaagaaatatgaaaagagagatgttgaaaaaatataaaatatcttaccagcaagtctataggtcactttaagagagtgggtgggttcaaacctgagctcagaaattcttgagaatgggaaaagcaagtattgacactcagggtgcttacattatatgaaagatggccccaacttgaacctttcttccagtggaagggaatgtcatagcaaatgtacttatctttgattctttgaagtcaaggaatacagaagtcaagccataccaagacagaagtaaaatattgcagaaggctgtttcaaatctgtttggtgttacatatttaaaatctgagcatctaggatttaaatatttatgatgtacataaaatgatgtttatgtatactttaaattaacttgcctatatgtgtaatgcatcagtatgaaagattacaccagacctaaagtaaaacaaataccacttaagaaataacaacttaaggcagggatcaaaatgcttcaaagtattattcatcgcttatttaccctataaggtcatcaaaaacttagagttataaaacttgtatgtgattttgcagacttttccgtgtaagtctgaatcctgaaactgatttccattgcattgtaacctccctaacttagatttcaaggaatcttgtgctttaaatcagggtttctcaactcaatcactattgatatttttgtgctagataattcttcgttgtggatgctattctgtgtattataggatatttagtagcatccctggcctctaccaactagatgtccagtagcagtcctctcctagttgtgacaaccaaaaaatgtctctagccattactaaatgtcccctgcaggcagcacggtcacttatgactgggtaccactggtttaaacggtctcaagatgttatcaatgcttccctcttaacggtaggcaggataatggcctctcaaagatattcacacccaattcccagagcctctgaatatgttgccttatatggcaacatgcctgtaatcccagcactttgggaggccaaggcgggtggatcacttgaggtcgggagttgaagaccagcctggcctacatggtgaaaccccatctctgctaaaaatacaaaaatccaggcatggtagcacgcgcctataatcccagagggaggagaattgcttgaacccaggaggcagaggttgaagcgagccaagattgcacgactgcactccagcctggaagacagcgcaagactctatctccaaaaaaaagaaaaagacaacagagaattgaggggtctgcagaagcatatgttagaagtgtggtcctaaattatccagaggccagagaagccaagctaagacgtgatcaatacagtttacaagagaaagtgggaccacctccacctgtatagtcatgcaggttgtacactgcatatttgtcgatggcagccttgacagacaggcttgtggaacatcaagacctggatgaaacacctctcagaactgtccactccttttattttaattctgcacataccaagaaaacttttgatgattacttaattattaatacaaggagaggtggcattctgttacttgaaagatattttcatcatggtgagataatgcacagcggtccccttcttatcctctgaggatcccccaagacctcagtggatgtctgacactggactgaaccctatatatgctatattttttctgtatacatacctatgataaagtttaatttataaattagacaaagattaataacaataattaataaaaaataaaacgattataatattattccagcatcactattcttatggtttggggccattattaagtaaaatagggttacttgaacacaaacaccatcatcctgcaacagttgatatgataataatggagaaggctccttcgtgactttcatcatgctactcagaatggtgcgtgatttaagacatatgagttgtctgtttctggaattttctatttaatatattggactgtagttgaccatgggtaacaaaccatggaaagtgaaaccacagatatgggggagactactgtacgcacatactgatttaatcagatttgtgtgctttgagctatgaccctggaactgaaatgaagcttgcaaatgtctgcaagggccagatcatggtgatgccctaggtgatgcatcttggcaacagctagccttctcctggctgtcacaaggcatctctgccttcttgcctgttaacaccttgaaacctccatgaaggaaaacagcacaattaggtaaatacaggaaggactgatggctaactcatgggggctactggccctgtagcagccttttagtgtaggaaatgaggctatttcattatgtagttaagtttggaaaaaatccttcatggaataagaaagcagcagacatcttagtaggaagaccactgaagcacacctttgttaatttaaatgtggcatgtggcaatttgctttgtgtggcttccctggcacaattctcgtgaaaattgtgtagggatattaccttacatttatccagtcaaaattagcatctgtcaatcagatcctttccaagaaagggaatcagttatatcataaatacacaaatatataacatgtgttttttaccctccagggaaactttaagcaagtagtacaccatcattttttaatgaatggtcaagaaattgaaaacatatataagttgagttaagcagttaaagggaaagacaattagcaatgcctggtaagctaagtggtactccaaaggtttattttatagctacagaaattatctacatgtagagggggtggatacaaactagcttagactggggtgagaatcctggtttgacatttaacattttagaataagagatatagaaagattcctctgtagttgaaggatcctgttttgtcctactcataagcaaatccatggggtagcaaggtgctttctggtaagcctttgatatgatatgaagctcaagttgataaaacagattaattgaaggaaattgaaaaatacgcaatttaaaaaaccataaggagaatgttgcacaagcttttgaatcctgtaaattttcattctttaagaccattcagaaaaggagattttgtcgggggccagtggtggcttgttttgatcctatttctgaaccagctgaaaactagaatacgttctttctgttcaaaacatcctagatgggccacatattagtcaggccttctccagagaacagaaccaatggtatatgtatataaagtctcagtatccaaaggcccaagaacctggagttctgatgtctaagaacaggagaaggtggatgtcccagttccagaagaaacagaggatttcccctccctctgcctcttgttttatctaggccctcaacagattggatgatgctcagccacaatggtggtagagtgtggatcttctctactcagtccactgattcaaatgccactcttttccataaacatcctcacggatgcacccagaaataatgctttagaaataatgctttatcagctatctggatatctcttaacctggtcaagctgatacctaaaattaaccaccacaggctacagtgaaaaagatagttccaactgtgagtgaggatgcggagaaactgaaccatcatacattaatggtgggaatgtaaattttagtacatctggatcaacatgttagaaacattttgaaaaacagtttgataatttttacaaaatgttaaatatatactttccatacaacccagcaattctactcctaggtattacttaaaataaatgaaaacacatatcctcacaaggacttcattacagcataatgctgtttttataaataatttataaaagccaaaatatggaaatatcccaaatatgtattaacaggtgaataaacaaaatgccatatagctataaactacgataccacacagcaataaaaaggagcaaactactgttatgtgcaatggtgtagataaacatcaaaaacattatgctgagtgaaataagccagacacaaactgcatattgtaaaattcaatttatatgaaatttctataagaagcaaaactataggggcagaagacaaatattggttgcctgaggctggagatgaagcagggattggctgcaaatgggcataaggggacttcttggggtaatggaagtgttctaaaattggactgtgacaaattctcagctttttggctaaagatcaagtgtaaattggattgtggtgatggttgcacaactgtgtaaatttaccaaaaattaatcgggtgaattttatggtatacaaattaataacccaaagccgttaaaaaaaaaaagcaaacaaaaattcaccttcattctttcccccatctctccaatgtccatttttacatagttatctcatgttttgatcttatgcttgctattgtatgttgagtccattgagctccatttttgcagtttaaatgattatatgtagttttcaatgtagttttcaaatcttcactaaataaactcaagctttttagtttgagtgagcctctattatttaattatattagcaatatattgacgaaaagtctctggaaatagtaaatcaactgggaagttaaaattatttcaggattaggtgttggaagtcctgttttcaccccctggggtttcacttacagaggaagtcaaagacatatgtgtccaggtgtaccagccatctggatcaaagccagaccacttggtctaccacagagcagttagcagttcctgcttctggaaaaatgtgttggtttttcacacaggtgctgcgagatgttttccttttcaccttaactgatagaaagtcaagagccaggacgggcgttttggctcacgtctataatcccagcactttgggaggccgaggcaggtggctcacgaggtcaggagttcaagaccagcctggccaagatggtgaaactctgcctctactaaaaatacaaaaactatctgggcatggtggtggacgcctgtaattccagctactcgggaggctgaggcacaagaattgcttgaacccaggaggtggagtttgcagtgagctgagatcttgccactgcactccagcctgggcgacagagtgagactctgtctaaaaaaaaaaaaaaaagattgaaaaaaagaaaaaagaaaaagtcaagaaccaaatttgaatttaacttgaaattgtaggacttctttgtataaacttgcttcatcagctttattcctattcctcttttctttctcatacaatgtatattagtttattttatgtatccctctaaggccactttgaattattttaggaagaatgtaggttaataatcagatgaatagaatataaattccaacaactgatatgtgcaggagaagggctgttaaattataaactttatttcaaagagatgcaagtgttatgagtaacggaggcacaatttttggaagcttactgcttctttttccactaagccaacttttagcatgggagatctgggatgtaagttttggccacatcctgtgtgattggtatgagatcctaattaagtcagttcagctttctgcatttcattttcattatctacaaaattggaattgaaagtgtctcattttacagggaaacagcaaagactaacgacagcctatttcatgttacacgcccttcagggagatgcaccataggtataatgcacagataggattcatagacatcttatttcatgaaaattgcaaatgcactatttaaaattttttattgagaatcaaataaaaatcaaatcaaaaggcgaacagtgtatttttaaagaggaagttgtagccagaaacagagagaaagaaaaaagagaatgtggtacattttacatattctcaaataaaaatgtgtcatcctttatgaacaacatttgatttgattgctgtgctctgtcttagtatgggggtgacagttcaggctttgaatcaattagaatgagcacaatcagaaatgaacacttgaatctgtgtttcctgtaaagaaaagcctaccatcagggacaccttagtttgtaaacctagctaatctgcactcacccttgccagtaccccttttctcacctctgattaatcccttaaagtaagtaagtcagaggtctgcatcaggagaatgactagatccttggtattcaatgcgtggtccatggaccaacaacagcagcagccactgagaatgtgcaaaaatgcagtctcgggctccgcctcagacctactgaatctgtggctgcactttcagtagcctcttcaggtgatctgcaaaataaggttgagaagcactgaggaatagtgattttcaaatatggctgcttattacaatgatttgggaagcttttgaaatgtacccatactactaaaccttccattcttcctgggcacacaaagtttccatttcttcagtggagtagtttctgttatgtgttaggaggaaaagcaatttaagtaaatgaatagatgttaaggggtataggaattgcctggatatttgcatttttaaaagaaggtacatattgaccaactgattgctttaacaggttcaatttcagactgtgtgctcagtgaagactttaagttagagaggagtgaagactttaagtcagagaggagagacactgagcctgattttctgcttatcgtggacaagctgaacctggaatatcttcctaaatttccccagtgtaatgcaggcatgctatttctgtagagacattagaacaactttttgcctcttccattcattcatttattgatttatctattcattagttaattaattttattttttattttttttagaggcagggtctccttatgttgcccaggttgacctcaacctcttgggctcaagcaatccacacgcctcagcctcccaagcagctagaacaacaggcacatgccaccatacctggcattcatttttttttccacaaaagcattaatcaagcagcttctaaacattgaacactagacattggaaatatgaactaaaataccccctgccgtcaggaaaatgaaaacctggtcagtgtgacagacataaacaacattaccatatggtttgataagtgctatgatggtgataagatttgtgtgctacaggtgccctgagagaggagcacctaaaccagagcgggtctgggagtgggcagctaaagtgatagcaatgaggccgggaaagcagtcgcacttcaccagctaagttctgaaggataattgaattgcccaaccagtgggagcagaggagagcatgtgcatagtctgtatgcaagatggaggcaagagctcaggaagtttaggacctactagtggttcatgatggctgggatgtagaagctagcaagacttgatactagagaagtaaccagggcccaggtcacacagggtcttatatgccatgataaatgggttgcattatctcccgaagtctacagaaaatgaataaaattaaaatgccgcaggggacatctaagggattttaaatagggatgtgtgacattgtcaagattggctgctgtctagctcaagcctggtaaagtggaggcaaagatttacccaaacaaaggaataacattttggtgcccctggtgtgtgagagagcttggcaatattgagaaactgaaagaatatctgtaaggctatcatagagggtgtgtatgaagatatgagagtggaggcaaggagaagtgttcactattggcaaaagaaataagcaggaattggattttgtagtctgtgttaaagtgaatgcacttccttctagtagcggtgggaggtcacagaaggaagggttttaaatgacgcatgactttatcagaattattgagaaagatcactgaatagaaataaagaatggctgtgggcaggaaattgggctactgcacttatttggatgagtattatggttgcctggatttgaatggcaacagtttttattgttgttgctgttgtttgtttgtttgtttgttttgagacagggtctcactctgtcacccaggctggagttcaatggcacaatcacagctcactgtagcctcaacttccccagactcaggcgatcctcccacctcagcctcctgagtagctgggattacaggcatgcaccaccacaccccgttaagttttgtaattttctgtagagatggagtttcaccatgttgcccaggctaagaaatggacagatttgagaaatatttactgggaagtagaattcataaggcacaatgtttctgtaaataggtgaggttgtgaaaaggaagtgaggaaaaggtaactcaagtttctggcttggtaaattgggtgataagtcagctgttcaccaagctagggagcactgaagcagagcttattgggtaataggctgggaccaatgcagtgaagagttcactgtgagatagtttaaatttgagatactggtacatattcgatgtggtagaattcagggaagatggtgttggaaataaagattcgggggtcatcagcatgtggatgatatggttgagatttcttagggaggaaatggagaagagaacccagaattgcatcacataaagcaacatttaaaaatgagaagaggaagaaactccaaaagaaaccgagaagtaatcagagaggtagaaggaaaatcagcgaagtgtaaaatcaccaaagcaaatggaggagcagctgtccaaaattagagagtgatcattggaattaagcacagctgagaggttgagtaggctaaatgttgaaagcagaaaggaagacattgaagattcaggtgaagatcaggtggaaaattgatggattttgtccagaggaagtaaaagaggatgtatatccagagaaaagaatataggatgattccgagataaaggatggcctcctcctcccccttttatttaatactagggagaaagaagccaagatggctgaaatgcaaacatgtttggaagctaggagggacaggaagttgaatgggtcatcatccagttgcctttgtgaagtaacaaacaaaaatctccgcctgggagtgagctggtagagaaagtaagtaaggagagtatgaagactggaaagtgtccatgtgaggagtgggccatgcacacagaactgatggctctgttgaaatggaaggctataacttgaaatggcattaaaccaggcagttgtggggtttctccagcatcaccgataatggcttcaacagatattgtcagcactgttttagatgctaaggatacttagcacctaaacgcagagtgagcaacacaatgtccctgcttacaggagcttacagcagtaaaggagacagtaaataaacacacacacatataaaaaaacattattagatagactagagttggaagggaaaaggaaggcagctggatcaattcagggtaggctcatttgcagggggcaagggaatgaaatactttggtgagatgatggtttcagggatggcaccacaggatgtacactggacagaagatataaaagaaaagtaaagtaaaaaatagagtggctggctgggcgcagtggctcacggctgtaatcccagcactttgggaggccaaggcaggcgaatcaccaggtcaggagatcaagaccatcctggccaacgtggtgaaaccccatctctactaaaaatacaaaaaaattagctgggcgtggtggtgcccgcctgtagtcccagctactcgggaggctgaggcaggagtatcacttgaacccaggaggtggaggttgcaatgagccaagatcgcaccactgcactccggcctgggcggcagagtgagattctgtctcaaaaaaaaaaaagagtggccatggggtgagagttttcagtgaagtcgaggaacaggtgtagagggaataaagaaatgaaacaaacaaacaaacaaaaaacacttctaagaatcagaagattcttattggagaggggggttactcgagatgaagatttcagaggtacaactgttctgggtgatgagaacattaagatgtcgtcatgaaaatgtgtagactaatgtgaagtgaaggtgaaagttaggagagttcagatggtcaagaaattcttaagctagagtgtagcagaggttgtccacagggtctctgatgttacatatcaagatggtagaacttatgtggaagggcagactgcacaaagtgccagagtcttaaacaagcagagatgaatgcctctggagtcagtagaagacagagataaagtaggtgaggcggggatggttgactggcagaagcttaaataagcagagtggacagtaaggatttggctattgcaccaagtgataacagaaaactagttttgcttttccatgttggggcaaggtggagggatatgccacctgatgggattagttcatatggattagtattttcagtacacgtgttgtcatatgtaattatcactcaaaagggtaagcagcaactaataagaagaggtgctggagggccacctgtctggcatatagtgtgggattccatttgatacaattacaaatgaattcatttttactcatttttatcttttcactatcctagataaaaactcaaaatgaatcaatgagttcttatcttaaaacaatatgttctgtttaaacatttctcagcggtataatcttcctttaatcttacatttcttcaatccagaggagtccaactacagtgccttcaccgtgaagctaatgaaaagggagttggtccactgtgtagactagactagatgattgcgaagttaaattgaagtaattgagcaggtacccaatagccagcagcggatttgtttctctgttcttgatgcttaagtaaaaacaagcaagccaagtattaaatggtggagctcctgacaacacagcttcataaaaaagaaactgcttgactcaaggagtgtgtccttgcgatagtttgccgagaatgatggtttccagcttcatccatgtccctacaaaggacatgaactcatcctttttatggctgcatagtattccatggtgtatatgtgccacattttcttaatccagtctatcattgttggacatttgggttggttccaagtctttgctattgtgagtagtgctgcaataaacatacatgtgcatgtgtctttatagcagcatgatttatattcctttgggtatatacccagtaatgggatggctgggtcaaatggtatttctagttcaagaaaaccgaggcaataccattcaggacataggcatgggcaaggacttcatgtctaaaacaccaaaagcaatggccacaaaagccaaaattgacaaatgggatctaattaaactaaagagcttctgcgcagcaaaagaaactaccatcagagtgaacaggcaacctacagaatgggagaaaagttttgcaatttactcatctgacaaagggctagtattcagaatctacaaagaactccaacaaatttacaagaaaaaaacaagcaaccccatcaaaaagtgggcaaaggatatgaacagacacttctcaaaagaagacatttatgcatccgacagacacatgaaaaaatgctcatcatcactggccatcagagaaatgcaaatcaaaaccacaatgagatatcatctcacaccagttagaatggcgatcattaaaaagtcaagaaacaacaggtgctggagaggatgtggagaaataggaacacttttacactgttggtgggagtgtaaactagttcagccattgtggaagacagtgtggtgattcctcagagaaataattttaataatgtttgagtgaatcaaatatacaaatagtattgtgatgcagtgtacccacaatcattaactcaactatgaattactcaaagcactgtagataatagtctagcaaggatctgacaatatgttgagaagaaatgatgcacatgaaaccttgaaagtcaccttaaagaaactcatatcatgcaaatatgaatattttaatagctactataaaatagtagcagctgagtgctgtggcacacacctgtagtccagctactcaggaggctgaggcagcaggatcacttgagcccaggagttggagattagcctgggcaatgtggcaagaccccatcttcaataaataaataaataacttagtagcaattggtgctatgaaactttttgatgtagcttggatatttgtcctcgcccaaatctcatgttgaattaatcctcagtgttggaggtggggcctggtgggaggtatttggatcatgggggcagatccctaatgacttggccctgtctttgcaatagtgagtgagttttcatgagatctggttgcttataagtgtgtggaacccccccacccactctcttcctcccgttcttgccacgtgagatgcctgctcctccttcacgttctctcataagtaaaagctccctgaggcctcccaaaaagcagatgctggtgttatgcttcctgtacagcctgcagagccatgagccaattaaacctcttttctttataaattactcagtctcaggcatttctttatggcattgcaagaacagcctaatacattttgcatggtgcatatcaactatggtaataaagtgaaaacaaagaagtgggaagctttgaaaagttgacaaattggttgagtaccatatggaactccagctgtaggatcagtcccattccaggcccaggcactcactggggccaaggtcagtagctcaaacattccacttccagtcagccctactcttggtgatctgcctctgaccccagctctagtaaatgggtttctgccttctcccatagggatttcactcctggctcattccccacttctggaaaatgagtttctttttttcttttctgtcttctgggactgaaatctagcttagctcttaacctcatgaccttttgccagaccacggagaactgaagtttccttggatcaacacacaccatctgctggttatagctccctcctcacagctgccgtgggtgccctccctgtgtgacttatttctgttgcttgtagctgagaacttcttctgttgatggtcctttatagtttaactaaaccgggattcagtctcactgggctagtcaaaccacttctaccagagcccagtttatgtgaatgatgaatgttttacatggaaaaaaaatgtttcttcatttactgaggaaggagcaccttcactgattttgtatgccaacacagacagcgaaggatcctgcttgtccttcacctatcagccatcacacctattaggaggggggaattggtcttttgttttgtttatttagtaaaaggaaatctaattatatattaaaagttaaaaaaattttagatcctgcctacatgactttaaaatgagcaataaaagtcattttttattcagggatagtaacaggaaaaagaagctagtatcagaatgttttaagattccgatacagtgcatatgcaggttttagtttacaaatagcagatggtgatgatttactataagaaggtgtaattaattgagaatgaaggatccttttggagtgtccattatgggctagtcattgtgctaggcgtaggaattagaatcctttccctgggtgggggtatacttaaaattattgcttttgtattctatggattaccttgaaataccctttgagtcatttctcaaaaattgtgcatatcataccgatctgataactcattgcactgttgatctgaggcttcatcccctcacctaaccacatggtcatccattttgcagtccacaagagcccttcctggattcatggaaagaacttgctctcacttgggcttgagaaagcataagtcaacttggcagggcatgtgttaacaagatgatttagaactttgcgaccagccagaaccataaagacagcttgtaataaaagtaaagctgttctcatgagatgcccatgatgagggcttctagggcaaggctgctgtttcttgctacctcagcaagaatgaggtctctttcccatgatcatttccctccccttcactgggcagggtgacaaagaccaggcctctgctcccaccagtcaacaacaggcagggctcccagcatgccgaaaccttgagagctacctcttcctcctttatcccttcttcagagggtagcctacctgtccacaccggcagagagtcactctgcatgtcagtcctctttcggttgcctcttttgtcaaaaacgtcacctactttcactgcctgggacacagctcagaacctgactcaaatatttgttgaatggccaacggaatgaatgaattgccctctctcctctaccttcaactggtagctcccccttcattcccagagcatcctatacgctttacctataactcatatcccacttgttattagttgttcaatgtctggtttttgtccactaaaatgtaagttttgactgtttctattttattcattattctatttctagcacccagcaatgtgtaagttaccaataaatattgattgaataaatatactctcaggttccttaccttgaagtcacaaaactattgatgcctatgcaaggtgacttgtaagcatacctaatacacaaatatagctgcctcaaggaaacgttttcagtctagctaggtcctgcttatgtcagatttctcagttcagtatttctgtatcaagcctcctaggtttagcccctttctatctgatccatcttctttgctagcaataaagtcaattacgctcttctcagttgtctaattcaccttgctaattctaccctcctaagctagaactaggttaatgaggaaacagtttccggatgtgtttctatttcccactatttttctgtttaagggaaaatttcaactaattttctacttgggtgtaagcatttccagctctctaggagcaaagtctctatcagtctggtttttcttttccaactgtggtttgttctgaattcctcccttctcaataatttatttcttctctcttttaacactctgtgttcttcttctcttgaacaccattatttagctaagtgttgctgttcttcaacaaccaccatcctctaaaactcctctgtccctgctcacttcattcataacacacaaattcaaattcctagccagctcacgcatacatgcataaactcacttatggaaggacattacaagagactccttacctctaggttaggaggagctttacttatcaactgaatacagtaggagctttacttgtcaactgaacactgagtaagtttgagaattgaaaatgagacctgagcatcacaaaacaacctttcatatctagatatagttaccatctaggagttcacgtgcattataaaagaaatggtcttgtttaagatgaaaccctgcaagctctgtgagggcagggattatgtctgtttatcacaccatggtatgttcagttcctaagagtgtcgggtatatagaggccgtcaatatttgttgaaattaaatgaaaagtttcagtcttttcatgcttcacaagaagaaaatcttttggagaaagccaatgatttaacataatcttctggatcttctatgacagaaaatagctatttaatccgtaaaaaatataaacatatggagccaaatactgccttgtgccaatcaaatgtttggtttattaatagttactaaatttattagtgctctctagaaaagagcctttttagaatttgatttcattttaggcagcattcgagaagcactgtcgactcagctttcctctggctgttgtctttttgtaccactccctaaccaaaattgatgcaaaggcaggatgctttgagttactctcagtaatcacatattattgaagtcagctggttattcttgacagacaatatgatccaaaataacacaatgtttaaacagaaggaacatgggtgtggacccccattgctccctcttcagagatgtctgccagggtccagggaacttgggatctacctgaagagtgttactaagggaacaatgtagccttttcatgaccttctatagctttagtttaaaaaaggaacattatcatcatttgctaacattacaatcaacagcagatctgataactcattttaagtgatatattgtatttaaattacagtataatccctaatagctttttgccagcagagtctttcaggattcaaaatgcaaattgcacctgaaaaagaaaaattatttttagacttatggcactttaacttaactgtaacacagttagaatactttttattattattattattaatagaatatgtttcggttgcgaattctggaggaatccctactggaaaataattgccagtcctcccttggctgtgagccattcattgaaatggactatgagataagactgaagaatttcactaatttcgggagtgccaactgaagtttattattgtgaatccattagacatgagatttctgtgattatctcaatgagttctaaaatccaggtccaaatgaggtggaaaaattttatatgactatatacatgttatagagcaattaatattttaattgggtgtcaagaaaagcagtggttgctctataacttaatttgggttcctctgcctctctgtagagtttctgaaaatttttaaatgtcatttggagttaaggcagaatgatactgtggaaaaagcatcagcttaaaattagacctaggctcagctttagttgaattccttaaatttacattggtgacgttgagtttgtaaccaccccatacctagattttcttaaaataggagtaatatgtcctactttataaagcagttctaaggaagaaaaatgattagaacccaaggcagtttcacatagtataagatcccagacgctggccaccaggtttcttgagttcaaacccactgcattatcctttgccaactatgtgaacttgggcacaaatcacttaccgtcaatttctatatttggaaaatggggacacaaatatagttaccatacaaggttaaaagaaaacaaacattaaagaaagcatttaaaaaacagccatcatgaagttggcacttggcgtttgacatatgtcaagtgttggcttctattgttattattattattacatttaagcgtctttggctaaacctaaatgaaaatcctataatttacattgtatatttaaatctgatagtgaatttatctgatagcaaatggattctaggttgattattcatatgcttgtgcctacgtgtgtgtatgcatatttgttgtatgtataagacctatggatttaagataaattagtcacatgtatatatgaaatatagttataaactaattactccccaaactagaacagcaaaaataggtctccttacttaagagtacagctgtacagagtaaattcactatgcttggaaacttctttcatatctatttgtgtaagtctgcagctagtttctgaacagttgtatagtgatggtttcatggtactcaccaattagacaagtataagtcatgaccttggctttcttggaacgtaaccagtggttgacagggagtgtttgagttaaatgataaactagcagtccagtttacactcagcatctggtatcccccactctccatctttcttcaaccaaggcatcacaaaagcaatttgggggcaggcattttcatttaaaaatggagagtggattgtggaagcatcctgagtgtttgtaatgaaagccatttggtttttattagcattagagtctacgtgcttgctagttttcagtcattttctcttcaaaaatggttccccagattccagttttcacattgctgccttttgaattgaatcctttgtgacccgttgtgattacattgcattttccttgtgttcttttaaaaagttctgactttctctgaattgtggttggggggatggtgggaggagggtggcagcaagggaatagggtcacttgtacttttagaatgttgtcaaaagagatttttaaattgtcaaaaattgcctagaagtaatatcaagcttagtgtctgctaataaagcaaggatttacaacagaaggttcggtcagaaatgggtgtcctaaggtctttacaaaagagcatttgctcctgggttccccaacatttctctgacctctgttggacaattctagaacagttataaatcaggctaattataatgatgttaggatactggtgttgtgtgtttggggttaggaagctgagagcttaggcaatttgaagacaacaagctgaaaacagctttgttcatataccattccctaaacattaattcagtgcagattaagaatagtcaatggagggaccgggcgtggtggctcatgcctataatcccagcactttgggagactgaggcgggtggatcacgaggtcaggagtttgagaccagcctggccaacatggtgaaaccccgtctctactaaaatacaaaaattagcctggcgtggcagtgggtgcctgtaatcccagctacttgggaggctgaggcaggagaattgcttgaacctgggaggtggaggttgcagtgagccgagatcgtgccattgcactccagcctaggcaacagaatgagactctgtctcaaaaaaaaaaaaaaaaaaggaatagtcaacggaggaattttgtcatggcactgggggtatatatgtggtatgtatgttgtaaatagatgcctaacctatttaaaacgtggctaatttatagtgaccaagagtttttaaaatagagtagtaattgagaaagaaatggtttgtatctttttcccacttaattttctttcctgttttgtacatttttctagatgcttcaaaaagacccaaagaaaagaggaatataagcacagtcattactcattatttgtggattctctgtttgctaattcacctactccctaaaatgtatttattacccccaaatcactatttgcagctctctcacagtcatttacagacatgcacagactggtgaaaaaactttgagtctttctacacacatgtactcagctgagattgaacaagggaactatagacaaggatcctttttgtagtccatttagtcaacgttttttgcatttttgtgctttttaatgatgatttcactgttaaaatgctccacaaccatagtgtggaagtgctatgtagtgttttgaagcacaagaaggctgtgatatgccttacagagaaaatatgagcaatggataaacatcgttcaggcatcagttatagtgctgttggtgtgagttaaatgttagtgcatcaacaaaatatattaaataaggtgtctttaaacagaaacacacataaaacaaggctatgtattaatcatctgtgtgtccagaagcccacaggaacctaaccttgtatttcccctagggtcaatgattcagtattcactaattcagtgtagtagggactttatatagaacaaaactcatataaataactagaataaaccacacttgttttttaattcctgtgaaataattcatatgggaaaccatcaaagacctgctaagtaatgatgaacattaaaaaaattaaactgggccgggtgtggtggctcttgcctgtaatcccagcactttgggaggccgaggcgggtggattacctgaggtcaggagttcgagatcagcctggccaacatggggaaaccccgtctctactgaaaacacaaaaattagccaagcatggtggcgggtgcctgtaatcccagctacttgggaggctgaggcaggagaatcgcttgaacccgggaggcagaggttgcagtgagcagatatcgcgccattgcactgcagcctgggggacaagagtgagacttcatctcaaaaaaaaaaaaaacaaattaaacccatataatagtactacagcacaaaactttatgctatctattttgttcatttgctgtttgtgactatcatatttatgtcaactttaccctgttttattgacaagtacccaggagcacttgaaaatgtagaaattcctttaaaccctcccccctccaccagaaaacaagcctccagggaatgcacatatataaatattaagatagttgttgtgtatagtgcccaaaatcctattttcagttagcaaactattggtaatgttggaaagcaaggcatccagataagaaaggggagatcttgtggcttggaggccattcaaaggcagacttaaggttgcgtcttcttaagggagacatgtagtgggggtcccgtgtaactggaatttcaccatgtctaatcgtgtctagcagaccaatggaatgctgtgcctcaagtttcttctgagaggcctatgagcctcatgagatatcaacaaaaatgtttcttggccatcagaagagagaagtgattttgaatatagtatagtttttgctattataatcactccaaaaccaggcctgttggtgcttgtggttcttgagagaggaggccatggggggtgaaattcaagagacctgtttacctataggcacaagagccctcctcaagacttgagacaatgaaagatgaggaagggaggtattttccctgcatcatccagcttcagcacccagcgggaactggatcatgggtggtgtctgggtaggaggctgtggaggctaaagtcagtggagcagagtggaagccttggggtcgtgggcttatgcatgagacacatgtgaggttccgtgcaacactttaccagccaattataagggactgaagtcactgcaaaacataggttgccatgatgtaagcccatttgcatttgcagactgaaaaggcaaaaggaaatattcctgattcaagtaagtatgggactatacttttttgatattggatctgttggtcctcatttctatgtttctcgattgtctaatgtggtggttccccctgactgcacattagacccactctagaaaaccttaaaaaaatgtctggaccccctccaaagattctgactgaattgatcaggagtagaattctgggcatccgtgtgtctaaaaggcttctcagatgattcacatgtttagccagggttgacaagtactgtcctaaaacatatttctgagatttttcacactccattttccaatgtgctccaaagatagcttaggcaggaaccctgctacatggccacttcaaaaagatgcacccctgcatgggcctttgagtgcatccacctagcgtggcctccatgccacttccctgtctggttactccactataaaaaattcatctgcggactctccaagtcctcaagctgtacattgtcctgcctttgtcccaacaagaattgttggtgataagtccgacagtggagaggctgtggctgcagagtggcaggaaagagagtaagtaaaggagaagacaggacaaaggaagagtaaaagggtacttgaaaaggactggaaaggagggccctgcaaggtgctgcttctcacgtgctccccaccagccttctgcattcaaagcagggagggaagagtgtgggctcagagccatacatgcttaagtgcaagccttggggccccataatttactagctgcttgatcttggaaaaattacttaatcttgtacagctaaaaagtggtggagctctgggattcagaactggtctgtctgggttaaaagagcccaaacgtttttcccagcgtatactacatctcccaatccatacacacacaatagacttttcagtgaggaatacagtaattaataacttcccagatggtagttgaacttgcttttaaattcctatagtcaaataagttgggagaatgttacaagaagattagttagaaagaaaatggtgtcatttattatcagctcgaaacattcagaattgtcatttgtaagaaataagctcattattaatagaagattacttctcttgtctttgtgtgaccattttcttaaattaaaaataacttttttcccttactgcaaaagtaatgcatgttcatctaatacaaattggaaaataaaggtaagcaaataatacaaaattaaacacactcttaatccctccgcccagatctaactgctgtaaatatgttagtatatatccttctagattttctgtgcttttatacagattttaaaaaatcatagtatatgctctttcactttacaatatctggtcaacaacattccatgtcaatacatttgcctttactacattattttttatatctgcttattaaggtgaacaatttagtctgattttaaaccacatttgtttactcagatgtcagagatccacagataaggaaacatctgaagagcccaggtgtggctatgtggagaggttgagtaattcaaaacaaagtacaaaacataaaaacaattacgaccagtttgacagttgtacgtctgtttcctacggccttctacccacaagtctaccgctgacttcaaagaaaagtcagcacagaggaggtccagaggataaggtgcaaaacgagaatcaaacccacgataagagattaaaggaaggttgatcaaagacccagcataaaagtgctagcccgtgacttgccttggcccatggccccaaaatattcatcagaacagagagcgctctttgaagtgattggatgcatccatgctcagacaagctcggtggtcaaagggaaattttaaagagtggccctggaaggagttagcaaagttgcctcttcctctctctgctctgcacatccctcacaaactgaatgttatttctttggtttgttgtgcagatgcaagtaatttaactgtactttttgccccctgggagatgtgggaagtacagttgcttttacaggatggagaatttgcactcatgatcagagaactgaaacttccagccatcctttttattcagagtgtttaaggaccggtggtatttccaaataggcagtagggcttgttcatgctctgcttgttcattctgcttgttcattaattgttcactacttttctgagtagagttcattgctctgtgatgtcgtgacagaagctttcatttccccagaaagaggaagaaaacagaagtgccccctccaaatggcatagccttcacaacattcagtttaaatgtttttaagtatcttaaaagagaagagttatatattgctaagtgtgttcttagaatgtctgtagttagcacttctttcaggctctagttttctggtttttcactttacataataatcctctatgtatttaggatctttatttttcacctttcccgttaccatatttttatttccttcaaaattcgagggaattgcttttttctctctaccttttttagatcagtttcctagtctttaactgaggtgttaaagttggagtttttactggcaagtcttgactgagcacagtgttaggctctgtgagagagaatatgcattttctattttcacagagccacagtccaggtgaggagataatgaatttgcatgcaaaaaatgaatatgttgtgagctgatacagacttttgtcaggccagtctttcataaagaagtatttggaatgggctttgaaaatgcctgaaattccaaaatgaaataatatgaaataatatttattagtacgtataggggctgggtaacatgctcaaagttacagaggcagaaaaccataaggtgtctcacagaaactgaatatactcatttaactgtgacagatggctcatgcgagaaagtagcaaaggagaagcttcattcgttctattagtgttagaatgtgctatagaatctggattttattatgattgcaaaaggatggtattgaaaactttggagtggaaaatgacattctgaagtattttgagaatatgaatctgcctgtggagtacagaatggacataggtaagaagaggcctggggccacaactttgtcaaaagggcacaaatagagtctgagagaaagagggtttgagacagaatggaaacaatgggaaagatggaatggactctggaggcaatgaactgagaacggatctgacctctgtggcaaggggagaggaggtgagtgatgggctgtaagagaaggtggtaagaagactcatagatgattcagtcacacataaccataattgcacccctgttacctaggtgctaggtgatacaaagagattaatcacatcaacaaaatggttaggtagacagagtaggtatttacaatgaaaaactcaaagtagtctcacattgaagacagagtgaggcaatgagctctcaggagtcaagagaaatattccttgaagtttggagtcacagaagcatcagggaagagatggaacatgagctgaatgttgaatgatgggtagaatttggaaagaatgacaggggcaatcaaagctgtgggatgaggaggttaaagcaaagacacaggactaagaaaacacaaggagtgtttgtgacacattgacgagggccatctggttggaacagagtttgcataaaccaccaaaagaggaaaaggggaaggtagggtgatacgtttattctggtaaaggtttagacaccaagctaaagattttatttttatttctgagatagtctctctctgtcacccaggctggagtgcagtggcgctgtcttggttcactgcaacctccacctcccgagttcaagcgattctcctgctttagcctcctgagtagctgggactacaggtgcctgccaccatgggcagctaatttttgtatttttagtagagttggtgtttcatcatgttggccaggctggtattggactcccaaagtgctggaattacaggcgtgagccactgtgccctgccaagcttttataatttaacctgggaaatgtcaagccactgacatttttcagcaaggttgtggccagtgtcaaagagtctttcgggaagtttggtttgtggaagatgtgtagaatatatcaagatgaagaactgggtgacttctagtcaaaaaggaatgatgatataaaccaggtaccaatcagaatgagaggtatggaagaggggcaaaggaattaccagtaaaccaaggggaaatagaaatacagttttacccaaagtttcaaatccaggaggctatgatagcaactgtgctgtatactaaggcatacaactcatgagatgactggtttggtaacagtcctgagcgttttgttttaaagagctgggtcctgaggttccagacaagcaaacatgccaaaaaagtggttcaatgggggggcttgaggctcagctggaaaccatgtttaccataccaagtttaaaaaatccacacagctcagcaattgtttgaagtttttaattaattaattaattcataaagtgaagtattttcaaaagctcatctgagagcttatattctcttgatacagatgaattctcaattgctcttttgttttcattgcaaaacagttcaacttgtatgagactcaaagtggggagggcaggagcagaattttctctgttccgggtatagacattatgggtattgggccatattctcctcttcgttggtaataattcctattttatacatctttctatcaattgcagctcctaccagagtcaacgtcttgattgtaaatactcagtgttggttgatttgcattttcatcatagtcctgaaagataaaagtggacctaagaaaaactaataagcttacagccagttttataatgacagactctatataaacaaatgcaaattggatgtcaaatttgaattacaaaatttatttgagcaaggtccaggaagtaataacagtgtcttcagatcttttctaaaatgataaaaattcattaacaatcttccatggcttggagtctcagagactttcaaaagtcacagcactttgaagagcagagttggcaactaaagttatcagagtgaagaatggcatgctaacctcaggtgcaggatggccaactcaaagtagacctctattctttgttcttctgagataggaactagccagaaacttagttattcaggggtggggtgggaaggctgtgggacccagggtggaaggacccacacagttcaaaataaaacgaaccaactatagtgaaggaaaagagaactatacacagatagtattcctcatccccctgaattgacttatataaaaaagaaaacggagcatccgacaaattgatgcaatcaaaagggagcaataagcctttttctccttttaagcctcttaagaaataaacccatcattttatctagtgttttctctgctcttgcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaaggttagtagagattgtgtctgtgcatcaaagatttctctcttaatatgttcattttttaaatatacaattgttagccattacaaggaatgtcacagaagattaaaaagttaataatccttccaggatttgtgtaccaccaccaagtcactctgatagtggcagacactgaaattaatgtgttgacatctcttagcattcctgctttcatttgtaggtatgcaaataataaagcggtatcatctctagagatggcaggtttggttttttgtttgtttgtttgttttttgagatggagttttgctcttgtcacccaggctggagtgcaatggtgctatctcggctcactgcaacttctgcctcccagatttaagcaattctcctgcctcagcctcccaagtagctgggattgtaggcacctgccattacacccagctaatttttgtatttttagtagggacggggtttcaccatgttggccaagctggtcttgaactgacctcaggtgatccaccagccttggcctcccaaagtgctgggattacaggtgtgagccactatgcccagccaagatggtagttttatgccattttacagaagaaaaaaaattaaatgattggcacagaaacctacttctgtagtctccctacccaaaccctgtgttaaagttactgtaagatgttactaagatttgccttcccagcacaggtatattctaacctggctaagactgtctccctgagaagttaagaaatctagccaagtccctcctatcctttgttctctgttctcccctcttctagaagttattttgtagaagaacaatttttgctactttttaacattgaaacaagtaggacaattcaattcattcatttggagcatgaacggtacagtcacacaaagataattattttccagccatcaaaaagactattcatactaaattccaaattcctctgtgttattgtttttttttaatctcaatttcaagaaaagtaactgttacctatggcagagccgtatgcatcactgttcataaaaaaaaaaaaagataatctagtcaaaaggactttcatctaaattggctgattaaactgactcccagttctgtgctaggaatgataatctggtaaggggtttggtttttcctataatgttttggaactggggggaggaaatgaatgtacctccagaaaagcaaggtttttttttaactgaacccactttgcaaatgttaattactgcaaatgagcaattatgtttgcatagtgcaaatgagcaattatgttgatgcattttattaaatgtcctatttcagatgtccttcaagaacccaaaactgaagatatagtagcagtgcagaaagcaaaagcattgtacaggtcttgtataaatgaatgtaagtgctcttcatttgatttcattaggagtatatatatatatatattggtgccaaactatgcctagatttctaattgaatttatgtttgttgtttccaaaagctgctattgatagcagaggtggagaacctctactcaaactgttaccagacatatatgggtggccagtagcaacagaaaactgggagcaaaaatatggtaaggcaattttcctactaaaaaagaaatttccatgtaaaatctatgttataatatcattagtgaactaaagcttctaaagatatattttatcttttattgctttaggtgcttcttggacagctgaaaaagctattgcacaactgaattctaaatatgggaaaaaagtccttattaatttgtttgttggcactgatgataagaattctgtgaatcatgtaattcatgtaagtttgtgtgtcaaataactaaagttacctttaaattgtaataaaacttccacatacattgttgttattgatatttagaaataatgctattttcaattgaattgaataagcaaggaggtagtatatccatgctctgtccctaatacctggagttccaattttgaaagtattttcttaatgctgttttcgacattcaccccttgcttctgctacctctgttttagatacctctcccttcacaaaacaaatgataagaagggctccaggcccctcctattcagaaaaagttcctaatttctttgtatagtacttgaaaggagcatgctttcgtttatagaagtaatgcaggtctagaaaccaaaaaataataattgctttcaaaaagaacacagaaaagggattttaaacatcatttttttcctcactaaagagtatctgtacttttttctcaactaaaggtaaataaaatgcctttcttttaaaatggatttattgtatttttacaaatgtaaacaatttgatttaggtgtcacctaagactagattaatgactatgtttggaatgtactgaaaaatataaagagtttttctttcttcctttttttttttgtttttttttttttttggtttcctgtgtaagaaattatacaaaaaattgcaggctactgaatcacctaatcatatctgtgtcactattgcataaatctttatggtcgtttttgttaaaatcatgaaaggaattgaacccaaatctcctgcagtgggctctctctcttctgaaactttctccttgcaggatcaccttgaggaccagggggtggggaaggatcagggcccttcatgtggagatatcttctggctctttccataccagttctttgggttatgttttcttttctattggcctaggctctccacagctgctaggattctctctttaacccagaaatgctctgtttggcctccacactcatgttgccatgcagtgagtaggaaacaatcttgcaaagctgcagtatgcccagatagctcccacttgggtattaaacatggaccagacacgttagcgcaaaactgagtttcctctttcacacccttaactgctatctgggtctactgaggttcttctgagcagagcagctttgaggagaaccaaggagaagtcgcctccattcccttagggtagagaatcttaaaaaacattttctggcacaagttacattagctaaaagattctggagttaccttagaggttttccacttctccccttctccccatccatccaaatcaacttgaagaatattaacccactcccaccaatgaaaggggatcccaactaagggtggaagcagatgagaatgttcccaggggagcacattagaatctcaggaagctgagaaatctgtgaatatgtaatttagaaatttccacgtcctagaatctaacatgtttttgttcacttgcaccttctgctctgcattaaaaatccctcctagtaaatcttttgttcactttcttttgttttccttaaatatctgcagcacagtcctccagattatctaactgcccgttagtataacacttacaagtagtgtagaaagcatttcctaactaggtatttattgagtgtctgatggtcaccccataaacagcaagagtaggatctttcacatacatagatagacatgcttgtatttttcaaacttttctatattcactgaatgatttattttcttttatgtatattttttatagattgaccaacctcgacttggcctcccttctagagattactatgaatgcactggaatctataaagaggtaaaaagaaaaaaaataatcaaaaccaaactacaaaatgatctggtgtaaacctacaagtaatgaaaaagataaagccaaattaaatttagccctctgatgtttttcattcatgacagggacttaaaatcacacataatagtgagctgtctttgatagaatgaacattctcaatagaatgaatgaaggtattttacaaaactaggaaacttgaaattccttatttgtatcttggtttttagtatttaaaacatatgatcgattttgaaaagttaatttaaaatattttaatccacctgtaaactgcattatttaaaaaatgaaaagatttatcatggtctagggtggtgctggtgaggaccagagggtcagtgagagatacactctgcagcatccttctggaaccatctgatttgactgtcagagaactatgcaggtagtgacattgggctcagacaaacttttgcagctaccttgtgactctaacattggccaggtagccagtgggcatcatatcccatagtggacgtttggatgttctggagtgctttcttattgtctcacaaccttgcctcccttgggctgatgttcacgtgctctttttttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggatgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttaagttcattgtagattctggatattagccctttgtcagatgagtaggttgcgaaaattttctcccattttgtaagttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaagaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatgaaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcttctgcaaacagggacaatttgacttcctcttttcctaattggataccctttatttccttctcttgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcttccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttatagtattctctgatggtagtttgtatttctgtaggatcggtggtgatatcccctttatcattttttattgtgtctatttgattcttctctctttttttctttattagtcttactagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagttttttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatgtgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactgtttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatactggcccccactctcttctggcttgtagggtttctgccgagagatccgttgttagtctgatgggcttccctttgagggtaacccgacctttctctctagctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtataccaatcagacgtagatttggtgttttcacatagtcccatatttcttggaggctttgctcatttctttttattcgtttttctctaaacttcccttctcgcttcatttcattcatttcatcttccattgctgataccctttcttccagttgatcgcatcagctcctgaggcttctgcattcttcacgtagttctcaagccttggttttcagctccatcagctcctttaagcacttctctgtattggttattctagttatacattcttctaaatttttttgaaagttttcaacttctttgcctttggtttgaatgtcctcctgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtgcttttatctacttttggtctttgatgatgatgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgtgtgctgggagaaccactgctctcttcaaagctgtcagacagggacatttaagtctgcagaggttactgctgtctttttgtttgtctgtgccctgcccccagaggtggagcctatagtggcaggcaggcctccttgagctgtggtggactccacccagttcgagcttccgggctgctttgtttacctaagcaagcctgggcaatggcaggcgcccctcccccagcctcgctgccgccttgcagtttgatctcagactgctgtgctagcaatcagcgagattccgtgggcgtaggaccctccgagccaggtgtgggatatagtctcgtggtgcgccgtttttaagccggtctgaaaagcgcaatattcgggtgggagtgacccgattttccaggtgcgtccgtcacccctttctttgacttggaaagggaactccctgaccccttgcgcttcccaggtgaggcaatgcctcgccctgcttcggctcacgcacggtgcgtgcacccactggcctgcgcccactgtctgggactccctagtgagatgaacccggtacctcagatggaaatgcggaaatcacccatcttctgcgttgctcacgctgggagctgtagactggagctgttcctattcggccaacttggctcctcctccttttttttttttttttttttttttttttgagacagagtcttgctctgtcctgtcacccaggctagagtgcagtggcgcaatcttgggtcactgcaacctccgcctccctggttcaagcaattctcccagcctcggcctcctgagtacctgggattacaggtgcccgccaccgcgcccagctaatttttgtatttttagtagagacggggtttcaccattttggccagtgtggtctcgaactcctgactttgtggtccacctgcctcggccccctaaagtgctgggattacagatgtgagccaccacacctggcccatgtgcttttcttacagaaagtaaggaacagcaggagacaaaactaataatcttacacgttattagatattggggaaaggtgttggttctacaaaggtttgtcttataattattttgtagctcaaaagtaagttatctttgatgatcctaatggctcacagtgtagtgatgtgactaaaattacattttagttaaaattactagctaaatatgtttatgattggcatttattttgccaaattatgaagttcgaataacatggaatgaattcactgtaaggtatctttttgaatgactacacaacactgaaatgaagaaaaagatatatcatcaaaggccacaattaatagcacagataaatacatgggtatgggatatttgagttcagtacaatctagttgctgtgtggggtacagctactggctttaagagcaatgcagctgctttctgttacagatttgaaagtgattgaggaattttggttcactattgtacatttttatcaccatgaactgggatgcttttcatatttaggattgtgttcttatatcaaatttttcaaatcctatgatacatattttttttacattttaattctgatatcaaggtatacctggcagtcgatgtatatatttaaggcagtaaaagctttttttttttcattgttaagatgttgcatttttgcattttatactcaatgctatcccataatctcaaacaggtcacaaactggcagtctttggcttgaatctgatatagaagcatttttgtttaacctgtagtgtttttttttaaattttgaattagttgtcaatatttttcaaaattgaaagatttcatttgagaatccagatttcttagtaagtcagtagaatttgagcccctagcttgcattcttatatggcagcaattgaccagagtggtgttgtggttgctccttttagaaagggcatttattggctgggcgcagtggctcatgcctgtaatctctgcactttgggaggccaaggcgggtggatcacctgaggtcgggagatcgagaccagcctgaccaccatggagaaaccccatctctactaaaaatacaaaattagccgggcgtggttctgcatgcctgtaatcccagctacttgggaacttgggaggctgaggcaggagaatcgcttgaacccaggagataaaggttgcagtgagccaagatcgtgccattggactccagcctgggcaacaagagcgaaactccatctcaaaaaaaaaaaaaaaaaagaaagggcatttgttctccaggtttgaacagttttgaacagtcctcatcaacatgattcatcgatttatattgacttatcggctcctgtaggcacttgattttgcatattagtctggtcttggctaagccacagcagtaaaaacacaaatacagtagctcaaacaagaaaaagtttacttctgtctgtcatgccagtctggaagtaggcaggccatccagatgaggcaggaagctctgctccatgggaatgtctgggagccggctttctttgattttttgctctaacatcaacctcctctggtgtttttcttagtctatttggtcaaagttggttcaccagtgccctattcacatgtcaggccacaggaagaagaaaagagagaaagtggtagacaaatagttaacctttatgtaaatggcgcagaacttgcatacattccgttgcttaaaacattgtcatgtggccacaactaaatataaaggaggcaggaaaatgtagtcttgagcagtggccatgtctgtgtcttgttaaaacttggttggcagagaggaaggtcgtatcatttaaaagatgaggagtacatataccaatgtcatttagcatactctgccacagtttacatccactgatctagggaatactgtatttgtgatcaaataacacagtggtgatcaaatctagaatcagtaatatgtttatagagtttatgagtgagaaatctgagtctcagaagtttgctgtcaacactcagcagaacagtagtatagtggcaaactttggtccttctctcttcttcattctactacattattacaatttcttaagagttggtacttcatactagtagagttctttgaatgagcaaatgatagaagaaactaacctgcactggcacttacagcccggaagttattctcagcttaaattaggtgctcttcaacgatctgaatcagactagcaaacacgcagcatgcttgctgccttgctcctcttccataactatgtacttttggtgacatccttctttcctgctaacctgagatctcagaattcttcttaaggtagtgcttcaagctgtaagcaatctcctttcagtggaagggagttgcataaaaataaaagttacatgtcatcccagaaatgggtaattatctgaatatttctgcaccctctccctttttttaaatccattcttttgggcatgggggtgagagcgtgtgtagttacagtaagaattccaatgttacccttatttttcccatgatattttctactctctcctaatccctaccacctgcaatccctcagtttcccctgcatttctggcaaaattctagtttttccactactctgctatctttgaaagatgtcaaccaccttaagtatttctgtcttgtgtcttattgcttcatgaacaaaaaatggtgcgaagtgtagaataacaagtttaccttcagtagaggagttataaatctggaaggaatgttaatgtcagtgtatcattggccttcaatgattttctcccttataggcttttatatatgcttttccctttgcctagaacttgccccccacacacaccacctgcctacactctttcctctaatatagttttcctagcacccaggtttctgtatacttcttatttaatgtctttttttttctataaaactgtaaatgaagtggaagcaatgctgtgtctcattgccctttgctctttttctaatacctaccaaagtttctggcccttaaatactacagaatcagcaaatgaatgattgagggggaagatagcagggaagagaggaaacaaaagaaagaagaacccaatcttttggaagccctccttgtttccttcccttgattccgggaaacatgagctctagggcatcaatagctaatagcatacatttctttagcattttacaaactctgtgttctcttttctcttttcaatccccagttacttctttgctaaactcagtttgcctgaggtatatttatacaatcaatgggtatcatacatttgcagtttacattattttattggaaataatcaagagaagttttgagaattggcatagggtcaccaactttttttgtcaaagaaagatggtcttagaccagagaggtctggcttccttgcccgtcgctttagcctataattttaaaactttagtgtggggtctaccttctgcagatatgcctcagaggctgaggatcacagagggtcacattccctcttcagtcaaaagtactctaatcgtaggtctcctttatcagattattaactcagcctgtttccccaggtcttctttgatccttccttccaggatatccaggtcatccagaggtatcatctcccataatcttaaaaccaaacttcttatcgactatgaaaatagcccccacaattactaagaagatcatttcactttatagaagtcattttttttttgctttggataccctcataatggaatttttgtattgtaatatttgattattattataatctagaaagggaaagtgatagagaacagttgcatcatctcagaaaggggcccacattcaccgtgtctgctcttcctaacaaactgttctcaagatgttctcatcaaggagcttcttgtgctatatctttgttaaagagatggagcctgagttctgaggtattctgattatctgaagagattacttaatgacacaatgctatctcaaagaacagaagtagggagattcaagacaattctattccttacagaggtacaaatttctatgctaggaaaacaatacgaaagatacacatggcccataaacataaccattcccattcacaaaatttgtaagtgaaaccaaccagcaacctcatgtgagaatgttcttctatattgattcactgagagaaatgaggaccttaattttcttaagaaatcacccaccttcagaagagtctgaactctgtattgggggtgaattggaattggtctcaaagcttccctttctctaccttcttagcttttcaagagcaattgttatcttactttgttgtccttcataaggaaatctgaagattaggaatccaaaatatttgagcataattacataatagatatgtttatgctctgtactgatgtttgcctgagaaggagcaataagtgaggttagtggtttccaactctaaggactactttgtgtgtgccaattacagggctctgtgcagaaacacctcacatgtacacacacttcaaaagccactatgatttatttttacttgtgcatttatacatccacaaaacatttctttgagtagagcatttcaggtctaaaagaaaagtaagaaaaccactcaggctagagtttgagagcataaggaggcgggaaaggaactggagagtagaagctacagggtatactgctgcagggcatggctagggagaagaagccagagttataaagaagtgtagagccttcacaaaatctgaggttcataaaaatagagacattttagggatgaggatagaggacttggaacatgggcacaatggactgaagccagaaagcgatgacccagagtctgtgctcctagatcagaaaagccaggagaagtctccaaattatatgtacctgggaaagaacacaagctgagattggctatcctgtagatgagcaggtgcaagctggaactgggattaaacaagaggggattttctttgtccacctacccaatgtacaagctgagagaaactgttcaggacttgagctaagaatagaagttccgaggaaataggaagtgagagaaacttaatatatttacaatttaacttcatttttttttaattcaacagatcttcattgagcttatgctatgtgacagatacttttctaggcagtagacattccaaggaaacaaggtccttgttctcatggaactcatgttctaatgggaagagatagacaataaataaccaagtaaataatttaaggaaatgagacaaattgtgagtgttataaagaaaataaatcaaggtgatagaataataagtgactggggtaaggcatgggtgattcaatttggcttgctgaaaccatctctggctgttgtttgtagaatgtgttttaatggaagcagaaagatcagagaaggccacatggtaattcatgtgaaagataacgatggactcagatggcagcaagtcagatagagaaatctgagcagacctaagataatcttgtgtaggtggctctatcattatagggaaacagtttgtgtactttaaactgctcggccaatatgtgcctcagtgatacgtggcggagcttgtctcactgcataacacagctatgacatgataagacaggccctgcaagggaaactgctgacctcactttgtcctttctgggtaccaagtgactaatagtcagaaggtttcactcagttcagtaatctgtgtttaagaaaacaaaagggggcttttaaacatgagatttagtgaatatgacagagaatttttgagatcaactgaactcagtttgtaaaaagagctagattcagccccccaagcatggaataaaccttggaagttatgcaagaagttgtacaaatcttcaggttcttattgataacctgatgaaagccccaaacagtccctatgctggtccaagtttgggtcctcttaggtcccacgttcctcctgctctagcgtcctgctccactgggggctattttttatttccagtgcccagaaatggctgtgtgactatatgtttgcagtctgttggagggaagcaggtctctctgctaacaactgcacactagctgacatgctgcttaaattgagaaatgtttctaagcttttttggtaggaaataatctttcctgcttagtctccctctgtgttcccccagcaaacttcttgtgtagcattattaaatattccccaacatcagtggccaagaatgacacaattctgtgactcctcagtcacttcatgctccacattaagtggagtttcttcctagaatggggaaggcagaacattggtaagagctaggtgtctcagaatctttggaaataaaatccctgatccataggtagttggctcgctaggttacccagatatcaatctgacaggacagttttctgttcctccctgggtcttgattgtcattcattaggaatgaaattaaagtttgaaggacagtagtcaaatggcattcatttgctctcttcctctttggcaaatctaacaaacatcaggctttttccaggcaggaagagcctcatttctaaagagccaatttataaatatcattacctgattctgcaaaatgaagatagtcctaactagagtaactatccatggtgttgggtgttagtaaatatcatctcattggtagtgtgtgattttaaaacccacaaaactgctattatatggattttatctaactgtttaaaaccgatgatcacctttgaaactactgttacgagtactaggacttacaattttttttttaagaaaagctacataaatgttttggtggattcttcttcacgtaaacaatcattgatttgctatctcagagcttcaagaaatctaccttatgactgtcaaaaatgagagctgactctggcctctgttgtaataactaattgctctctcagtcacacacacacaaaattaaatttgggtttaaaaagtatcctggccaatctactttttaagtgttaaaatacatgttgatttgcctgacgtggtggctcatgcttgtattcccagcactttgggactcagaggtggtggatcacctggggtcaggagttcaagaccagcctgaccaacgtagtgaaaccccgtctctactaaatacaaaaaattagccgggcatggtggcacatgcctataatcccagctaaggcaggagaatcacttgaacccaggacgcggaggttgcagtgagccgagattgcaccattgcactccaccctgggcaacaagagcaaaccccgtttaaaaaaaaaaaaaaaaaaaaaaatatatatatatatatatgtataaagtttcttcccaaatcatgacaattatcatcatttcacattttccatatctggaagtatcataataaagaaaattaaaaccttaaggtagaatcacatctcgtacaatggatttagcacggcagtaaccttaagttctgacaccagataaatttggaagtcaggaaagatagtcatgatactaagacatatgttttaatcagttacattggagtagttaccaggtaatggaattcattaaaagaagtggtatattccatgtagctatattaaatactcgagcatcccagaagctagtgatactatatgcttccagttttctgagaaacttgaccagtttagcagactagaagcatcatccaaagttcttgtgcttgctttatatcaaagttctatagtctttaaatacatcggtaaggataaagagactggagcagaatcagtttgctgagtcaacaaagtgcccaagatgattactgttattgttttctcacctcatcaacaaaaagcatcccatatatatatatgtatatatacatatatatggtgtatatatatatgtgtatatatatggtgtgtatatatatatggtatatatatattttccaatatcaattttccaatatcaatctactgagatatatctcagtagattgatattggaaaattcgaactaccattttgtttatagtcagtagtaataccctgctaaaggtcgattgatttatatgctttgggaatacagttaattcaaaacactgcatgcttgtactttggaatagttggtcccatgaggtatgaactcagacatactcgtttacttcaaagtgaaacaaaaattctgattaccttaaatagaaaaaaattgagttgctgagaatatacgtaaaattgtcttttcatttctgttactttagtgattagagttttttaaaaatataatttcaagttttattttagattcagggggtacatgtgtagttttgttacatggatatattgcatggtactgaggtttagaatatgaatgaccccatcactgaggtagtgagcatagtacccaatagttagtgtttcaacccttgctccactctctccctccaccctctattaatcctcagcatctattattgccatctctatgtccttaaatgcccaacatttagctcctacttataaatgagaacatgtggtatttggttttctcttcctgcattaattcacttaggataatgacctccagctgcatccatgttgctgcaaaggacatgatttcattcttttttatggctgcatagtattccagggtgtatatgtaccacattttctttatccagtctaccattgatgattctctaggttgattctacgtttttgctattgtgagtagtgctgtgattaacaaatgagtgcatatgtctttggtagaatgacttattttcttttgggtatatatccaataatgagatttctgggtcaaatggtagttctattttaagttctttgagaaatctccaaactgctttctgtagaggctaaactagtttgcattttcaccacagtgtataagtgttcccttttctctgtagcctcaccagcatctgttcatttttgacttttgataatagccattccaactggtgtgagatggtatttcatcgtggtttagatttatatatctctgatgattagctatgtttaatgttgtctcgtacatttgttgaccacttgtatgttttcttttgagaagtgtctgttcctgtcttttcctactttttaatggggctatttgttttttgcttgttgaattgtttaagtttcttgtagattctggatattagacttttcttggatgcctagtttgggaatgttttctcccattctgtaggttgtctgtttactatgttcatagtttcttttgctgtggcagaagctatttaatttaattaggtcccacttgtcaatatttgtttttgttgcaattccttttgaggacttagtgataaactctttcccaaggctggcatccagaaaggtatttcctattttgttctaggacacttagagtttgaagtcttacatttaaatctttaatccatcttgaggtaatttttgtgtatgatgaaagttaggggtcccattttattcttctgcatatgactagccagttaccctagcaccatttttgaatagggagtcctttccctgttgcttatttttgtcaactttgtcacagatcagatggctgtaggtgtgctgctttacttctgtgttctctatcctgttccattggtctgtgtgtctatttgtgtacccagaccatgctgttttgactactgcagcattatagtataatttgaagtcaggtaatgtgatgcctccagtcttgttcttgttgcttaggattactttggccatttgggctcttttttggttttatatgaattttagaattgttttttctaattctgtgaaaaatgacattggtagtttgataaaaagagtgttgaatctgtatattactttgggcagtatggccatttgatgatactgattcttccagtccataagcatgaaatatttttgtttgtttgcttcctctatgatttctttcagcaatgttttgtagttctccttgtagaaatatttcatctccttagtcagatatactcttagatatttatgtaatgtgtatgtgtgtgtgcctattgcaaatgagattgtgttcttgatttggctctcagcttgaacattattggtaaatagatatgccaccaatttttattcatggattttgtatcctgaaatttttgtgaagttgtttatgagttccaggagccctttggcagagtcttcaggattttctaggtatagaatcatatcattagtgaaaagagagagtttgacttcttttcctatttggatgccttctctttcgttcttttgcctgattgattgatctaggtaggacttccagtactgtgttgaataggagtggggagaatggacgtctttgtcgtgtttctgttctcaaggggaatgcttccacattttgcctatccagtatgatgttggctgtgggtttgttatggatagttcttattattttgaggtatgtttctgcaatgcctagtttactaagggtttttattatgaaaggacattgggttttattgagacttttcccacatctattgagatagcccaatggtatttgtttttaattctgttgatgtggtgaaattgattaggatcttaatgcagattcacagatgaaaaattgttctattgagtagcaaatccatggatagcaatcacagctagatagtcacagcattacagagtatccatgaaaagaactgtttacttagcatttagtaaaagtcatagaataccagtatataaacctctggacttacaaattgataataattttgtacatttttcttaagttcttgcttgatcgaatatttctattttcctattagttttaggtttgattaatggatcactgtaaattcagatgcacctttgcactcacagtgaatatatggatgttccttccacttctaattgttccataaggatgtaaaatattcttaaaactgtgaaaatgttaaagcacattatagcacactttatagcctttctttgtatttaccctgcaaacaagtctttgaagcatagaaatctcacctatccataatcacaattgactgctttactaaattttaaaatgaggtggaatcgtaatgtattttaattgctaataggtaataatggctaataaatagcaattggttcaaacctaacaaaagtgggactccatttcctagtgttcttgccactgtgaacttgaatgaggcatttatatattctgtaaaaggttagtaatacaactattctatagtttacttttgcaaattaagatgtatgtgaagataaaatataaataatttgagttatcagaagaaaactaatatctaaatctatggtatcgtatagtgaaattttacagtaacaggagctatttatggaattaactaaaacctacaggtgtgtgttggtggagctcctgacaacacagcttcataaaaaagaaactgcttgactcaaggagacagataaaaagaagtgtgattatattatatgagtttgtggtcatttttccatgaatagttgagaaaatgactatgaaaaagagatttggtaaagaaatgtattattatggctgagcatggtggctcacgcctgtaatcccagcactttgggaggccaaggcaggcggatcacaatgtcaggagtttcagaccagcctggccaacatagtgaaatcctgtctctactgaaaatacaaaaaattagctgggtgtggtggtgggcgcctgtactcccagctacttgggaggctgaggcatgagaattgcttgaaccatagagatgtaggttgcagtgagctaagacagcaccactgcactccagcccaggcgacagtgtgagactctgtctcaatgaaaagtaaaataaaataaaaaaagaaatgtattattattcagcgaaaaaattagtatatgttattgcttatcaagtgttttgcaactcattctaatcaaggcaaaataactttattgaaaattgaaaattacagtctccataaccaagtggttatacattacttagtactttcaaagtgatacctcattgctctcctttaagctcttattcaaagatatattgactgtctaagaatctgtgcaggtcatttctttaaatacttagaaaaggatttttattttactaaggttatctattaccaaaaattaatattgaaatgaaaataaattttaagtaccatgatgaatatttagagctactccaacagtttagtgctatttttttcttgcaggcttgtacagcatatgtggattttatgatttctgtggccagattgattcgtcaggaagaaagattgcccatcgatgaaaaccagcttgctttggaaatgaataaagttatggaattggaaaaagaaattgccaatgtaaaacacatttttttttctgatacactgaataatgtcaaccgctttttttctttcccctctctatcatactttaagagtaaaaggtacagcactttaaccaagtagtaaaaatgcatggcttggtaatagatcattgacttcaaaaggacctttgaaactaaagaattttatagtaaactgggttcctgacatttaaaagacacactaaattggacaaatattaaactagaaacacttaattgccttttataagtggattccatcagaattctaccatttacagtcaaactgttgttagatgcccttcagactcagagcaaatgcaaagctgttttagttttgatatgtatagaatattactttattttaaagtttaaagtgatcacagagattgtctctatttctttgctaagaagtattaacccctgaacatagccatgtggcaatgtgatactactgagttcaaattgtcaggctgctgagctgacggagggtaagacaataattttgcaacaaagcccaaggagtgtattcctgaatttcttctggctctagatcaacccttggagtctgagttggcactttcttccctgatgattctttgatagggcactgcagtctcaagtgagtgaactctgagtctaagcagcatccaggttattgattaaacccatcgtcagagtcagtctaggacccacagagttctctttgtcattgcaaacgacaacctgcatccctgactccctatctgcttgcccctgccatctaagctcatcagaatcttgaagagttaagatcatggagggcaattttagctttcctggggctacgtgaaaccaaaaatctcctatcagaaccagggtgttcttggagctgccactgaatgaatggcatttgaatgggttacatgtggttctgtgttggaaacagacttgctagaggagaaatgtttcctgctctgggtttttgccacttgcaccttcccagaccatgcgctcctttgaccagcatcagctctgtagtgttgtgtcttacctcagcattatgtgtctatattctcactcttgtattagattcttgtattagattggcatgaggccttagacgtctttgaatcatttatgcatctctaacaaaatccagcatagtattgcacaaaggacatgctcaataaataattgttttcagtaaatgaataggtaagtgacctaaaggggaaactggagccattgtcactgagaaataattccaattttaaacctttaccttttgtctcttctcacttaaaattgcttttactcatttcagccactagttggggagttgttattgcaatttttctttttaattcagtgaaagaaataaaattggatgctgctggtctggcaggataggagaacagtcacaaaggtccatgatgttgccattctcagataacttgcaaccaaattgtgctctgtactaggaagtttctctgttacttgcgataaattcttatagaaactcttgcacctttttttccttgctgaattttaactaggacaccgaatggtaatggtgaagatgggagagagagtatttaagagagaaattggagatgactatatcaaagaaagttaaaatatgaaacattcacagacacaactgaactggccattagccatagctcataaatattgcttatatggcttggcagttgtcaaaatatagacagattttttaaaaattttaaacttgaccccacagccaaatctcaataattcttactacttctactccaaaaatctcttacatttcactttttttgaaatgacaaaacaaattacaaaaacaagtacagaataggacttaaattatgttgtacctatcctatatttttaccctcatatgtagttatatttttctaaagaattcttaattctaaaataatgattaaaaattaaatccataggctacggctaaacctgaagatcgaaatgatccaatgcttctgtataacaagatgacattggcccagatccaaaataacttttcactagagatcaatgggaaggtaagtggtaagttttttgtgctctcttattgtgccgttttctaaattataacattgaaatactctttctaaaattcgtcaagtttttatttattgaagtaaatgggacttcaattccttttttttttttttttttttttttgagacagggtctcactctgttgcccaggctggagtacagtgacacaatcttggctcactgtaacgtccacctcccaggctcaagcgattctcctgcctcagcctcccaagtagctgggactacaggcatgcaccaccacacctggctaattcttgtatttttagtagagatgaggtttggccaatctggtctcgaacccctgagctcgagtgatctgccggccacagcctcccaaagtgttagccacaggtgtgagccaccactcttagctggtaaaattccttttaaggcagctatacaataatactagaaactcccataggaaggggtttgaaaaatactaaaactgaaaatctttctgagaggccattatgtagtcatcagacttggacagtcacacaataaaagcactagatttccttttaactccaaaaaaggataatttattcatagaacttcccatgtgctcatcaaggccatctacagaggtgttcagaacaataattcagaaataggacacaaataaaaagaaaagctctctcatagattccatttataaacagcagttgacttctttttccttacctagtatccaataatctctttttgtggctatgcatttattctcgtgtattagttgatgcacacagccaagagatgaagcaatatccatgggaaaacctacaaactaccacattcagcgatgacattctctttggcactaattctagttaacaaggacttttccaaaggcataaactattgagttagacatcttacatagaattttttaatataataagtgtttaataaatacgttttgaaagaatgacctaaaccaccaaaggaaatgaagaaaattgtatagcatagcaccctatactcagtaagtgatgtgtgcttgtgtctgtgtgtgtaaaatacaacctaagatattgatagtcttaaacattatcaattcccatttagaaagacaagatttcatcttttggcaactccgtacttagcttctgaagtataaacatggcatgcctgtagacccaatatcgataattgaaaagatgctgttttctttgacttcataacatcactgtaccactgctataacagtatattttcatctataataggatttccactgagatgtgttactgtgtttgaatgaattgtttattaatacccacttttaaaagctaaacactttacacacatttccatttttgcataaaccaaaaaagctttatttttaaatttaaatttaaattatatttttattttctgtattggttagacaaagaagatgacattaagcctaatttctaggtatatgttccttaagcttaaaggctttgttttcgctcttaaatggttggcttaattatgctaggtaaataatcatgttgcagaactagtttttatttaaaaactgattgaaacaattgaggaagaatcccaagtgaatatcaaactgatccaaccctctaactataactgaatcttggacccaagaagagaaatccacaatttctgaatgtttcatgcctgcttttttccagccattcagctggttgaatttcacaaatgaaatcatgtcaactgtgaatattagtattacaaatgaggaagatgtggttgtttatgctccagaatatttaaccaaacttaagcccattcttaccaaatattctgccaggtaggtatgtcacagtccccatgtcctcaaagtttgcatttcatatcactcttcagaagctttgcagcctcatcttttctgttgctgggcggtggttttttttatacagagatcttcaaaatttaatgtcctggagattcataatggatcttgtaagcagcctcagccgaacctacaaggagtccagaaatgctttccgcaaggtgaagaaaaaatctctcttttcttaagacttaaagcataaagtgatacatggttatgaaggcttaccatgtacactgctaggacatggtgaactttgcaaagggacaaaatgccaaagttcgttatcttgcacatatttaggacatgttgctgaggaagataaatcttcatgggctttaccatcttatgatggtctatgtggcacgatgattgcattgtcctgtaaggagttacatttggttatttaaccagttcatgaaagaatactgtctggattttttgttgttgttactgtgttaaaagtaatttcggggttatctattttaattaatttgattttcaggtgctcattgcacactggacatatacacagatggacaatattgatgtgggcagtctattgaaagtacccctacctggagttaaataagaccttttcttagcctatacctatattatttaaacaatcactgttttggtactatggtgaggggagtaggcagtagggattgaggaaggagagactccagcaaacatgttagttggagtcttggaaagaaaataacgtggactgattaaaatttctagtttttatccttaaaaagaaaatgtagacatctttttaaaattaaagaatgcaaaaatgtattgtgctaaatctcccttacttaggttatcctgttattcttaaatttatacacatacaggttctgtaagtactcagagttcagctaaaaccttgaaaagcagtaatgtgttttctcatataccatatttcccccattacatttattgaatatgacttcacatttatgtttgtgcagtggttacagtgttgtatgtttttctaacgctttctacaatgatattaagttgtaatagcaaaaagttctactggggcatctactgaaaatatgcctagttttcagatcatatataagtaaacaatccatttggattacatttcatcataggctaggaacatgggccttgtgaggagaagtgatgaatatttcaagaacttagatgagacatttgtgaaatgtgtgctcttaacatgctccagacctttccttctggtcaaatgccatttcctttttcttttccgtaggccctttatggtacaacctcagaaacagcaacttggagacgttgtgcaaactatgtcaatgggaatatggaaaatgctgtggggaggctttatgtggaagcagcatttgctggagagagtaaacatgtggtaatgttttcagaataatacactgtcagttatacaggacactatcagtttgttcacactgatgagcaattacagttctccatcatttggctaaaattttattaatttaggcagagaacctctgaatcataatatgccattgtttcccaataaatcttcccttgccttccccaagagtctagttatgtttctgctcctaatactgtctagtctgaaaccaactcaccattttccagaagcagtgtatttggagtacccagtaacatgttctattgatatagtcatttataaactcttctattatcaaaattgcccccaaattagtattttcttaaaaacatagaaagtaaaacaggatttatttggagtataagaaatgtgctttatttttcattgttaggaaaatgaagacagtggaacttaatggtatggtgaaagaatttattgaaatgctactttatgcttagctaaaccactaatggtaatgacagccctaatattttacattagttcttccagtatgatagtgaaaccattatattctgaaaatgatttttaccttaatgcatatattaagacctatttaatcaagagtgtcgataatagcaatattgcttttaaaatataatggtcccatatatctgttagcttaggtcacagtttgtctataaatttacgtttattaacatattaagtcatacaaagatagcatgtagctctatttttaaaaatctgtgttacaaagaatgaattaatgacctatatttgtcttctgttctgatttgaggtcgaggatttgattgcacagatccgagaagtttttattcagactttagatgacctcacttggatggatgccgagacaaaaaagagagctgaagaaaaggtaaagagcagacagctaactagcaaagaaaaatctttgctagtataggaaaaattaactttaaaaacatttagaaaaaaatataatcaaagattgcataaaaacttgtaagctccttcaatatgtagtgtttccagaaagagtttttgtggataaagatatatttctacaattttaatcttttatctctgcaaccaatactctagcaaggtgaaaatattaagtttctgttcaagcaaatgtaaggtggtgcactattggtgcattataagatctataattaaagagatgttgaagaagcttttttataactattcatgcccacccataatgtgcagcttttattgagacttttactgagtttcataagaataggtctaagatttctcaggaaatcttaggtttaaatttactgtgatcatttgtctttataattatataataactagggggaacatgtcctgtgaaaactgttaacatgctttatgagcaacattcacatgcatcctgactaatctctgtagttaggttggcagaaaaagcagacgatttggattgatagaggagacaataataaatgtattttaataagataatcaaccttggtctagttttcttttagaattaaatcacatggaaggactatcttttttcagctctcaaagagccctgagtgggttaggcctagaacctctgcccccagtattgctatctttccatcactctggccagctcttcagacattcaggttggatttgctcctttcatgtcacagctgtgcatgacatggctctgcttggtaaagccagttggattgttctggatcggcatttccaaagtggtgtcacaaaatactggacatgcaagttattccacaagaggctcatggtcaaaagagtttggtgaacacttcttgtaggaaggcttccctcatctcaccctaggctgggttacatgctcctagggtgtgattttattatcatacgtgggagttaatatttatttcactgcttatcattgctgtttacaataagctctttatggttgggggcaggggggcagaaaatactgcctagcattatatcctcagccctttataacatacctggcccttggtagacccttgaaatatattgagtgagtaaattgataaattaatttcccatcctggacatttataataacttatgattctaaccttataatctaacccatttttaattgtaagaagtcctgcaataaagaaacttgcttaatgtttttgcgacagcatttacccgaagtaattcacaataatttttttgtgtgtttactaccttatactttctgtagaatttgtatcctttagaacactctttaaggaaatgtcttacagtaaataaagtatcattaagtgggggctggattgtcatgactgatggcaaacctacaagaaaatgggtttggcctcagtgacttcagtgatacatatgaggcctgatccactgactggggaaatcctgggctcatgtgacagatttgtaataaaactgcatccatttgatgggaaaccatgtaactcagagatacaggctaaaccccccatgaaaaatttaaattaattaaattatttaagagtgatacgaagtggtaaaatcaaaagtcaagtatcattgagaaaatcaagagagaaataaaataaaaatagaaataacaagtagtaaacaagtgataatgaaataataaaataagtaaaataaaccattttaaaataattaaaaatgaactttagaagtagtgataaataggccaggtgcagtggctcactggtgtaatcccagcactttgggaggccaaggcaggcagattgcttgagcccaggagtttgagactagcctgagcaacgtggtgaaatgctgtctctacaaaaaatacaaaaattatctgggcatggtggtgcatgcctgtagtcccagctatttgggaggctgaaatgggaagatcacttgagcccaggaggtggagattgcagtgagccctgattgtgccactgcacttcagcctgggcaacagagcaagaccttgtctcaaaagaaaaaaaaaaaagatagtagtaaatacataataaatatgagctggaataacaaggaaaaccccgttttccacttaactaattaatgtcatttattgaacttgagaagataggtacactgactttggagaataaaggagaacataaaaactccaggaaccaatatttaggactagtattagcagtaaacctataagcccatatctgttttctcagtcaaatcaatgaggcagaaaggtaattataacctgctggaatggaagctgtaaatattacttcttctaaaaaattgaaaaaaaaagctttgagagaaaaagttcataaaagtacaaaatatgtggaacaatgagttttgtcagtttttatgttggttttcttgagaaagctgcagcctataaggataaggcattagaaactcaatttcagacctgattttcatttattcttgaacctcccaggaaagagccattgcaaagatctctgtttaagtatgtcagacactcattttatgaacagtatggatcaagttattcaattgctagtcatgggcagattataaatttgtatctgaaagttatataatcatcttcacattcaatattataattttcataggccttagcaattaaagaaaggatcggctatcctgatgacattgtttcaaatgataacaaactgaataatgagtacctcgaggtaagtctctataaaatagactctggactactgatacttagggctggtagtagtgtcatttttagctatggggtgcctgaaattatatgaagtagcctgaaaccacaggttgtattatataaagccttcaacgctggtgccagaatgatatttgttttagcctttttgttttcattagccaggactatatttggttattgttcatttggtttccatatattccattttaagaaccgtaagtaaaatctggtgtcctttaaagagtatcaaggaagggatagacatcaaggtggtgaacaacaggcaggcttcttatcacattttacacaggcttcgagtttccctccaccttctaagttttcctctactggaaaaaccaattcatgcctactgtattttaaaaacaaaacaaaacaaaccctgatatttgagaactgaaaactattttgttctgccctggtaatgtaacagttaaaagagcagagagttgcttaaagtcactgcagtgctgatttcagactcaactgaaagtcttgctgctaactctgcagtcaccacaactacatgataccctgatgacagcgaggtgatccttgcccaggtcctgggatgacagtgattcctcattcattgattactagtctagcatggggatttgcaaaccatactgccttcttctctctttccatttgcagaagaaacttgactttttcttttaaatgagctggttatagcttgcaagacccaggggtccttatagcaggagcatagtggctacgaacacagactcaaaaccaagttccttgattccagatcccagttccaccactcatttaaacttggtcgagtgactaaactatatctcagtttccttgactttaaaatggggataggagcccttagttcatcggtattaaatgaacataatattagattctattagtataatagaattaaatgagtataatgtaaaatttaaagtacttagaatagtacttggcacatggtaagtactaaagaagaatgtgctattatccacatgtgttatgtgaagattaatgtcattaatgtgaggtttgtttgacacttggtttcatttgattattataaaataatacactgaatttgtgatttggctggaatactgacctgtgatatactaatagaattaggttaactggaactacatccttttttggtaagttttttaatgctctcttttaactttattgactgatataatttaagaaaatccctatgtttttagcaaaaatttagaagataccggttttaatatttcttcccaaatcttctttataatacagttgaactacaaagaagatgaatacttcgagaacataattcaaaatttgaaattcagccaaagtaaacaactgaagaagctccgagaaaaggtggacaaagatgagtgcgtatattctcatttctaatgtgatcatctagaagcaggtctttccctcctttctttgttggattaagtgaaagagcctcagttagaaaaatattaaaaagtacaaagtcctctttttattgagaacttctaaaagcatctaattatggtatactaaagatatggatcaagactttaaccagattaaaatacctttctcattaaggtatcctcaaatttacatgtctttagtttcgtcttatgtcattgcctatcagctcaatttatttgtgaacaagattctcaaaaaccttagcttaagtaagccaattcatagctcctttaagccttctcttaggccttactctgtgtccagaattttcttctgctgacagccccaccttttttctatcagtcaatcccacaactccatccccttcatagatagttaatgtaagacttttctaaccctgtggtagtcaaataggagatactaggaaccattcttattcacagtcttcttatgctcttaatctctgcttattagtgacattagtatttcctaataactattagtttagattttattttttctattaaatagatataactaacatatttatcagcatatgtgtttatgcaccgaaattcctagaaccacttatgttgactttttctccctaggctcttagcccctagacaacaggggctattccttttgaccataaagtctcagcatctagcatactgaagaatctcagttaaaacaaaattaatgagtgagtgagcaagtgaaaaataaatatactaacttgatttgtgtggtaactaacacagtaacatgccaaagaggtgcttgtttcattcatgcattcatttatcctttcatgcatttattaacattttggaacacgaagtccaggtgtcattgggtactgggagaatcaaaggtgaactttgattacattacaagagcagaaggtagacaagacatggtgtaataaactgcaccaccaagagggaaatgtcgtgccaagcaaagtacaaagtgctgtgggcttatttgatgataagactgttctgttctcagtaaaccaagtacaggttggacaaaactgctaatggaaatgccagtgcattttaatccttactcaacatgttgaactcttgcaacactgacgtgtcctgaaagagagagcaactcttttgctgacttctaagttcatattggaacaaatattgtgttatctgatgctaaaaatgggattgcaaatattatagaatgtttagtgtcccatctgggaaagaaagagagtgaatacacatgcttggcattataatcaagttaccatatcctgtctcttgaaacacacaaaaagttatgcaaaataattatctgggtgaatttatgatctgagaaatttcttataagtctgtatatttgtatttctttaaaaatagacatactaagatttaataattgttagcactataaaatatctatagacaaatactgtcaaatattatttctgaaatggccaaattaaccagtacccataggacatcaggaaatttcttcataattctagaaatagttgttgaattattgcttgatgttttcttttgaggttaacgtagtgccagtttcataatcattttgtcatataatttacactgttcattccctttcatcatatgggctgattttctctgcattcttctctttttaagatagataatcaaaagccaaaagtgtatacaatattttaatgaatgaatggtcaatagcacacatgcttcagtagtactttttggtcctccccatgagcttctgatgatcacaaatgcaatatgaattctaaggtcttctctgctatatggagccagctttcctttctttcctatagtctgcctgtataccagatacaaaggttcaaaactctagctgcacatgataatcacctggggaacattttaaaaaacactgattccccagctcaagcaccctagaatgtgatgtaattgttctgtagctggaacccagatactggtattctttttaagtaccacccaccaagtgagaacccctgagttagtgttatttcccttttgtgtgatatcgttcctgttcatattcaattttatggaatttttcacaagatgatgcctttaatttggcaatttaggtttaaaatttatttttatcttccaaaataatcagaaaccctctgacagtaattgcatcaaatcattaagactgagccctataggatacaacatgatcgaagctcctctcattttattaaggtttcttgcagggaaagttactgacttattttgaacctgcttaatagtaataaagttggctggacatggtggctcaggcctgtaatcgcgccactgcagtccagcctgggcgacagagcaagaatccgtctaaaaaaaaaaatgtaataaagtcattactcttttttcttttctctttttgtggagcaccaagttcaagtccttgctgtgtatgtttagacagataatttctgttgcttctacttgtccacatagcccgtagttacatcttagagaattacattttcagatgctcaagatcctcactcccaaagtcttgaaagagaaatatgtgtgcatacccaaaactgaagggacagagttgagacttttgtagggttgtattgtagggcacttcagagaaatgatgatgcattaaattttcaagacagcaactaatgtaaatgaattcaattagccaaatagtaaacttctagacacttttttcccccaattcacatgctctcactgggcaaactcattttacttctcgacatcttctatcatcatcatgtcagctgaatatttgtatttgactcagatccatttactaagattcaaatccaaatgtctacatgcttatgaaacatctccatgtagatgtcttattgaccctaaaaacacagcatttgtcatttaggcaaaaaataatatctgcccattttctaaaaacctccattttactgctaccaagacagaaaccaaggactcattttaatcatcctagacttatccctttctgttattcctgacatctacagtgatagttaattcaaatctccattttaaaaaaaaagtctgcatccaccagctgctatttaaatattacgtaggaatgggaagaggggatctctagctcaccattcccatggtcacttctgtaattcagacatttctcactgttcattgactcatctcaattattatcctactttttttaccaaccaccttctatatcttcagtttatcctccacactactaccttagagatttttttgaagacacaaattggcattttatttcctgatgaaaacacttcagtgtatccctgttgcctgtctcatgatgtgtgactgttttgaagagaaccaaggctcttcataccccacactagcactccagagttccttcacattcaccctacacctcaccattgtccaaagctccaaccatatgaattacttccaaatcctttctctgtctttcttacatccttgtctcttaccctggaccaccctttatgccctggttcatctaacagaaacctacacatgatttgattaaactttaagtgtcacctccttcctcacagcaccccattgcatatttctcttcaccttgggctgttctacactttgcacattttggtcaaagtaccagtacattttactacgtttagttggactagcccctattgaaagcaaaaaccagatatttgtgtcaccagagcttaaacactaatgaacagaatgtagctctttatgaatgtttatgggaagaataaatgataaaattgccaatttgtaataatgataataaaactaactcagctgctaaaataaaaatggtcacatctggctgggcccagtggctcacgcctataatcctagcactttgggaggtcaaggtgggcggatcacttgaggtcaggagtttgagaccagcctgggcaacatggtgaaacctcgtctctactgaaaatacaaaaattagccaggcatggtgccatgcagctgtaatgccagctactcaggaggctgaggcaagaaaatcacttgaacccaggaggtggaggttgcagtgagccaatattttaccactgcactccagcctgagcgacagagagacactccgtctcaaagaaaaaaaaaaaatggtcacatccaaacatttcactatcatggctggggaagatacacaacatcatctttaacaaattcaagaaattgaggaagtcaggaagtctgcatgtgagacacccaagttaataatttagctaaaagggcctccctctgctcttatgagtggctggcacctgcaaaggacagggatttacttttttttttttttttaagacggagtctcactctgtcacccaggttggagtgcagtgacaccatctcggctcccacctcccaggttcaagcgattctcctgccccagcctcccgagtagctggaattacaggtgtgcaccaccatgcccagctaatttttgtagttttagtagagacggggcttcaccatgttggccaggctggtctcgaactcctgacctcaggtgatccacccaccttggccttctaaagcgatttaaattttaaaagctcttgattcatgtggtttctgatgcctagtatgtgtttccaaaatcatctcaaacattatgtcttttaaggattttgcgccagtttgtaaagaattttaaacatgtcattataacatagaaatagtgctgaatcgggaatataataccctttggttacttaacaatatttctaaaatatttacttctagtaacatgaattttcatttagagttcatagagcaaacatgaatctctaaagaaaaagatgtacaagaacaaaacaaaatgagtctcttgtttttagacttgatgttattttgttagtttctcaggacagaacttcctgtgatataattgtgatgggtgttgctagtgtttgtgaatcataactgttgagccctggagttaactttttataaagtacaaagaggaatctcattggtgcatctctcttgctgttctgcatcaaaatgaaagcatactgacattgacaggagccaagtcaataaacatttattgagcagctagcttgtgcagagcactgtgctaaacaaaatagatgacaaagaggagaacaagatgttgccctttactcgggaggctatgatcttaaggggcagatgattaaaaattaaatctgatgaaaggcggggtttggttgctgctattaccaggaaacaaagtgctagaacagcacttttttcaaaccacaaagctttacttattagtaaaacacaatttttcaaaccacaattaaacctttacttattagtaaaacattctctggaatcaatatgtcagcatttaaattaatattgaggtgagcagaggattcacaaaaaacaaaacaaaaatgattggctcatttctgtctgccccttggttgcttcaagcatggtgttttttttctaatctggtgcaattggatggtggcacacctctgaaataagtggaacccctaaagctggcagctcaacatctgtgactccgtggtgcatatagaaagttcctgaaaggccagcaccaccaaaaatggcagagcagttggcaccctgggaagtgacactgtagttttgccactgcaatgagtgcctaatactcttttagtgttccagttctgccattcacaacctgtggccttttaaaagccctgtggtttccttatttataaaatgagtaggctgtgctagactgtagaatgtgtctgaggttctttctggcactaaaattctgtggaccttactgtgaagttttcataagagccaggaagttttcctccttggcttctccgcatcaaatgacccaagagaaaaaaacacattcttgagtggcagagaagtacctcgcttctttctaaaatatcccttctgatttttccacttcactaatgtttctagaaccaaccttctttctaactaagttctgtatagttcaacttgagtatcaaaggaaaaataattatgcagaaattatatgggtaaatatgatggcccagcagtggaaagttgatagtctctcgagggtgggcaggcggagcaccggacacttgagacaaatgactctccataaatgtagacggagatgatttgtaaaaaggactatttgactcagcaagtattagccagaaagaagagatacactaaacttgaacaaatcagtttaatttcccaaggcagtatctgccatggcatcctcatgttttgcacatgttgtaacagatgaaaattttagatttttacgttttatgcttccattaagccaacagagtctttgcagattttcattgtgttttggggttgttagcaaaatgtgttctattggcaaaaagatttctgctttttagtcagcatttgatgagggattctgttttgtttcgttttgttttgttttccagagggggaaggggaattagaaaaggaagccgaataatttaaaggctgaaattttaggtagttcttttttaaaaacaaaacgaaacaaaaatatcatcttcaaacaacacaattaaaaggtcctaaacttccatttaaactgaaagaactttgcaaaagaattctgatacatttatttcagtgtcatctcttgaaaggacaacattcaacggtgcacagtttctgacagccaccactctctatgacgtgcatagcaatggtgccctctgccctcctagagtcacaggatgaaatgggtcagcactctgggagcttggaggacccaatgctataccaaggcccaaatagccaagtgcctactatgctcccaccactggtcttagccttaggattcaattaagaacaaaacatggaatattcttgccttcatggaattaccttctaatgagctaggtagacaatagtcttatgtcaagttatgtaagtactgagggttatacagtatggaacaggtttcagttctttcctggaagttctcagaattactttaaatcaggagaaaagtcaccaaagaaaattctgacagaaatgatccacccacccaagtgtctccaaaattaggaatctctccgaaataaagcataccaagtgtgtatgcacatatatgtgcatgtacacatatataaggttagcaaagactaaaaagattgtgccttgttgccaaacagaactacacacaaacaactggtaacatctaggaaaacagtagtaattttccattaccttttgttgaaagagaagtggcttctcccagtttagtgtcaaaatcagagtcctagcctcagacagattcaggtaagtcacccagagtacttcagttatgttaacaaccatatgcaacaatagaagttctttggtcctactgtgcttttgcctttgggtaaaaagttacacttatggatcattgggaagagcctgtgctgtggagtcagggggtgaggggagtagacctgagtcagaattcctgctttgcctcctaacctctgaacctagaatttttcctttataatctggtgataatgacttcacttttgtcctgcatggttgtgttctacgttgtataatgcacctagaacataacttaggtgctcattaaatagtaaccagtgtgacacagtagtaagaaatggtcatcttcatttttaaagaggatggcaagaaaatggcattaatccctgtaatgaaattttgtgtatggtgcagatcaacagcttaggagtaggagatttgattggaaggtgagcaggttcctattcttcttagtttaaatataattttcccagttatataacgtagtttgtaggtgtattaggaaagagattaataaccatattgtgcctcagtttctatacctgcaaatatatggatggtttgaaagatgaataaaagtatacagaaaacttcgaagtcttgatgagagaatattgataattgtaaaggattagagtgattattgtgattacaaggtaagaattctttccacccaggcgactggaggaagacacagaaaatctatcgtattgcactgctgatttcaaaggagttgctttgagactactaaatgctgagaaattgaacactggcagtaccggctcactaacaattttgttgttttcagtttttaagttacacaagagtgggtgaaaaaaatttattctaggtgcttttgcaatctagtgggcttataatacccaaaaggctataggatcagtctgttgtcttctgcttttcttcccagctataaaaattatttctgcacactttcatcagcactaagcttcttcagggcaataagagatagaagagaaacacctggttcctctgtcaggtatatttcagttctattccccacccacattgttagctcagctttgagggccatactgcttctagtggcccctctttgttttactgccaaatgcccccaaacgagaataagcttacctgacaaaattacatctcataaattaaaaataaggtttcttccttcctgcttccccactcttcactttataccacatacatgcccacatttgtatgcatacagaccaccagaggaaggatgagaaatggaagaacagtggttcatctctaaagtctgatactgctctgtggaggctgttagtgtttggcctccacactttaaaggtatcttcaggtaacctacactatctattattttaggggcaagaatcaccaccatttcactttctctttgtgaattttctcttctctgtgctgccagtcagcatcaaatttggactgcattccaaccaaaagaacttacagtttttgttacatcactgtttagttggccctgttaatttagtttttatattaacattgagatattttgtgattgatcacaaatattagacattcagtctatagttgttatcatcaccttatttaagatgtaatgatctaatcacagtacttccagaggttctgattattaccagggacaaaatgtcctgtgcttttggtaattcccagactggtttgagggcacatcaagaaagatctcaaagaagaaaaggcaaatactacacactagtgctgtgtaaacccaaccaccataattctaattttatttgaatgtttggtggtcataaatagctacctattttctttaaggtataattcacagtggacattttaatatgcaaaactctccctgctggaaatttgcaaacataaatcaaaatgcagtcttaaagccctcaatgtaatgtaacagaagagcagaaaagcactaaaacaaaaggtatgacatttatttttacaaaagcaatagacacaagatggataatatataaacttcattcgtgtcctacttttgtgatctattgttatctgaaacattaatttcatatatcctgttcctctcctctgtaatcacagtttaaaaacaacttggattggcaccttttctatttcaatattaggatttttgactagtccagagccaaaaaatatgcaactgttatttgtaattacctgtaaaacccatgtagaattcactgtcactaaaccagaaagttcgcaattgagaaactgaaccctaaaaccactgggacctagatacctgttaaattaacttttatagcagttaaaactttaataactataagctgtttacctaaaaaatttgctgccacgtttgctatgaaaatgtcgaggacacatcagaattacctttcagaagtcatgcaaggaacaatgtttccccctaggagtagtaagagcacattttccattttgactttcttgccagacagcttggaatcgtatctgaacctgaattatagtaactgtctgaatatatataaacatagtcataatatatttcctaatcatgatttttgtttattttcttttataatacttcgtagtcacgtcaacgcaatctatttgttctacatcgtttctgatctctcaattttagtctaatatccctgggtttacacatacatgtttttcttgtgagtcaacacaaattatgtgggaagcaaatagagtttaattaaaataaataaaattatattgttgtaatcatcaacctgcaagaaatactaaaatactgatgactcggctgtaatgaaattaaggaggactgatattatcagtccccccccatcctgtttaaaaatgctttctcgatttaaaacaacagcagtaacaaactaaggaagaaacatgttgatcaatcattcttccccatctccaagctttttttcttcctaaagaaaaattaacagaaatgttaactaaatttttttaagtcccaaatcctttatataaaaagtcttgataagttgttgtagacaaaacccattcttagaatttatcagtcagttgttatatattgccctgtgctagttatttttaagagatcaaaataaaattcacttctgacagcccaaaatagttactgacattgtaactaaagcaacattgtaactaaagcctactttgtacagctcacctggcagagcagggtctagaaacagttctgatgtaacctaattgtgctaattactgtacaccccttctgtgagtaggataattgtcatactaacagttgccatgaaagtagaacaactgcagtgaagccattagatgatgatctctgactaccttaaatgtatgcatgtatgctgacatttaagaggttatctgaagtcaagcagtatccatttttccaatgagcaagtaacgatatatgtagtagtctactaagatgagaactttagtcctgttgcgcaaaatttctgaacacatgattattaatatgcagtcttcataacatctgagcagagagacatgggaactttggctcctatcctcatccctcaaattatcatctgggagccatttttttccattttttcattcagcctatagttatttatgcatttttctcatctcctcaactaaactagagtctcctgaagtcaggaactgtattttataaaatctctgggttctatacagagccttagacatggtatagacagacagacagaccgacaaatctacttaagaatgacctgggtttcattttaaagtcatacaaaaatatatctttgctcaattagctggaatgttgtattttttgaaaacacttttaaatggcaataatcagagacatattactctaagacaactacttgagatatcttagttcccaaaaaggttctttgtaaaccaggaattaactatttttaatatacttggatctgaagttttaatgacccacacttcagtattctgtcaactgctccagaatcgttgtcatagttacctagtatcaggaacataaagctaaataaatttcaatacaatcttaacccattgcaatttctgaagtgatacattttaataggttttgcaacatcagaggcctccataaaaatccatgcaaataaaataaaagattacagacttgaatatatgctgatgtttttcaagaaatagaaatgctttcaaatgagctctcacctagtgaactaattttaatttgttgatcatgtttcaaacagaaagttaagattcatctaggaatggtaataatgctttaattgtgtgagtgggttgaatcagataatgcagtatcatttgtaaagagttcttatgttttctacaggtggataagtggagcagctgtagtcaatgcattttactcttcaggaagaaatcagataggtaaggtgtattcttaaataattatttaatatttctctatcgttcccaacctgtagtgcattgtatgaccaattacaatacctctaaacaagcacagctgaggctgagttattgctctattgaatgcatttcttgaaagtaaatgcatccgtgtaccttctttcactatagtgggaaaattcagattggtacaaatcacgttaagtagttttgtttcttttacaatattcttatttatatctaaaatggtttatcttatttctaaatatttttattttatttctaagtaccttttttaaagtcccttgaatatatctatataaagtcatattgactttaagactcattaagcattagcttcttaaagtggtttaaggtttcaagagccaacttttcacagatccagtcctcctggcaattctgtatgctggctctgtgagagatgatcctattctatgtcatcttcattcaggaaggctccaaggggtttagaaagttggaatctcaattatattcgattgaatcgtatgaaattgtatttacctagccacaattgatcaaaaaagaaaaaatttcgtaagttcgcttatagtattattacagacatatatatacattaacacatgaataagttatcatatatgatgaataactgaatgacataatatgacaaaaatattttcttcttcttgggaaggcctggacatctttgaacatacattggctcacatatatcacttatcacatacattggctcattttttttcagggggtttttagcattagaaaggtactcaactgattcagtactgccagaaatattctaaacaaatagtagagcaagcttctgcaggtgcactcagttctccaggtacactcagtcctgcccttcatttctaaacgtggtctagaattaagagagatgataatctcagcattattctaaaccattcttcttatagctcagagtctgttgtaagcctcatttttattgaattctattaccaattagattagaaattataaaaaatcttacaagatatttatcattggctaaaaaaaaactaaccttaaaataaattgtatatttttaggttaaagtttgattatacctttccccgttgctttcaagtctaaaaagagttaggttaagaagttatctacagtttcttctagtatttttatgatttctatttttggagtaaaacctgaatccatctggaatttacgttggtacatgacctgaaactgaattatataaagtaaccagaaaagactgttttgtataacatataaataataagtaagatatgtttacttggcttaaaattacttagctcaaagtctaagctaatgctttctggctagggaaatgattacccaaacccataccagaacgtgcttaataatcaactcctcagaacctttgcagtcagtcctttataatatattatttgaaaccattcaaatcttgttttaaaatgcctttatctctagagagtcttcactttgaagccctctttttaatattcagtagttctgtcagtgtctagttcatttggtactgagacaaacgtaataattaactttcaatggaatcccaagtcaaagcaaggcaacttagactccttagtgctgcattagagcagaataagggatgcagcttcatttcagtccagcccagggaggaccctggatcctatcggagctcatgctggtgcatcctcagtaggaccactctggcatgttcagtccttcagcccttctctagagtaggctcaggcatttatgccaagcaggaccttgtttgattctgaattaccccaagcccctggaggtggctccaaattggcccacttcagggattccccgatcagagaagagctgaaaatattttcattttgagtataatgtcttgaaaccaaagaagcacacagaaaaaggaaaaagaaggtaaaagtggcccaatagtggtctatttcacaaaataaacaataatcctctggtaaatcaagaattagctataataacaattctgaatatataaaaaagaccttttccaagatccttaaaataaggatccaatggaaatataaaataagaaaacttgttaacctcttttcatatgcttgtctggttcttgaacagcagaagaagggaaatccttgaaatgtacactttttttctttcacaatttaaatcttcaaagtggggattgtcttaactaaaaatagttgaagagtcaaatctccatcttttttcttgataggaatgtttatgtgggctgggtgtggtggctcatgtctgtaatctcagcactttgggaggctaaggtgggtggatcacctgaggtcaagagttcgagaccagcctggccaacatggtgaaaccccatctctactaaaaatacaaaaattagcccagtgtggtggtgggtgcctgtaatcccagctactcggaaggctgaggcacgagaatcgcttgaacccaggaggcagaggttgcaatgagctgagatcatgccactgtactccagcctgggtgacaaaacaaaactctgtctcaaaaaaaaaaaaaaaaaaagaaagaaaaagaaatgtgtatgtgtatataaatacacacatacctacctatatacatgtcttctgcaacactgtcttaatggatttgggataatgtccattataaaattagggttggtatagagtaatatgtgccacgtaagtgagcccctccctccatacacacacatagacatacaaatactccaaattagactgcatacactttctcacgggattggtcattttatgttgttatgttaaaaaaagaacttgttttgttatatagagacttactcatatcaataatttctacttcttaattcagttttcaccattttgttagaactcacacatgtaggctacattccaatttgtatgcattcctactcttcatatcaacaaaaaagtcaatttccaagaaagaaggcaaactaaaagtgcttaatccactgttcctcttccttgcatgtttacttcatggagctctagaaggcccctgtgccatgacattaggaaagctgcgcttcaatgttttgtcatatggttctctgtaagttctaggtgctgttcagtcatcttattaaaccttaaaatcgcagtcaaggaaataatttagtgtattctcctttttcattaaaattgcagaaaggatcttttaaatcaatttttttaatttctcaaatgtgtaagttcttcagtgtgttcagtctgtgtcgactataaataccttgagatagttaaattttctaaattgccttatttattcttaggagttttattttcagacttgaaaattaagactgtttccaaacatattgttactccatttaatataaaaagaatgtttagactatgcatggtggctcatgcctgtaatcccagtagtttggaaagctgaggtaggctgattacttgagctcaggagttgataccagcctgggcaacactgtaaaaccccatctctaccaaaaactacaaaaaattaactgggcatggtggtgcatgcctgtggtctcagctacttgagaggctgaggtgggaggatttcctgagcctgaaaggtggaggttgcagtaagctgaggtcacaccactgcacttcagcctgggtgacagagtaagaccctgtttcaaaaaaaaaaaaaaaaagaatgtttaattattttccaccaaaaaaattacttaattgctgccttaggctacatatgaaatattctaaaattgaattgctagcagccttcagaaaataaaccacagaagttgtgctggggaggcaaaaacagggggaagaggagacatggtcttttgcttcatggcccaatgacttatttaattaactaacttgttgacaatcatgaacataaaaaatgcacaactaagcagttggttataaacaacagttgtgatgcctactaggtaacagcaataaggctagtggggaaaatcctccttacagagatttagctgacaaagtaaaaggggaggtcataattagcaaagttgaacttgaagactaatatttaataagaaccataaaagtcttatcacttgcctgaagaatggcatatcagggtatgattaaagcagcaggatctttgtagttaatatttagtcttgatagcacatttcataacagcattttatataatgggtggattttaatcaaagtacatagtgtgggagatagtattcactttaacttaataaagtactgcacataatttttatactttaaggtaaaaataagttcatggctccatttagctcaggctgctacacgtgaggtataactttcataaaaattctctaaagacaaaagtacttttttgttgtcgtgtcatttgaatgttatggcaactttccaaatttttgtagaggtctggggagcaattaaattgctcagatgctttttgaagtcttctctgtaaatatctaatatttatccctgaagcccatgcaaggttatactgtgttcagcccacctgaaagacaaagaaataacatgtgctactctgtgttaactagatcttaaatttcttaaggtcagggcccttgttttattttcttaatgtcctgcatagcaatgacccagggctttgcacttaataggtattgatactgaagggtttttttttaattacagaaagtaacgtttcagttattcagtggatgctagagttttaagccattaaagatagaattactaaactatgaacatttaattaatttaattttaatttctttctaaggtcaaagattagttacctccaaataacatgacccaaaatttgattaaacaggggaaatatattccaagggaagatactctccatcttttattagtatttaagacacattattagtatatttcagaaatagtgaaatatatttcatgagagtatatattataagaggatactggaatggggcagggaaggggagggtatgatggaggtggagaggtgggagaggaccctggggccataggccagaaagatgtgtttagctagagagcaatggtaagccttccaaagatttttagcaggagaatgatgatgcccagagttgtctttaatctggctacaggatagattcagagagtagattagatttagaatagattgtagttgtgtgagacagaaagtgggagactgattaggaaattaagtcattcctgagacaaggaatgagagtatgtgtaaacagtaatactgacaggagaagataaagatgctcctgaaagctacctcacccagcctctgcctaagcagacttgtaaaagactgtaaaagaaaggaggcatctaagataagtagaaacatttacttttgctgatagagacccttcaagggccattagcagaaataatacaaagactgagggcctagaggggaaaatgaatttgatgtttgatgcattaaatataacacatttgtgagacatctgaatggagaaagttagcaagttaatgcagatgtcagagtagacatactgaaaactacaattcatttatttattcactaaactctgtaggacacattagtaagttagggtgatcattcatttatttatcattgattattcattgattcagcacatttcctgagccctgattatgttccaggtactattctagttttaggcattgttcaattttaggcatttagataatgaactagaaaaatgtatgaaattaaaaaataaacaaatatatgtacagacacagaaatctctgctctcaaagggctaatatttgaggagctggggtaggattagggcagacaagaaaaggaaggactgtgatcataaagaaataaatagaatatgaggtagtcataagtgccttgatgaaaataaggtaaggttatgtgattgaggtataccttcaattgagtggcaatacttatttaagatattattgtagatggatacaatttctgcaataacattaaaaataatattggtgttactgagtaactatttcttccaaatatttataaggcagaaaggaccttctgaatgaaggttataacttccctttgcttcaaactccttacagcacaaaacaatcttggattgtaaagtgaatcgtgatgataaatcatagtttatagcaccactccaaggtgaactctgttgtcatccataataaaatgcctgcattggtttctattacagaaggtttttgtatataactaagtgaaactgacatagtgaacagcagcttagcaagcacaaagccaaccccaagcctgccatcactgaataatgccatggtggcatgcgcctgtagtcccagctactcctgaggagggaggactgtctctaagaaaataaaaattttaaaaacttatgccacaaataatctctaactatcttctctccttgtagtcttcccagccggcattctgcagccccccttctttagtgcccagcagtccaactcattgaactatgggggcatcggcatggtcataggacacgaaatcacccatggcttcgatgacaatggtaaagtgcagttgacattttcctttggctgaggtatatgctcataaatttgattaagagttattataatttattactacaaagctacatttattcaaacatgtatcatttctctaattttcaccacactttcaattttccctttaaattgttgcttaaagagatcagaaaattctcatagtgagttaagcaatgtgtgctttacactctggcagaatgaagtaaatattcccattgggaaaatactatggtgtttgtcagcggcagtgataatactaggtcttagtttcctggttgtatatgacgtatcttgtcatactcttaaaggacaggctgcatgtctatgtcttaaaatcagatgtaaaatcagaaaatattgcctctccaagagctcaaaagactcttaagctgcttaagagaccttttttttttcgtcttgtacctactacctagttcaagtctttgcaaacagttaggcacttaaatgccaccctaaatggaaaaatcaatttagagtttcaatcaaagctgaattcctgagaggaataaagacgtgaaatatgtaaagaggtgatagttcaatctatgacaaatttcattcacaaatggaaagtagagaacaatagagagaaaatacttaatccccattttagagagccagagaaagaaaaagagacagaaatgttagaattcttaaaaagacttactaagtgtctattaactcaaactatgcaacagtctttacaggtaggttctaatactgtttctgttttccaagtggaaaaaaataaaaacacatgaaagatttgcccaaaggtaacaaagataggaactggtagaaccagaaggtgaattcaagtaggttggctacatagcccttttcttaatcactacgtcataggcaaatatgaaaaagatggtaatattgtgtcaaaacacatgatacatataaatgcaattggagctcaaaagggagaaagatcgatgtagtttgtggttggcagggaagctgtaggagaaaaagactttttttgtgtgcttgaagtagagggaaactatgagtccacagtgtcctatgaagggtccaggaatataaaaatgccagaataaaaatgttggccattttaaaaatctcaaaatatcaaactaaacagacttgggtcaggtaaaaaccattcaacagaacaaggcataacttcaagaatattttgtctggcggcctcttctgagatatcaagagccaaatgggtgaaatgtctgggtcaatgctgagaagcattagcaaagaaagctctggcagtccaggctttgccaactctgtgatgaggagggatgacagtctctctcatcgtctgcctaatttaatgttctgtcacacagcagtatttcagtccttgcactttgaattaaacatatcttataattcttgttgcaatgagttcccattttacttaaataaatatattataggcagaaactttaacaaagatggagacctcgttgactggtggactcaacagtctgcaagtaactttaaggagcaatcccagtgcatggtgtatcagtatggaaacttttcctgggacctggcaggtggacagcacgtatgtcattagcattctcttgaaaagttttagacatgttcaatcttaagtgtattattggtggtttctttttttaacaatcctaataaagtgtcttttttaacagcttaatggaattaatacactgggagaaaacattgctgataatggaggtcttggtcaagcatacagagtaagtaaaaaagattttctttccattttagtgatttagagtgtttctcatatttaataattcatttaaaaccttttgcaaaaaaagaaactcatataagcagtaaatgatgaatagaaaatggaaaaaaatatgagaagaaagagtggtgaatatgctaaccataagggtcaatacattgatgtgacggagctgaacacttaagtttgcaaagagccaagaagaagagaaaatatggaatattatatcagctgaaatgaggagagagcaggttcacaaaggaggcaacatttttctaagaaataatctctggaataatttttttagaagaaatgtcccataagaaggattatttcagggtctttgaccaatataagaaacaggaccttcagttttgtagcaggtgaagtagcatttgggaacaaaaatcaatgtaaaccacaggcatattaaaccatagttcatatatgatacagtaagggactgacgtgatatggttccagcacatggccttgtagtcaaccacactattatacacagaggactattaacagtggagcatccgttagaatcccatttagccttccattcattcttgcattcaatacatattcattgaggcttaataggtttggcagtattcaaagagctggagataaagcaatgaatgctttatgaaaggtcattatttgaggatctgagcaagggttaaaaaatagtctggtggatgccatgtgcataagaaaaagcagggaatttcataaaagggtggaggaatgatggtctaggaagcaacaaaaaggaatgaagatgattttgagtgtttttctcaactatgaagtagcccatatgtaggagaaagagcagcatctacttgagatgtcacaaggaacaacttgttcctaggctagaactaggcttctctaagacaaggatggatggaatgatcagtggagtgaatgaggatgtagaatcatttgttcattatagaaatgtttggattagagtggaggaggtgaacatcaatggttggatcagggaagaggaagcaccagagaagtggagaaagaggtgactgatggggcctgcagtttgtcagtgaccaaagatgatcagagtgtgaagcttgggagattaagtcagctacaaggtttccaaaagaatgagtccaaccagttccagggacatgggagattgctgctactttgaatgtttagtaatttttttgttcgatgccagacattatgcattttacctcttttttttgagatggagtctcattctgtcgcccaggctggaatgcagtggcacgaactcggctcactgcagcctctacctcctgggttcaagcaattctcctgcctcagcctcccaagaattgggattacaggcatgtgccaccacacctggctaatttttgtatttgtagtagagatgggatttcgccatgttggccaggctggtctcaaactcctgacatcaagcgatccacctgccttggcctcctaaagtgctgggaacacaggtgtgagccactgtgcctgaccgcattttacctctttgggtctggatgttcttttgttcctgtaaatattcttgagctttattctaggatacagttaaattccttgaaaatggtttgatctttttgggtcttccttttgtaacttttattggttgggatggggacagtgttcagtctagggacattattctcaactgctgagataagaatctactctgtgaatcttggggatttccattcttgtcctgtgtaagtaccataaattattatctctaatccttttgagatattgttttcctagcattgggtattttgctcacacacatcttcagatcaagactaagctgaatgcttgaggatgaccatctgtaatctctgaggttctctttttgtgtagctttctcctctttagtaacctgttcttggtgtccctgaactctcagctccttatcctcaactcaaggagtacccccagctctgactggtttgctcctatgatatggcctgaaaactctcaggacaataagctcagcagtcatgggactcactgagagtaaagtttaacatctctcaggggtcattctccttttgcctgatgttcagtgttatgcaaaccattgttttaaatattttgttcatcatttagttgtttccacaagaagttaaatccagtccctatcattccatcttggctgaaagtggaaggcattggcactcaatattcccatggtgattctaatacacagccagattgagaatcactgctataaaatccagccaaagttgggattgatagtactcccatggagaacctcacctagagcaagtacagaattgttaatgatgaagcaaattacaattgtgcaaatattttattacactttgaaaatatgtaaattcttaacgtgtaatgccttgcccccctgctagattgcgagctctctaagagggagcaggtgcaagcctttcccatatccccagcatctttacatagtagaggttcaataagtctatgttgacggtaagtggaagaaatgaaatatattttctgctcatctagttggtcacattcctttgtattaaattggaaatgacacatctcagaacgtttattatgaattcgttttaaaagtttatttagtagaggaaaactcatttttttcagtagcataaatctttaagaattaagaggattttctgacattcaaattacctaaatattttccttcaaatgtacctgaggctcagtccattttgtcctgtcttcaaaagaccagaatagttgcattttattatcctcagactcattggagactaggcctctaagggatctcaagagaatcctttgacttggcaagaatcactcgatcttagtctggtgagtctattttgctaagatagtagtaactaagttaaatgtagcaattgcagacttccttggcaattcatttgtcctgactggtcttattcatcaatttataaaacaacatttagataagtttttcatcacttatttaggtcatccattcattcagttgacatttattgatcacttgacatatgccaggctcttgtcatctactattcagtagcttcttcttttcaaagcatttgtaaataaatttgatttgtctttctaatccataaaatagttgtaggttaccataactaaatgtattatcagggtgattttaacataaaatgttaattacttggtggcatgatcttttacataggtttatatataaccttaggaattaatattattgtttttctattttatcaactgcctaggcctatcagaattatattaaaaagaatggcgaagaaaaattacttcctggacttgacctaaatcacaaacaactatttttcttgaactttgcacaggtattgtgtctttcttgattgatagatatgaaaaccattttgagttataatttcacagtaagttagatgtcacatgctgagttcccttgttttacagagcatttgacttgattcactttcattgtttataatagactgttggatcatattaatgataaataactatgttcctggttgcctttcattgaacattatttgaagagcaaatggttgaggaatgcagaattccaatttaatttttctccttcccctcaacttgctcaaacaaataatccttgattgaacctgagtacatgctttgcttttcctattcctatctctaggtgtggtgtggaacctataggccagagtatgcggttaactccattaaaacagatgtgcacagtccaggcaatttcaggtgcgtggatatgaacagcaatcaaggtgctcttatattgggtccattgcttccacatttggaatttagacttttctaactctgattcttttacatttggaaattcagtgctttttttttttttttgagagtcaaaggtaggatcgagagaacacatcggagcattctacataagcatagccttggccactctctttcttagaatctacaataattataattccttagaatctacgaggctcagggcttgatctattccaacaaagatgtcgcctcagaacagtggctcaatttaaagctagcacaaagatatttctaagaggctgtgaatggtttaggcccagacccaatgagctccaacttgcaaagaaaaatttcaatataaaggaaactttctactaattagaggttcttcaatatggaataacattattcccaaagcttcaggagagagtacattgaagcacagcccatcaaggatgtgagagaaaaatgctctacagagtagaaaactgagctagaagaagttaaagttcttcccaaattagaaaatcaaagagaacaatgattgaagagagtcactccaaccaacatttgaatgttaaatcatagatcctatgtatttgtttaagaactgaattcctaatgctacccctttcccatgtactagaacacttagtcactcatttgctgatcaacaacacctctcaggcaagaaagttaaaaaaaaaaaacctaaaaattttgtagggtagttggaaaatgaaatttgagaacaaaagagaactaatgggctaaatttcaaaagctctacataaaatgaatgtaagcatactgcccagatcatttactcctgggaaaaaacacattcgattatggagaaaaacacatttaattatgaagcaataaagtagttcatttaaaaattaaagaatttattcagcttgctagtatcatcgttgtcatcatcatcatcatcatcatcatcatctagtatttgccctaacatttctttcaatattcattcactcaataactgcttatggtatgcctattatctctgtaatccaagctaaatttagttctgctaagatattcaaattaactgctttataggtaatgagcaacaaaagtgactggattaattcccattgtggtttattcaaaaaacttttagttttaatttttttaaagttgtctttttccttactaaagtgaacttaagctttgaggtaagaaacacttgagttccaaccatggcttcaccatttactagctgttaatgtaacctctgtacctcagtttcttgatatgtaaaataaggattaaattatcatgagagttgctagaggattaacgttaatataaatgaagagcctattttgtgtgtgtgtgtttgaaagtccatactaggattatttgtagacaagaggtatgaacagaataagaattcttatgcattttgtaatagttccctatcagtcaaggcttttttggtgctcatttcttatgttctgcacatttcagaatgttagtaactgatcagcagttaagtaaaacgtacataagtatataactgttttctagctccaattttaaactgaaaacaatattttgctataaattagttaaattatttgtatctttaagtctttattgttgttctggttccaaagatccctcatcgactatttttcattcataacaacagaagcgtgtgtgtgtgtgtgtgtgtgtgtgtgtgtgtgtgtgtgtgtgtgtgtgtgtgtgaagggtaaatggaatgggtaaatggaatgccaaccttttgtcaaggaaattattgttttctctggaggtaaggagattttcttggcaaaaggttgagcttacatttagttttggaaacaggccacttcctggctgtacaaagtaaaacatattttttaaaaaaactttaaaaattaatagatatcgagttgctatttaagaattgtgcttggtggttatatagaaatatttctgaattagagagagatttgtaaccttatgtttaaatagccatagtattaaaacaaaaggcaaaatacacttgatacaaagctgcatcataaaaccatatttgctatgtctaacctattgttgttttattcttcctgactaaagctttatttatgtactttaaaataaactttagaagttaaggtataagaatctaattctaaggatagcagctagcatttataagctcataaaaaccaccatgcaacctaatttgtcaagggtttgccctgcatatctccataaactaaaacataagtcataaaaacctaggtgaatttcagtaatattattgtaatacctagtatatctaccatcctcagagaatgagaggttgcaaattaagttttgataggtaaagtttgtctcttttaagtattaacatttttatcttaaccactggattaaaaattatctattaaaaacacatttctaccttcctgccttaaaacaatatcctgaaaaaaaaagcctaaccttttttaaaattttgatgacacagactactttatgattattagttatggttttactgtttattaatttagtctgtggagctatttattcttataccaattgtgatgctttttgacttattttgggtttttattagggtttttctgtgtgtttgtttctttcctagttttctttcctattattgtattgcctgcctttagttccctaattcctccattttgattagctcagaaaacattttgttaaatttaaatggtatttaatccaaaaacattcttcttttaatagtctagaaattgaatctataatttaaatattgacttcattttggaaatccagtttttggttagccatctatagtcatttcagggaatatttattataatatttatatgtaatctataaatatgtttctaaaattatttagctgtaattttctatataatatgtaagggtctgataattttgtaaagcaagtccaaatagacaaaatgatttaggtgcttagattactcaacattatcttccagtcaggaagaaagggcacttttagaactgacaccactatcaaagcaagaaatgtttctcacagcttaatttctaatattttgaaggaatattttgtctagtgttttatatagacatgttcaactaatatggctattttgttccttcataactctgtaatttagcatgctaataagccctctttgaaattcttctgtttcttccatttcccttcaatattagcattggttcctgatatttatagatatcaatatagattttagtgagttttgcagaatttctgttagcccctccaatctttagctgataactagaaatctattacagcatttatttatttatgactgtatagcagaacatacactcatcaatatgactttgctttgaaagaatcataaaaattagttaatgatgaagattggataccttattcctgaatgaaggcagttaactatgtagccaagtcattcatttacaagaattaacaaaaggttgtctgaggacccattaattgcaaacagtaattcagaagtccaattgtagtaggcaggaatagtcagataggatataaagtccattcttggtcccaatgccaaatctcttagatgtttttaatgcaagtaactgtttgccaagggaataaacatcagcagtacaataagttattttacataataaagtaaaaatttcaagtaaatcaccttaagaaataattaataaaagctttattatcttctgttattagaaacacaagcacacagttttgtaaagcatgaaaatcatgtacatatcttctaataacagaggataattcatgtaatgtgatctcactcttagaaaaaaagtgttttattaataatggattcacttttcaaaatagattatctaggcctggcacagtcactcacacttgttaattccagcactttgggaggccaaggagggaggatcacttgagctcaggagttcaagaccagcttgggtgacatagtgggacctcgtctctattaaaaacaaaaaaattacccaggcatgctggtacatgcctgtagttccagctacttgggaggctgaggcaggaggattgcttgaacccaggaggtcaaggctgcagtgagctgtgatcgtgcctctacactccaacctgagtgacagagcgagaccctgtctcagaaaaaatagatgatctattcaaagatttgatgtcataaacaccaaatgttaactaagaaagtaagtgaagccctagtgtgttgttgatctattcaggatcaaattaggtagagtctttggatggaaagaggatgggcagaatgggcatggagagctgagtgcacaccaggctgagtatttctgcagtgcccactctctgcggtgttatctgaagacgtttctttcttttaggtgttttttgtttgttgttttaacttaattttgagatttataaatataaatcctaaaaatactttttaagaaaaatatagaattaagtcgtgggtttggacattattaccgaagtacttgttcccatatgataaaatctaagaaaaaatcctttggaaaaaattaataaaataaaaacaaaaacatgcagctcttccagtcagtgatgctgatggcttaccctgtcaaccagggagcttgctccctagtgtgaggaatgcccaggatgacaggatgactgtctttagccagtagctaggcatcctgaattgggaagaaggttgcattaatgaatcaaagctcctctctaacataaagaatccttgagtcccgcaacctgaaagactaaagaccaatgcaaattcctaatttctaagctcttttaattcctacataaacagtcacttttgactacattatagaagtgatttttttttggctcatgaacaatggaaatttgtttctcacagttctggagaccggaagtctaagatcagggtgccagcatgatcaggttctggtgagggccatcttctggtttgcagactgcagacttctccttgtactctcacatggtccaaatagtgaatttgtttttcaatatttcagatgtaagaaatggacatttgtttttttcaatcaaattaagccaaactctgagctcttagaccaagctaggagatgagccatttactttcagtggtttttcaacgtactctttcagggttattcaggaatctgatatcatcacacaggcatagaaattagagaatagcctccatcttcagcccaccgtggtcactgctgagatccctacagtccaaatgctccagctggagtcagtggttccatttccttccaatgctcatgagctccagagcctccactcttcatgtccaggttctccaacaaccacacgccatgctatcagagggcctctcggggccttgctcagagcaggaagcatcttcttgtcattcacacaacctgccattactggaacctaccccattcttgggaaggccaatcatctccctgacaagtggactaatatataaattccccagcttctgactccacttcacctcaaccctcccacaccaggagattatttttcgtctttaagactcatctaggaatcctaaaaaacaaacaaccagaaaagattacatcctccatgaaagataggagagttgtggtggagagggatagagaagttagttgatgcgttgatgggtgacatattagaaagtcagacttacaaaaaatccatatggatctctcttttctggaatgaggaaagggaaagaaaatgctttctttctcttccagttggtccataatatcaaacaaacaacagaaacactaagtcgtgtttttcttcctaataccctattgcttctctacaggtaatcactgtgaccaaccaggtcacaggttaattcattcagtatgtactgagtcctgtgctggactttgggggtgcagcagtgagcaagacatacacagtacagcatcttccctcagcatctgtgggggtttggttccaggctccctgcagatatcaaaatttgtggatgctcaactccttgatataaatggtgtagtatttgcatataacctatacaccttctccctcctatactttgtcacctctagattacttataatacctaatacaatgtaaatgctatgtaaatatttgttatactgtattctttagggattaatgataagaaaagtaagtccatacgttcagtagacaaaatatttcccccacatatgttcagccgcatttggttgaatccacagatgtggaactcaaggatacaaaggctgtattttgccctcatagaaattagtctagtgggtgtgtcaggaagtaaaaaaggagaacaaatcattgtaaatgtggtaagtgctttgatagggatagtccctgtaagaggagttagtttagatggcattcaaagaagggggccaaggaaggaatatttaagcaaaggcatgaaggctgaggagttagccatgtactgactggtgagtaactttccagggagtagggtctgcaggtagcaggaagctctgaagagggacagggtttggctggtttgaggaactgaaggtaggtcagcatagtttgagcctaaggaggaacaggaagagaaatgtaccacgaggaggctagagaggagactggagccatcaggaggacattggaagccatggacaggagtttagatttccttcaagtccatggaaggttttaaatctgagattatggaatctgatttaaattttacagatcattctgactgtggtgtggagaatggttggaggagagagaagtcctaagatgtacacacagtagtacacctgccacgtagggagaattccataaatcaaaatggactcacctgtcatttgtgcctagtccttccaaaccagtccacttgtctctgggcccctcctcccaacccaagcaaacgtggtaggctggccttagcaggaggagaagggaaggaggtggttcagggttcagggtgggtgtgaaaacatcacctctgcatcaatgtactgacccatctctcccctcaaacactgctaggtgcagatagtgagttggactgtgttgtttttgcccactggggtcagagataagaggaaaatggcattttgccagccctttccagttattcaagctgaatccagcttctgatatttaaggagcccttttggaaaaaaggaaaataatcctctataaaagcaacaaaaaatatctatttaaagtctattatatttaagtcattatgtgagccctttcaagacatagtgagaaatcatgattatattctttgaccaaactcttattataatacaactccaaatacctgcattttcaaatgtgaattattcatgttttacaaacacatataatgcttataaattattaactctccatgacaaccttaagatgcatgttctattgtgcagaaaccaaggcacaaagaagcttcataagcaggattcaagccatgtagtctgtctcccaaattgcttttaactcctgttctttgttacttctccatttaaaaattctgttaatgagaaggcactgactcattgtaccaggttattttaagtttaactttaaattccaaattcattcacttgacctgcagagggaaatgcttcagggctccagtgtggtatggacgtgagtatcaaatgctgacggtgactttttttgtttgtttcaaaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgttctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctgttccaaactgccaactcctgtgtaaatctctaccccatttatttcttgaaaaatattaagattaaatggagcttttatctctgtagtcttgcatttcccactagcttcaaattgaatttttagaaaatgaatgatataagctttgtatccattatgtccttgttttccccaccctttttcaaagatcaccatgactttctgattggattttttttcaaaagtgaaatggccatcaaatgttatatggagtcactagcataatcagatgacttaggcaaaagccaaaagtaagtgtctttatccacagtctctagtctgaagaagttgaccatttggttggtcaagtggacagaggagtcacatctgactggtggtcaaactggcacatgtttatcgcattctaatcttttatctaacaatggtttcttaatttctgcttctttgtattttgcatttcctctaaaacagtgagaaacactactttcactttcaacctcatagacaaaatgttgtgcttctattttgcttgacaaaacagatcttctcagttgtacaaaggaagtctggcagaaaaataatcattggctcttgccagaaataatgatgagtttccaacttggggaagtatagaaagactggaaagactaatatttatgataaatgtttatactctggattttccttctacccagaaactgacaattttgcgggtattaggcatattagcatcccatttcgctcttataaatacacttgatagaatctccaatctgacatttatgctatatccaggaagacaaatggagccaagtatctgtattatcgttttaccttggtgtaaatccttcttacatgctatgaatgctctatgtcctctgacatactgcatcaaagatgtaatgctaagacgtatggcagctttataacaccaaagaaatagggattcaaacactaactagggctgggtgcagtgcctcacacctgtaatcccagcactttgggagtctgaggcaggaagattgcttgagcccaggagttcaagaccagcatgggtaacacaaggaaaccccatctctacaaaaagtaaaatacaaaattagccaggcatagtggcacatgcctgtgaccccagctactcgagaggctgaggtggaaggatcgcttaagcccaggaggtcaaagctgcaatgagccatgattatgccactgcactctagcctaggcaacagagcaagactgtctcaaaaaaaaaacaaaaaataaacagaaaacctgaccagcagaaaatatttagatgtagtaaatgaaaatagaaaaaggacacaatgttgagtatgcattatcatatcaactatgttaaaatattattccatagaaaaagagttggaagaatatatggcaaaaattaaccagggctatctctgggtggtagtattataagcagttcttattttccttttttggttttctacattttaagtttttctgtgataggaaaatgttactcttaaaaagtcattttaaaaatattatttggaaagaaaaagaaaaggaatatgaaagggaggggagtgagggggaaattgacccaaaaagaaaaatataatttccctaaataaaagggttgttaattctttttaggacctattcaatttgatgtctcaggcaacttagacccaaggaacctggtgaagtagattttggtcaagagcttgctgcctccaggacaggccagatctgtttataaagtaactttgacacacactgtataacacagaatggaggaagttgctggaccttcctctggtacttaaagtgcttctgtgagaacaaagcatgtaatctagaggaggttttgggctttttcctgaaaatgctaaaaggttgactgacccagccacactctcccacctggtcctccgcacctccccaacccgccccaaaccccagcatttgccaaaccctgacccagat

SEQ ID NO: 12664 - DNA, 107329 bp, Human; identical to SEQ ID NO: 12663

SEQ ID NO: 12665 - DNA, 85152 bp, Human
cccaccagattagctagatacagagtgctgattggtgcatccccaaaccccaagctagacacagagtgctgactggtgcatataaaatcctcaggctagacataaaagttttccaagtccccatctgactcaggagcccagctggcttcacctagtggatcctgcgcagggctgtgccgggcgcctgcactcctctcagcccttgggcagtcgatgggaccgggcgctgaggagcagggggcggtgcccgtcggggaggctcaggccacgctggagctcacaggggttgggagggggctcgggcatggcgggctgcaggtcctgagccttgccctgtgcagggcggctggggcccggtgagaattcaagcggggtgcaggcgggccggcagtgctgggggacccggcgcaccctctgcagctgctggcccgggtgctaggcccctgactgcccggggccgggggtgcggggcccgctgagcccgcgcccacccggaactcgcgctggctggcgagcgctgcgcgcagccccagttcccacacccgcctctccctccacacttccccgcaagcagagggagccggctctggcttcggccagcccagagaggggcccccacagcgcagtggcgggctgaagggctcctccagcacggccagaatggacgccaaggccgaggaggcgccgagagcgagcgagggctgctagcacgttgtcacctcgcattctgaaccacagactctccaactctccggcgcttttcgcccactcggtccctcagaacacgaagggctctctcatcctgtcactaaaacgattagctgtccggagacacggaaaaagtcgcccctcttctttgcaggattcctcccttgaacttctccaaaccctcttagtgtgacgtgaccccacccctagctaacccaggctgcttccttaccagcttcccgccccctggggaggcggcaatgcaaagaccgtccgctgccagctctgccgctatctctgtggggtgaatctaacatggcggacaaagacagtaactagtcccgtttctccgcgttttcgccaagaagattggctcttaccacttgtccctcaaaacgaccaccccattgactggtggcgattgcgtcgacggagacggggcaaaagcaagctgaacccgaaaaataacaaacactggggctgaggggtggaactacgagtgcgcagacatgggccagagcgcatttcccctgccccaggcaaattcggcgctcactgcgtccccgcaggccactgaccttacaggactacttgccccagactcctggggctggatgggaattgtagtctccctaaagagttgtacgtatctttttaaggcctagtttctgctttcaaaatacgaaaacataacactccagtccataactgttgacaagtacaagcgcgcacaggtctccaatctatccactggatttccgtgagaattgtgcccgctctggtattggatgttcctctccataagactacagtttctaaggaacactgtggcgaagacctttcattccgcaacgcatgctggaaataattatttccctccacccccccaacaatccttattacttatatttaccgaaactggagacctccattagggcggaaagagtgggggattgggacctcttcttacgactgctttggacaataggtagcgattctgaccttcgtacagcaattactgtgatgcaataagccgcaactggaagagtagaggctagagggcaggcactttatggcaaactcaggtagaattcttcctcttccgtctctttccttttacgtcatccgggggcagactgggtggccaatccagagccccgagagacgcttggctctttctgtccctcccatcctctgattgtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaaggtagtagagtcccgggaaagggacagggggcccaagtgatgctctggggtactggcgtgggagagtggatttccgaagctgacagatgggtattctttgagggggggtaggggcggaacctgagaggcgtaaggcgttgtgaaccctggggaggggggcagtttgtaggtcgcgagggaagcgctgaggatcaggaagggggcactgagtgtccgtgggggaatcctcgtgataggaactggaatatgccttgagggggacactatgtctttaaaaacgtcggctggtcatgaggtcaggagttccagaccagcctgaccaacgtggtgaaactccgtctctactaaaaatacaaaaattagccgggcgtggtgccgctccagctactcaggaggctgaggcaggagaatcgctagaacccgggaggcggaggttgcagtgagccgagatcgcgccattgcactccagcctgggcgacagagcgagactgtctcaaaacaaaacaaaacaaaacaaaacaaaaaacaccggctggtatgtatgagaggatgggaccttgtggaagaagaggtgccaggaatatgtctgggaaggggaggagacaggattttgtgggagggagaacttaagaactggatccatttgcgccattgagaaagcgcaagagggaagtagaggagcgtcagtagtaacagatgctgccggcagggatgtgcttgaggaggatccagagatgagagcaggtcactgggaaaggttaggggcggggaggccttgattggtgttggtttggtcgttgttgattttggttttatgcaagaaaaagaaaacaaccagaaacattggagaaagctaaggctaccaccacctacccggtcagtcactcctctgtagctttctctttcttggagaaaggaaaagacccaaggggttggcagcaatatgtgaaaaaattcagaatttatgttgtctaattacaaaaagcaacttctagaatctttaaaaataaaggacgttgtcattagttctttggtttgtattattctaaaaccttccaaatcttaaatttactttattttaaaatgataaaatgaagttgtcattttataaaccttttaaaaagatatatatatatgtttttctaatgtgttaaagttcattggaacagaaagaaatggatttatctgctcttcgcgttgaagaagtacaaaatgtcattaatgctatgcagaaaatcttagagtgtcccatctggtaagtcagcacaagagtgtattaatttgggattcctatgattatctcctatgcaaatgaacagaattgaccttacatactagggaagaaaagacatgtctagtaagattaggctattgtaattgctgattttcttaactgaagaactttaaaaatatagaaaatgattccttgttctccatccactctgcctctcccactcctctccttttcaacacaaatcctgtggtccgggaaagacagggactctgtcttgattggttctgcactggggcaggaatctagtttagattaactggcattttggcttttcttccagctctaaaacaagctccatcacttgaaatggcaaaataaaatcatggatgaggccgagggcggtggcttatgcctgtaatcccagcactttgggaggccaaggtggtaggatcacgaggtcaggagatcgagaccatcctggccaacatggtgaaaccccctctccactaaaaatacaaaaattagctgggcgtagtggcatgtgcctgtaatcccagctactcaggaggctgaggcaggagaatcacttgaaccaggaggcagatgttgctgtgagccaatatggcaccactgaactccagcgacagagctaaactccatctcaaaaaaaaaaaaaaaaaaaaaaaaacatggatgatcggtgtcgttgagaggataggtatttggaagaacctttgtttgaaactggctctgtacatacaatgaaattacatacttatttacatacaatgaaatgcagaggttttttttttatataggatctctgtcgagaggctggagtgcagtggtgctatcacagctcactgcagcctcaacctcgtcaggctcaagcaatcctcccacctcagcctccagagtagcagggacgataggtgtgcaccaccatgcccagctaatttttgtatttttttttctttttttgagatggagtcttgctctgttgcccaggctggagtgcagtggcgcgatctcagctcactgcaaactctgcctcccgggttcatgccattcttctgcctgagcctcctgaatagctgggactacaagcacccactaccacgcccggctaattttttgtattttttttttttttttagtagaggcgggatttcaccgtgttagccaggatagtcttgatctcctgaccttgtgatccacccgcctgggcctcccaaagtgctaggattacaggcataagccactgcgtccagccattcttgtatttttctgttgtagagatagggttttgctatgttggccatgctggtctcaaactcctgacctcaagtgatctaccctcccttggcctctcaaggtgctgggattacaggcctgagccattgcacccagccatggtctaaaaatcttgattgaaataccaccttttcatttccagacacccctatttaaaattaccacacccccagcacacactttatcttctattcctgctgcttctccataacactgattactagctgacattctatgtaatgtatccattttttatctctagtcccacagaatgtaaactccaggatgggatttttgttttgtttacatacatctgtatgttcagtagttagaacggtacttgggacctagttgccactcaataaacatttgtcaaataaataataaactaaactaaattagttctttaatttttttaaatatggtgatggttagtagtgagtaacattcaaaaaataagttgaaaagttgtaccattgcctcttacccacaataaaaaagggtaaattcttttctgctttatgaaagttgtttttcatatttgaagtcaagttaatcagattaaggaaaatgtatgttgtgttttcagagcgatacaagatttataaataaccatcctctcccttgcccttcaacattatagctaaacaaaaataagaggaaaacaggattcacaatttatcaatttattgaaaatcagagccagagaagcaggaaatgacattgtaggaaaaaactgcttttgaaaaagcacaaaacttactcatgacaatcagtgatcaggaaaatcctcaatagtgtggcatttggatacatttatgtttcatttccatgggagagagtcataaaaataggatgttctttctcattctggcaaattaaaccatcaattaaaaactcagatacataaaaattaaagatgtaagaatgaaaatgctaaattgttattttcaatcaactattatgttttctagcttttcattgcttttttctgtttcctgttaagattaatttctttttttttttttttttttttttttgagacagactttggctcttgttgcccaggctggagtgcagtggcacaatctcggctcactacaacctccacctcccgggttcaagcaattctgctgcctcagcctccggagtacctgggattgcaggcatgtgccatcacaccagctaattttgtatttttagtagagacagggtttctccatattggtcaggttggtctcgaactcctgacctcaggtgatcctcctgccttggcctccgaaagtgctgggattacaggcgtgagccaccgctcccagactttttgttttgttttgttttgtttttttgagacacggtctcgctctgctgcctaggctggagtgcagtggcgcgatcttggctcactgccagctccgcctcccgggttcaggccattctcctgcctcagcctcccgagtagctgggactacaggcgcccaccactatgcccggctaattttttgtatttttagtagagacggggtttcaccatgttagccaagatggtctcgatctcctgaccttgtgatccacccgcctcagccttccaaagtgctgggattacagtcctgagccactgcgcccggcctggacctttttttttcggggtggggggttggagtctggctctgtcgcccaggctggagtgcagtggcgccatcttggctcactgcaacctccgcctgccaggttcaagttcaagcgcttctcctgcctcagcctcctgagtagctgggattataggcgcacgccaccgtggccggctaattttgtatttttagtagagatagggtttcatcacgttggtcaggctggtcttgaagtcctgatctcgtgatccacccgcctcggccttccaaagtgctggcgtgagccactgcgcctggcttaagattaatttttgtttgttttgtttttgagacggagtctcgctctttcacccaggccggagtgcagtggcgccatctcggctcactgcaagctccgcctcccgggttcacgccattctcctgcctcggccccccaagtagctgggactacaggcgtccaccaccacgcccggctaattttttgtatttttagtagagacggggtttcaccgtgttagccaggatggtctccacttcctgacctcgtgatccgcccacctcggcctcccaaagtgctgggattacaggcgtgagccaccgcgcccggccttaagattaatttttatggtgttttacattcatttgtatggaaagttctaggatagggatcatatttcacttccttttaatatagtacagtatagcacaatttgcagttatgtcttaatatgtgatcaggaatgatcatgactggaaacagtgttatttgtggtagctatagggtaggtaaggttttcagcctgttttaggtttcttgaactaaaattccttctgctgtcttctaagtcaatattggcagctatttctgacaattggtagttctttgtaactttttacctatgactataacatttttgactttcagaagaatttgctaaaatgtgttccccggtgggttgttgtttttcaacctaaacctagctgctttttccagtcacttatccgtattggaagctcaaaatgcaaatatacagtaggcctaaaatattgcctggtttgaaaagtgtttaaaatatttgaatcatttttatagtaaacatttactctcatcaggacctagaaggggaacattttaattttttttcttttcccttttcacagtcttccttcaacattcattacctttttacatatcggagttttcatctgttcaaagtttgtgtttacagtgtgtttatatagtttagattataattaccatactgaaatataattgtttcagaattgagtcagtggtgagaatgaaagccatctggtatgataactgaatccaatttttcttttacggagaatttctttgaaatgtagcttatctcagaaatagggatttagtaaccaatcagagttttctttgtcaaggttgtttttctttttaaagtcacatttggtcccagtaataataccaatgttggtacaagttatctcaggttgtgaagcatttttcccaagtcatctcaggttgtgaagcattttcccaagtagcatttaattttattcttgcaatagcccaaggagtctggcagggtgaatggcaagagaaggaaacaggttcaggtagagtggttagcccaaggtggctctgcttatatacacaactggtagtagaaacccagcctcctgacttagttcattgtttttcttttcactgccctgtgctatgtcaaaaaccccatgattacaagagttgtattacaacccttcacaataaggttactgtccacaagcttttcttgtgatccttttctttttttttttctttttttgagatggattctctgtcacccaggctggcccgccttggcctcccaaaatgctgggattacagcgtgagccaccgcacctggcccttgtgatccttttctaaaaagttaaatatttaaggaaaaaaccacattcttgtcacactgccaggttagtcgttctttgatatcttgcctggactttatccaaaaaatccgtttcaaaaattcacatttagagctaagtgtagtggctcacgcctgtaatcccggtcgaggcagatggatcacttgaggtcaggacttcaagaccagcctgggcaatatggtgaaaccccttccctaccaaaaatacaaaaaaattagccgggtgtggcagcacgcgcctgtagtcccagctacttggaatgctgaggcacaagaatcacttcaatccgagaggcagaggttgcagtgagccaagaccacaccactgcactccagcctgagcagcagagtgagtgagactccatctccaaaaaaaaaaaaaaaggttcacattcagaagaaagctaaaggccgggtatagtagctcacacctgtaatcccagcactttgggaagccgaagcaggaagattgcttgatgccaggcattcaagaccagcatgggcatcatagtgagatcctgtctctacaaaaattaattaacattaaaaattaaaaagatggctggcatggtggctcactcctgtaatcccagtactttgggaggccaaggcatggtggtgcatgcctttagtcccagctactcgggaggctgaggcaggagaatcacttgaattcaggaggcggaggttacagagagctgagatggtgccactgcactccagcctgggcgacagaacgagactctgtctgaaaaaaaaaaagaaaattaaaaagaccagaataaagctaaagatttaaaatagcctataggttcctaccagaagttaccagctacctctctgatagtctttccctacaatatcctcctggattattacattttaacaccttgacctatctgatgtcctgcatacacaggcatggtcctgctccgggtttgccttctctgctccctctttcttggaatgctcttcccctaattgttgcatagtgtgtttctttacattattaagctatcctctagtctcacctcagtgaaacctttcctgactccccccatgtacatctcacccccacatagatattgaactacctgtttccccttaccctgcttaatttttctctttaatgcacttattcccatgtattctttaattccgtatcaactgtctaccacactagaatatgagctctatgagagcaggctttattttgtaaactgctacatttctatctcctagaatagtacttgaatatagtagtagatacttaataaacacttgttatattagtataataaatgaactaatctcaggaatgccttggttttgtggatagacaggtagggatgggaacttgggtgatgtattttctgaagtttttatttttaagcttattattattttgagatggagtccagctctgtcgcccaggttggagtacagtggcgcgatcttggctcactgcaacgtgcacttccccggttcaagcgattctcctgccttagcctcccaagtagctgggattacaggcgcatgccaccatgcccagttagttttggtatttttagtagagacagcgtttcactgtgttggccaggctggtctcgaaatcctgacctcatgatccgcccgcctcggcctcccaagtgctgggattacaagcatgagcccccgtgtctggccttattttcttttttttgagacagagtcttcctctgtcacctaggctggagtgcagtggcacgatattggctcactctgcaacctccacctccaggattcaagtgatccttctaccttagtctccaaagtagctgagaccacaggcatgcgccaccacgcccggctaatttttgtatttttagcgtagacagggtttcaccatattgtccaggatgatctggaactcctgagctcaggtgatccacccacctcagcctcccaaagtgctaggattacaggcatgaggcaccatgcccggccttaagcttatcattttctaaatttcctttagtgagtacttattacactgtttttacaaagtaatcacaaaccaaacatcatgcctcttctgaagtgatctaataagagtacacagtaccatctgtaaagtgttcttgccagaaagttgaacctgaatgattaagcctgtaagtctagtttataggaaataaggctagaggaacaagttaaacctcaccatagggttatacaatcagcaaaatccagaatgggggaaactccacaggtcaaatgacctaattttaaaaataaatgacaagggagaaaaagtaagagacacctatagatcagaagacacttggggctgggcatggtggctcacacctgtaatcccagcactttgggaggccaaggcaggcggatcacctgaggtcaggagttcaagaccagccggccaacatggtgaaaccccaactctactaaaaatacgaaaaatcagccgggcgtggtggcgcacgcctgtagttccaactacctgggaggctgaggcaggagaatcacttgaacttgggaggcagaggttgcagtgagccgagatcgcaccattgcatgccagtctgggctacaaaagcaaaaccccatctcaaaaaaaagaagacacttgggtttgggtgtgttggctcatgcctgtaaaccccgtgctgggaggattgcttgagcccaggagttcaaggctgcagtgaggtatgtttgcaccactgcactccagcctaggtgacagagtgtgaccttatcttaaaagtaataataattaaaataatctggggtaggggtggatatgggtgaaacagcttggccatgagttgatggttgttggaccagggtgatggtccatatagttcattttattattttatttacttgaaattttgaaatacttgaaattttccatattaagttaaaaaggcatttacagtaaacaaaaaaaaagtgctaggaaggaattcaaaagaaatataagcagaaaattttgtctttatggagcttaaagatgagatgtgcacccacagtgatagtgcagaaaaatatatcactggaaatgaattcgtacgaactattatcaactaatcttttaaatgctgatgatagtatagagtattgaagggatcaatataattctgttttgatatctgaaagctcactgaaggtaaggatcgtattctctgctgtattctcagttcctgacacagcagacatttaataaatattgaacgaacttgaggccttatgttgactcagtcataacagctcaaagttgaacttattcactaagaatagctttatttttaaataaattattgagcctcatttattttctttttctccccccctaccctgctagtctggagttgatcaaggaacctgtctccacaaagtgtgaccacatattttgcaagtaagtttgaatgtgttatgtggctccattattagcttttgtttttgtccttcataacccaggaaacacctaactttatagaagctttactttcttcaattaagtgagaacgaaaaatccaactccatttcattctttctcagagagtatatagttatcaaaagttggttgtaatcatagttcctggtaaagttttgacatatattatctttttttttttttttgagacaaagtctcgctctgtcgcccaggctggagtgcagtggcatgatcttggctcactgcaacctccgccccccgagttcaagcgattcttctacctcagcctcccaggtagctgggactacaggcacccgccaccatgcttggctaatttttgtacttttagtagagataaggtttcaccatattggccaggctggtctcgaactcctgaccttgtgatccacctgcctcggcctcccaaagttctgggattacaggcgtgagccaccacacccgactgacatatattatctattaggatgtaacatcattttgaacagtgttttgtattttttgtgtccatcagtgaaagcaaactgcaagcagttttgaaataagcacattgtgtttgagccttcccagtttctcctttctgttcatttctgcatatccttatgcattcccccttctaagggtcagtgtttgcccgctttgtaatcattgtgaagacaggaaaggacctgataccagtttctatttaggccaaaattcatttatagcagtgattcaagttatatttacgtatttgatgatcttgtcttttgaaatgaaaatgtttgtttcttaataaaagaatttcagaaaaagtagagtaggtaatttagtagaacaagtgggctttctccttttctttatgttaagctatggctcacatcttaccttaaatgtcaactaatttgtttttaagtatttatgtacctggtacataacctggtaccaggtacaaactatgtacttggtaaaaagtttattagcacaaaaaggtatatgatgcaaagtatacttccctcttaccctacaacccctgcctccctgttccctccccagacaaccacaatgatcaatttcttatgtatcctttgaggaatttttaaattccagagttcttaacttggggtttatgaatagtctttatgaatttcctagaattatatttaaattgtattcaaaactatggccatgtacatttttctgggaagatagtccataattttcatctgagtgagctaagatcatgccactgcattccagcctgggcgacaagagggagactcaaaaaaaaaaaaaaaaagtcccagtatttactacagagagctaaagattaacctttaaagccctggggctttcaatttatctggatgagaatctttctggaatgaactgtatgttttcttgtcagcttgagtaacaaatgctgaacatactatactattattacagggactcaagggcccagtgtggtagctcctgcccataaccccagcactttgggaggccaaggcaggaagatcacttaaggccaggagttcgaagctgtagtgagctatgatcacaccactgcactccagcctagatgacagagtgagaccctgtctttttttttttttgagatggtgtttcactctattgcccaggctggagtgcagtggtgtgatctcggctcactgcaacctccacctcctgggttcaagcgattctcctgcctcagcctcttgagtagctgggattacaggcatctgccaccacacccagctaatttttgtatttttagtcgagacagggttttcaccatgttggccaggctgctctcaaactcctgacttcagctaccttggccttaaaaagtgttgggattacaggtgtaagccaccgcgcctggctgaccctgtctcttaacaaaaaaagagagattaagttatgaatatagttgctttgagaacttgtggaagaaggaaattataggcttataggcagagataataatacgagcaaatgtacaaataaaagaaaatagaggacgggcgcggtggctcacgcctataataccagcactttgggaggtcgaggtgggcggatcacgaggtcaggaaattaagaccatcctggccaaaatggcgaaacactgtctctactaaaacacacaaaaaactagcctggcatggtggcacgtacctgtagtcccagctacttggtaggctgcggcaggggtatcacttgaacctgggaggcagaggttgccctgagccgagatcatgccaatgcactccagcctgacaacagagtgagactctgtctgaaaaaaaagaaaagaaaagaaaatacatccaggaaaaataagctaactttgcatatgtgtataggagttgtgttagaaaaggaagaagccctcaaagatgggaagccatttgcaagaaagagaaggtccaagaggaggcagaagggattggaaatagaaaaaggatgtaagaaagagttgattattactcataaacagtaatgaaggaaaaggagagtaattctacaggaagatgctgaggtgctttgagcccagtgaagttggaggtaaagacagctgttgaggccgggcacggtggctcacgcctctaatcctagcacttttggagcccaaggcaggtggatcacctgaggtcaggagctcaagaccagcctgaccaacatagagaaaccccatctctactaaaaatacaaaattagacgggcgtggaggcgcatgcctgtaatcccagttacttgggaggctgaggcaggagaatcacttgaacctgggaggcggaggttgcagtgagccgagattgcgccattgcactccagcctgggcgacaagagtgaaaactgtctcaaaaaaaaaaaacaacaaaaaacagctgttgagattgagaggattagagttggcaactggagaagagtgagaagcttgaaacccctactgatgaagattgtgatagtcaggaaagaaccagtcataaagatatatgtgtgtgtatacatataaatatgttatatatatgtgtgtgtgtgacacatatatatttttgtttgtttctttgagacagtgtctccctctgacacccaggctggagttcagtggtgtgatcatagttcacttttaccttgcaatctgggttcaagcaatctctcatctcagcccctcaagtagctaggactacaggtacatggcatttgcccagctaatttttaagtttcttgtagagatgggccagccatattttaaattgtgttttgaatgttatattagaattaaaagtccaaagccgggtgtggtggctcacgcctgtaatcccagcactctgggaggctgaggtgggcggatcacgaggtcaggagttcgagaccagcctggccaatatggtaacaccatctctactaaaaatacaaaaattagctgggtatgggggcacatgcctgtagtcccagctactcaggaggctgaggcagaggaacctcttgaacccaggaggcagaggctgcagtgagttgagatcgtgccactgtactctagcctgggtgacagagcaagattccgtctcaaaaaaaaaaaaagtccagtataatgcccatgtgatagatcgactttttcatgaaatctcttctgtaatatcaatataatctgaataacactttgatctatatgatgagaaagctgggagcctgggagcgatacccccatgcttttgttgtattaattgtattttctacggataaactctaattgctaaaaataaaacaactttattgacccaagcaagcctaaagttctgaaatcttttttttatttttgtttgtttgtttgtttgtttttgtttgttttgttttgagacggagtctcgctctgtcgcccaggctggagtgcggtggtgcagtctcggctcactgcaagctccacctcccgggttcacaccattctcctgcctcagcctcccaagtagctgggactacagacgcctgccaccacgcccagctaatttttttgtatttttagtagagaaagggtttcaccgtgttagccaggatggtctcgatctcctgacctcgtgatctgcccgccttggcctccctaagttctgggattacaagtgtgagccaccacgcccggctgtttttttttgttttgttttgagacggagtctcactgtgttgcccagactggagtgcagtggcatgatctcagctcactgccacctccatctcctgggttcaagcaaatctcctgcctcagcctcccgagtagctgggactacaggcatgtgccaccacacctggctaatttttgtatttttagtagagacggggtttcactatgttggccaggctggtccaaaactcctgacctcaggtgatctgctcgccttggcctcccacagtgccaggattacaggcatgagccaccttgcccagccagttctgaaatcttttatgaagcctataaaaaaagataataataccaatctagaaaatatttcttaaggcagtcatgcattagtttgaactttccaaacaaaaaaatgcaatgtgtaatacttttttttttttttttgagatggagtcttgttctgttgcccaggctggagtgcagtggtacaatctcggctcactgcagcctctgcctccctggttcaagtgattctcctgcctcagcctcccaagtagctgggattacaggcgtgcaccaccatgcatggctaatttttgtatttttagtagagacagggtttcaccatgttgacaaggctgatctcgaactcctgacctcaggtgatccgcccacctcagcctcccaaagtgctgagattacaggcattagccaccacgcccagccttttattttagtagagaccatgtttcaccatgttgaccaagctggtcttgagctgacctcaagtgatccgcccacctccacctcccaaaatggtgggattataggcatgagccaccgcacccagcctgtaatacttttttgaagatctagaaccacattgttcaaagagatagaatgtgagcaataaatgtaacttaaatttttcaacagctactttttttttttttttttgagacagggtcttactctgttgtcccagctggagtacagtggtgcgatcatgaggcttactgttgccttgacctcctaggctcaagcgatcctatcacctcagtctcccaagtagctgggactgtaagtgcacaccaccatatccagctaaattttgtgttttctgtagagacggggtttcgccatgtttcccaggctggtcttgaactttgggcttaacccgtctgcccacctaggcatcccaaagtgctaggattacaggtgtgagtcatcatgcctggccagtattttagttagctctgtcttttcaagtcatatacaagttcattttcttttaagtttagttaacaacctttatacatgtattctttttctagcataaagaaagattcgaggccgggtgcggtggctcacgcctgtaatcccagcactttgggaggctgagatgggcacatcacgaggtcaggagatcgagaccatcctggctaacatggtgaaaccccgcctctactaaaattacaaaaagttagccaggcgtggtagcgggcacctgtagtcccagctactcaggaggctgaggcaggagaatggcgtgaacccaggaggcagagcttgcagtgagcagagattgtgccactgcactccagcctgagagacagagcgagactccgtctaaaaaaaaaaaaaaagattcgaatccttatcttggttgatttttgcgtatctagttccactgaattatttatataattgtatagactacagcacgagacagcttagcttgtcactctactgtactatattctgcagtactatcataagggaatttcctccctacccctgctctgaattgttcaattgtactatttgctggagtaatgcttgatgccttcttgatccattatactagagtatatgtagtatttgtagattctgaaggagtgggagcctctattctgagttttaaaggtacttatgtacagtggaggtagctttttgacagcctcatcttccaaactatagagtcattgttttgttgagtgcaatatggtacttgaagcatctatatcggcgaagaaggacccaagtctccttgaccttacctacctacattcactttctctggtaggaagattgtgggtgcctctctccagacttagtttccatgtcaaaaaagaaaaaaggaagattgtgggctttgctacaatccaattctggatccaatataaccttcattgcttaattactgtgtgatctgggacaagcctctactctataaaaatgaagataaggccaggcttgatggctcatgcctgtaatcccagcacgttgggatgccaaggcaggaggatcacttgaggtcaggagttcgagaccagactgggcaatatagtgaaaccacatctgtacaaaaataaagatagaaagtagcccagcgcaatggctcacacctgtaatcccagcactttgggaggctgaagcaggcgatcacttgaggtcgggagttcaagactgtagacagatagataggtaggtagatagatagagatatagatatagttggggtttttttgttttgttttgttttgtttttgagatggagtttcgctcttgttgcccaggctggagtgcaatggcgcgatctcagtttactgcaacctccgcctcccgggttcaagagattctcctgcctcagcctcctgagtagccaggattacaggcatatgccaccatgcccggctaatttttgtatttttagtagagacagggtttctccgtgttggtcaggctggtcttgaactcctgacctctcccaaagtgttgggattacaggcgtgagccaccgctcctggccttttttttttttttttttttttttttgagacagagtcttcctctgttgcccagggtggagtgcagtggcactcttctcagctcattgcaacctctgccatcctgggttccagtgattctcatgcctcagcctcccaagtagctgggactcaggcgtgtgcccaccacgcctggctaattttgttgtatttttagtagagacagggtttcaccatgttagccaggctggtctcaaactccaggcctcaagtgatctgcctgcctcagcctcctgggattgcagacatgagccactgcacccggccaagagagggtaataaatgttaaattacctggctagtaaaaaatattctctaagtgtcttttctcacaattcccaatgccttttttttttttttggcacaatctcactctgttgcccaggctggaatgcaatggtgcaatattggctcactgtaacccccgcctcacaggttcaacttattctcatgcctcagcctcccgagtaactgggactacagtgcaccaccaccacacccagctaatttttgaatatttagtagagacagggtttcaccatgttggccaggctggtcttgaactcctggcctcaagtgattcacccaccccgcaagtgctgggattacaggtgtggaccaccgtgcacagccctagtgactttttttttagccccttaatcttttctttcctgggtctcttcattgtcagtgtctgctatttactccctacctagtcacccccttcaccagtatattatgtcctttatgttttattttgcaggatcttattttgcttttctattgaatcccctccatctagaatagtactagacatagtaaatattggttgtatgagtgaatcgctgcttttaattatcatcaccattgctctctctacttctggtctatgatccactttgagttaacttttgttatttggtgtgagataggagtataatttcattcttttacatgtggttatacttttgtctcaacactgtttgttaaaaacacaaaaagtattattttcccatttaatcatctttggcctgggcacggtggctcatgcctgtaatcccagcactctggaaggccaaggcagatggatcaatttgaggccaggagttcaagactagccaacatggtgaaactaaaaatacaaaaaattagctgggtatggtggtgcatgtctgtaatcccagctactcgggaggctgaggcacgagaattgcttgagcctaggaggtggaggttgtagtgagctgagattgtgtcactaccctccagcctgggtgatagagtgagtctgtctcaaaaaaaaaaaaaaaaaattaagaaaataaaaatcgtcggccaggcatggtggctcacacctgtaatcccagcactttgggaggcagaggcgggcagatcacgaggtcaggagatggagaccatcctggctaacatggtgaaaccccgtctctactaaaaataaaaaaattagccgggcatggtgctgggcgcctgtagtcccagctgctcgggaggctgaggcaggagaatggcgtgaacccaggaggtggagcttgcagtgagccgagatcgtgccactgcactccagcctgggagacagagcgagactccgtctcaaaaaaaaaaaaaaaaaaaaattgtcttggtatttattattgttgaaaatcgcttgatcacagatgtatgtatgagtttatttctgtactgtcaattccattttattgatgtatgtgtctattcttatgctattaccacactttcttgattactatagctttgtggtgaggtgttgagattttaaactaattataagcatcttacatgaactacttaccgtttatatttgattatgcagcatgaaataattatgaatatatcattaaatatgccatattaacttttattaagttttatgtgatcataacagtaagccatatgcatgtaagttcagttttcatagatcattgcttatgtagtttaggtttttgcttatgcagcatccaaaaacaattaggaaactattgcttgtaattcacctgccattactttttaaatggctcttaagggcagttgtgagattatcttttcatggctatttgccttttgagtattctttctacaaaaggaagtaaattaaattgttctttctttctttataatttatagattttgcatgctgaaacttctcaaccagaagaaagggccttcacagtgtcctttatgtaagaatgatataaccaaaaggtatataatttggtaatgatgctaggttggaagcaaccacagtaggaaaaagtagaaattatttaataacatagcgttcctataaaaccattcatcagaaaaatttataaaagagtttttagcacacagtaaattatttccaaagttattttcctgaaagttttatgggacatctgccttatacaggtattagaaacttactgcctttctctaatgcttctagtgtaaaaacttgcagacttatgtaaagtagggctgtatcgccgtgcccccattgtctgttaatcttgtttttatatttttgattgtgtttccttttctttttttttttttttttaagacagggtcctgctctgtcactgaggctggagtgcagtggcgtgatctcggctcactgtagcctctgtctcccagcctcttcctgccttagcctcccaaatagctgggactacaggcacacgctaccatgcccggccaatttttgtattttttgtagagatgaggttttaccatgttgcccaggctggtaactcctgagctcaggtgatctgcccacctcggcctcccaaagtgctggggttcacaggtgtgtgtttatttctatctaattatttacacaaacacaatgtatttatatattgtgtatctcttctgctacaatgtaaattctatgagagtagtaattttgtctgtctcaacactgtttttcctaagtttggtacatagtaggcactcagatgcttaaaggaatgaatgaattgtgctttaattccactttactaaacccaaatctccctttggacattgttatctatgtgttttcaaagaagtataatcataatttgacagaaatccttgagaggcagaactaagtgagggattgggcagggttcagatgttaagaacagtaagctcagcagggtgtgattgctcatgcctataaccctagcactctaggaggctgaggtgggatgattgcttgaggccaggagtttgaaatcagcctgggcaacatagtgagaccccatcactaccaacaaaataaataaataaatgtacatggtggcatatgcccatagtcctagctacttgggaggctatagtgggaggatagcttgagtacagaagtctgaggctgcagtgagctatgattgtggcactgcatgctagcctgggcaatagagcaagaccctgtctctaaattaaacaaaaaaaaaagtactctagttttctatgcaatgcattatatctgctgtggatttagggcagtattatatcagataattttaggcatttggtaggcttaaatgaatgacaaaaagttactaaatcactgccgtcacacggtttatacagatgtcaatgatgtattgattatagaggttttctactgttgctgcatcttatttttatttgtttacatgtcttttcttattttagtgtccttaaaaggttgataatcacttgctgagtgtgtttctcaaacaatttaatttcaggagcctacaagaaagtacgagatttagtcaacttgttgaagagctattgaaaatcatttgtgcttttcagcttgacacaggtttggagtgtaagtgttgaatatcccaagaatgacactcaagtgctgtccatgaaaactcaggaagtttgcacaattactttctatgacgtggtgataagaccttttagtctaggttaattttagttctgtatctgtaatctatttttaaaaaattactcccactggtctcacaccttattttatcaatcgtaaggtgcacatttttcacatcttaacatctctgaaattgggaacattttactattgagggtgtgtcatttgtttaatttgtgtgctttctttcttagtgatacagaaaataatagtgcaacttacattgttggtgtcttagctttagtgaaatacagtattgataggcaaatttcttagtgttaaggtagaaaacaaggactctaaataactttgatggtctgtgtatttgtttttgtttcctaggagtaaaatttccagttgattttttaaaatttgatttttaaaaaaaatcacaggtaaccttaatgcattgtcttaacacaacaaagagcatacatagggtttctcttggtttctttgattataattcatacatttttctctaactgcaaacataatgttttcccttgtattttacagatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggtaaaaccatttgttttcttcttcttcttcttcttttttctttttttttttgagatggagtcttgctctgtggcccaggctagaagcagtcctcctgccttagcccccttagtagctgggattacaggcacgcgccaccatgccaggctaatttttgtatttttagtagagacggggtttcatcatgttggccaggctggtctcgaactcctaacctcaggtgatccacccacctcggctccccaaattgctgggattacaggtgtgagccactgtgcccggccggtaaaaccattttcatttattctggcaacatctctttattgagcattgtgaatatgttagtgaatgtgctagatgctcatagatttatataaaaagttagtgaagaaggaaagatggtatattaagtggttagacaagtgttctaatcagttagagttcagagaaggtcagggtacctgatataatcaagagagagaccttacagccaggtgaggtgaatgtacctataatcccagctacttaggaggctgaaatgggaggatcacttgagtccaggtttgagaccagcccaggcaacatagcaagatccccatcagatacaccaaaaagacagatttcttttttttttttttttttgagacagagtctcgctctgtcgcccaggctggagcgcagtgacacgatgtcagctcactgcaacctccgcctcccaggttcaagtgattctcctgcctcagcctcctgagtagttgggactacaggggtacgacaccagacctggctaatttttgtaattttagtagagtcggggtttcaccatattggtcaggctggtctcgaactcctgacctcaggtgatccaccctccttggcctcccagagtgctgggattacaggcgtgagccaccaagcccggccaaaaaagagagctcttataggcccttccttgctttggagctttatctgctctgtgatgcttatctaaaatagccataaggtcactgatatttttaagcatttggaaattacttcagctgggtgccatggctcatgcctataatcccaaccctttgggaggctgaggtaggaggtcctttgagcccagcttgggcaacacagtgagacactgtctctgcaattaaaaaaaaaaaaaaagtagctgggtgccgtggctcacgcctgtaattccagcactaggaggcttgaggattgcctgagctcaggagttcaagaccagtttgggcaacatagcaagtccttgtctatattaaaagtttttttaaattatctgggcatggtggtgtgtgcctgtagtcccagctacttgggaagctgagacagaaggatcacttgagtccaggagatgtagactacagtgagctatgatcactccactgcacttcagcgtgggcggcaaagcaagatctagttgcaaaaaaaaaaagaactggctgggtgcggcggctaacacctgcaatcccagcaccttgggaggctgaggccagtggatcatgaggtcaggagattgagaccaccctggccaacatggtgaaacccggtctctactaaaaatacaaaaattagctgggtgtggtggcacgtgcctgtaatcccagctactccagaggctgaggatggagaatcacttgaacctgagaggtcggaggttgcagtgagccgagattgcgccactgcactccagcctgggcgacagagcaagactccgtctcaaaaaaaaaaaaaaaaaaagcttcacgcctgtaatcccagcactttgggaggccgagtcaagtggatcacgaggtgtggagatcaagactatcctggctcacatggtgaaagcccgtctctactaaaaacacagaaaaattagctgagcgtgatggcggactcctgtagtcccagctactcgggaggctgaggcaggagaatagcatgaacccgggaggtggagcttgcagtgagccgagatcccgccactgcgatccagcctgggcgacagagtgagactctgtctcaaaaaaaaaacaaaaaaacttagctgggcgtggtggtatgcacctgtggtcctagctacttgggaggctgaggctggagcattgctttaacatagagagtcaaggctgcagttgagctatgactgtgccactggactccagcgcaggtgactgagaccctatcttttaaaaaaagggaaaattacttgaacttaaaaggtgtaattgttaaagaaaatgtagtgatttgctctgttgttacttatatgtgcatgaatgatggagatcttaaaaagtaatcattctggggctgggcgtagtagcttgcacctgtaatcccagcacttcgggaggctgaggcaggcagataatttgaggtcaggagtttgagaccagcctggccaacatggtgaaacccatctctactaaaaatacaaaaattagctgggtgtggtggcacgtacctgtaatcccagctactcgggaggcggaggcacaagaattgcttgaacctaggacgcggaggttgcagcgagccaagatcgcgccactgcactccagcctgggccgtagagtgagactctgtctcaaaaaagaaaaaaaagtaattgttctagctgggcgcagtggctcttgcctgtaatcccagcactttgggaggccaaggcgggtggatctcgagtcctagagttcaagaccagcctaggcaatgtggtgaaaccccatcgctacaaaaaatacaaaaattagccaggcatggtggcgtgcgcatgtagtcccagctccttgggaggctgaggtgggaggatcacttgaacccaggagacagaggttgcagtgaaccgagatcacgccaccacgctccagcctgggcaacagaacaagactctgtctaaaaaaatacaaataaaataaaagtagttctcacagtaccagcattcatttttcaaaagatatagagctaaaaaggaaggaaaaaaaaagtaatgttgggcttttaaatactcgttcctatactaaatgttcttaggagtgctggggttttattgtcatcatttatcctttttaaaaatgttattggccaggcacggtggctcatggctgtaatcccagcactttgggaggccgaggcaggcagatcacctgaggtcaggagtgtgagaccagcctggccaacatggcgaaacctgtctctactaaaaatacaaaaattaactaggcgtggtggtgtacgcctgtagtcccagctactcgggaggctgaggcaggagaatcaactgaaccagggaggtggaggttgcagtgtgccgagatcacgccactgcactctagcctggcaacagagcaagattctgtctcaaaaaaaaaaaacatatatacacatatatcccaaagtgctgggattacatatatatatatatatatatatatatatatatatatgttatatatatgttatatatatatataatatatatatatgttatatatatgttatatcatatctatatatatatatatgtaatatatatgttatatatatattacatatatatatgttatatatatgttatatatatatgttatatatatgttatatatatatgttatatatatatatatacacacacacacatatatatgtatatatatatacacacacacacacaaattagccaggcatagttgcacacgcttgtagacccagctactcaggaggctgaggcaggagaatctcttgaacttaggaggcggaggttgcagtgagctgagattgcgccactgcactccagcctgggtgacagagcaggactctgtacaccccccaaaacaaaaaaaaaagttatcagatgtgattggaatgtatatcaagtatcagcttcaaaatatgctatattaatacttcaaaaattacacaaataatacataatcaggtttgaaaaatttaagacaacagaaaaaaaaattcaaatcacacatatcccacacattttattattactactactattattttgtagagactgggtctcactctgttgcttatgctggtcttgaactcctggcctcaagcagtcctgctccagcctcccaaagtgctgggattataggcatgagctaccgctcccagccccagacattttagtgtgtaaattcctgggcattttttccaggcatcatacatgttagctgactgatgatggtcaatttattttgtccatggtgtcaagtttctcttcaggaggaaaagcacagaactggccaacaattgcttgactgttctttaccatactgtttagcaggaaaccagtctcagtgtccaactctctaaccttggaactgtgagaactctgaggacaaagcagcggatacaacctcaaaagacgtctgtctacattgaattgggtaagggtctcaggttttttaagtatttaataataattgctggattccttatcttatagttttgccaaaaatcttggtcataatttgtatttgtggtaggcagctttgggaagtgaattttatgagccctatggtgagttataaaaaatgtaaaagacgcagttcccaccttgaagaatcttactttaaaaagggagcaaaagaggccaggcatggtggctcacacctgtaatcccagcactttgggaggccaaagtgggtggatcacctgaggtcgggagttcgagaccagcctagccaacatggagaaactctgtctgtaccaaaaaataaaaaattagccaggtgtggtggcacataactgtaatcccagctactcgggaggctgaggcaggagaatcacttgaacccgggaggtggaggttgcggtgaaccgagatcgcaccattgcactccagcctgggcaaaaatagcgaaactccatctaaaaaaaaaaaagagagcaaaagaaagaatatctggttttaaatatgtgtaaatatgttttggaaagatggagagtagcaataagaaaaaacatgatggattgctacagtatttagttccaagataaattgtactagatgaggaagccttttaagaagagctgaattgccaggcgcagtggctcacgcctgtaatcccagcactttgggaggccgaggtgggcggatcacctgaggtcgggagttcaagaccagcctgaccaacatggagaaaccccatctctactaaaaaaaaaaaaaaaaaaattagccggggtggtggcttatgcctgtaatcccagctactcaggaggctgaggcaggagaatcgcttgaacccaggaggcagaggttgcagtgagccaagatcgcaccattgcactccagcctaggcaacaagagtgaaactccatctcaaaaaaaaaaaaaaagagctgaatcttggctgggcaggatggctcgtgcctgtaatcctaacgctttggaagaccgaggcagaaggattggttgagtccacgagtttaagaccagcctggccaacataggggaaccctgtctctatttttaaaataataatacatttttggccggtgcggtggctcatgcctgtaatcccaatactttgggaggctgaggcaggtagatcacctgaggtcagagttcgagaccagcctggataacctggtgaaacccctctttactaaaaatacaaaaaaaaaaaaaaattagctgggtgtggtagcacatgcttgtaatcccagctacttgggaggctgaggcaggagaatcgcttgaaccagggaggcggaggttacaatgagccaacactacaccactgcactccagcctgggcaatagagtgagactgcatctcaaaaaaataataatttttaaaaataataaatttttttaagcttataaaaagaaaagttgaggccagcatagtagctcacatctgtaatctcagcagtggcagaggattgcttgaagccaggagtttgagaccagcctgggcaacatagcaagacctcatctctacaaaaaaatttcttttttaaattagctgggtgtggtggtgtgcatctgtagtcccagctactcaggaggcagaggtgagtggatacattgaacccaggagtttgaggctgtagtgagctatgatcatgccactgcactccaacctgggtgacagagcaagacctccaaaaaaaaaaaaaaaagagctgctgagctcagaattcaaactgggctctcaaattggattttcttttagaatatatttataattaaaaaggatagccatcttttgagctcccaggcaccaccatctatttatcataacacttactgttttccccccttatgatcataaattcctagacaacaggcattgtaaaaatagttatagtagttgatatttaggagcacttaactatattccaggcactattgtgcttttcttgtataactcattagatgcttgtcagacctctgagattgttcctattatacttattttacagatgagaaaattaaggcacagagaagttatgaaatttttccaaggtattaaacctagtaagtggctgagccatgattcaaacctaggaagttagatgtcagagcctgtgctttttttttgtttttgtttttgttttcagtagaaacgggggtctcactttgttggccaggctggtcttgaactcctaacctcaaataatccacccatctcggcctcctcaagtgctgggattacaggtgagagccactgtgcctggcgaagcccatgcctttaaccacttctctgtattacatactagcttaactagcattgtacctgccacagtagatgctcagtaaatatttctagttgaatatctgtttttcaacaagtacatttttttaacccttttaattaagaaaacttttattgatttattttttggggggaaattttttaggatctgattcttctgaagataccgttaataaggcaacttattgcaggtgagtcaaagagaacctttgtctatgaagctggtattttcctatttagttaatattaaggattgatgtttctctctttttaaaaatattttaacttttattttaggttcagggatgtatgtgcagtttgttatataggtaaacacacgacttgggatttggtgtatagatttttttcatcatccgggtactaagcataccccacagttttttgtttgctttctttctgaatttctccctcttcccaccttcctccctcaagtaggctggtgtttctccagactagaatcatggtattggaagaaaccttagagatcatctagtttagttctctcattttatagtggaggaaataccctttttgtttgttggatttagttattagcactgtccaaaggaatttaggataacagtagaactctgcacatgcttgcttctagcagattgttctctaagttcctcatatacagtaatattgacacagcagtaattgtgactgatgaaaatgttcaaggacttcattttcaactctttctttcctctgttccttatttccacatatctctcaagctttgtctgtatgttatataataaactacaagcaaccccaactatgttacctaccttccttaggaattattgcttgacccaggttttttttttttttttttggagacggggtcttgccctgttgccaggatggagtgtagtggcgccatctcggctcactgcaatctccaactccctggttcaagcgattctcctgtctcaatctcacgagtagctgggactacaggtatacaccaccacgcccggttaattgaccattccatttctttctttctctcttttttttttttttttttgagacagagtcttgctctgttgcccaggctggagtacagaggtgtgatctcacctctccgcaacgtctgcctcccaggttgaagccatactcctgcctcagcctctctagtagctgggactacaggcgcgcgccaccacacccggctaatttttgtatttttagtagagatggggtttcaccatgttggccaggctggtcttgaactcatgacctcaagtggtccacccgcctcagcctcccaaagtgctggaattacaggcttgagccaccgtgcccagcaaccatttcatttcaactagaagtttctaaaggagagagcagctttcactaactaaataagattggtcagctttctgtaatcgaaagagctaaaatgtttgatcttggtcatttgacagttctgcatacatgtaactagtgtttcttattaggactctgtcttttccctatagtgtgggagatcaagaattgttacaaatcacccctcaaggaaccagggatgaaatcagtttggattctgcaaaaaagggtaatggcaaagtttgccaacttaacaggcactgaaaagagagtgggtagatacagtactgtaattagattattctgaagaccatttgggacctttacaacccacaaaatctcttggcagagttagagtatcattctctgtcaaatgtcgtggtatggtctgatagatttaaatggtactagactaatgtacctataataagaccttctgtaactgattgttgccctttcgtttttttttttgtttgtttgtttgtttttttttgagatggggtctcactctgttgcccaggctggagtgcagtgatgcaatcttggctcactgcaacctccacctccaaggctcaagctatcctcccacttcagcctcctgagtagctgggactacaggcgcatgccaccacacccggttaattttttgtggttttatagagatggggtttcaccatgttaccgaggctggtctcaaactcctggactcaagcagtctgcccacttcagcctcccaaagtgctgcagttacaggcttgagccactgtgcctggcctgccctttacttttaattggtgtatttgtgtttcatcttttacctactggtttttaaatatagggagtggtaagtctgtagatagaacagagtattaagtagacttaatggccagtaatctttagagtacatcagaaccagttttctgatggccaatctgcttttaattcactcttagacgttagagaaataggtgtggtttctgcatagggaaaattctgaaattaaaaatttaatggatcctaagtggaaataatctaggtaaataggaattaaatgaaagagtatgagctacatcttcagtatacttggtagtttatgaggttagtttctctaatatagccagttggttgatttccacctccaaggtgtatgaagtatgtatttttttaatgacaattcagtttttgagtaccttgttatttttgtatattttcagctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctctgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtggtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtattggaaccaggtttttgtgtttgccccagtctatttatagaagtgagctaaatgtttatgcttttggggagcacattttacaaatttccaagtatagttaaaggaactgcttcttaaacttgaaacatgttcctcctaaggtgcttttcatagaaaaaagtccttcacacagctaggacgtcatctttgactgaatgagctttaacatcctaattactggtggacttacttctggtttcattttataaaagcaaatcccggtgtcccaaagcaaggaatttaatcattttgtgtgacatgaaagtaaatccagtcctgccaatgagaagaaaaagacacagcaagttgcagcgtttatagtctgcttttacatctgaacctctgtttttgttatttaaggtgaagcagcatctgggtgtgagagtgaaacaagcgtctctgaagactgctcagggctatcctctcagagtgacattttaaccactcaggtaaaaagcgtgtgtgtgtgtgcacatgcgtgtgtgtggtgtcctttgcattcagtagtatgtatcccacattcttaggtttgctgacatcatctctttgaattaatggcacaattgtttgtggttcattgtctccttaaattagactgtaagcaccttgatggaactcatactaccttttatttcacacacacgcacacgcgcacacacagcctacacatacactgcctagctcattgtagcatactaaatactgattttaatgaataagctaaaccttcgaaacccatttgctaatcccagcactttgggaggccaaggtgggtggatcacctcaggtcagaagtttgagaccagcctggccaacatggtgaaaccccacatctactaaaaatacaaaaattagctgggcgtggtggccaatgccttgtaatcccagctattctggaggctgagacaggagaatcgcctgaacctgggaggcggaggttgcactgagctgggattgtaccactgcactccagcctgggtgacaaagtgagactccatctcaaaaacaaacaaacaaaaacacatcatttcccctatagcaaaaacatgacggcacttactgtatcaagagaggtgagaaaaaggagccacagcaggatgattcaagggactctgcatagctccattttaagaatatgcctactgcaggtcagagaaggtaagcaaactgcctaaggccacacagccaggtacagaactctcaccaatattattgccagcaatcgcaattttggtgtttattcttggtaccaagttggagactatagggttctcttcctaatagagaccatctagcctttcactgttttgtggatacttctttctcttcttctttttttttttcccttttaaaatctagttatttttttctttttggtttctttgacacagggtctcttactctgttacccaggctggaatggagtagtgcagtcatggttcactgtagctttgacttcctgggctcaagcgatcctcctacctcagcttcccgagtagctgggaccacaggcgcccaccaacacctccagctaatttttaagtttttactagagacaacatctcactatgttgcccaggctggtctcaaaatcctgggctcaagtgatcccacctcagcctcccaaaatgctgggattacaggtgtgtgcaaccacgcctggcctattttttttttaattgctcataaatcatcttttttctttaaaaaaaagaaagatgggaggctaaagcaggagaatcacttgaacccaggaggcggaggttgcagtgagctgagatcatgctgctgctctccagcctgggcaacaagagtgaaactccatctcaaaaaaaaaaaaagaagaaagtacacaattttactttctggacctaatggtcaaggccaataatttggtcacctatgaagtaaataaaagctttaccatatatatgaccatttgataatgtaatatgaaatgtttatgtactaaaggcagaatagtctagaaaaaacattctgtatcacaacgtctaaaaattaatatcatcttcatcatagaaccaggctctttctcctaatttttttttttgagatggagttttgctctgtcacccaggctggaatgcagtggcacaattttggctcactgcaaccttcagctcccaggttcaggatcaagtgattttcgtgcttcagccttctaagtagctgggattacaggtgactgccaccacacccagctcatttttttgtatttttttagtagagagagggtttcaccatgttggccaggctcgtctcgaactcctgacctcaaataatccacccgtctcagcctcccaaagtgctgagattacaggcgtgagccaccaggcctggcctcctaatttttatttgtagaagtggcaccaaaattttccaagttctcatgcaaaaattcaggctcatctcagtttatttttttcatttatttatctcccactaaattgacaacttctaataattaggttggttctttgtattcccagcacagggttctatgcagaatacacacacagcagttgctggcaataatattggtgagagttctgtactgggctatgtgatcttagacagtttgcttatgttctctgacctgccgtaggcacattcttaaaatgaagctgttcagaccccctcgattcatcctgctgtggcttctttttcccacctaaatcttaaatacccttttagctgctagtaagtgaatgatgtttttttatgaactttctgaagtcagattagatgaagttgagaaaagcctgatattcttataaagttatatatgtgcatcatagaaaacttagaaaatacagataaacaaaaatcatccatggacgaaccttgaagacattgtgttaactgaaataaaccggacaccaaaggacacatgttatatgcttccacttatatgagatacctagaatagttacatttggttactctgggtacattgcctatagataagccttgctccacaaggagcagttaaaaaaaaaaaaaagataaattcataggatggaaggtagaatagtggttactagggacttggggagggggaaatggggagttactgtttgatgagtgcagatttcagtttgggatgatgaaaaagttctggagatagatagtggcaatggtaacacaacagtgtgaaaataatgccactgaactgtacacttaaaatgattaaaatgataagttaattgtaatttgtgttatccagaaatggttagcaatttattggtgtatattcttttagtattcctgtgtgtgcacaggggtgcttgtatatactttatctttaaaatatatccaggaagctaggcacagtggcttacacctgtaatcccagcactttgggagggtgaggcaggaagattgcctgagccccggaggtcaaggctgcagtgagttgtgatcacgctactgcactctgttctgggcaacccctgtctgggaaaaaaaaaaaaattagtgaggcttagtggtgcacacctgtagtctcagctacttgagtggctggggtaggattgcttgatcccagcaagttgaggccgtggtgagccatgatggtgccactgcactccatcctgggtgatatggtgagaccctgtctcaaaaacaagaaatccagataattctgtgcattataatctagcttttactggatcattaaaattcttttttctttttttttttttttttctgagatggagtttcactcttgttgcccaggctggagtgcagtggtgtgaccttggctcaccgcatcctctgcctcccgggttcatgcgattctcctgcctcagcctcccgagtagctgggattacaggcatgtgccaccatgcccagctaactttgtatttttagtagagacagggtttctccatgttgaccaggctggtctcaaactcctggcctcaagtgatccacccacctcggcctcccaaagtgctggggttacaggcgtgagccaccgcactcagcctgggtcgttaaaattcttaagtgacttcatttttaattactatatgggattctatctttccagtgtatcatgatttatttgacctattgctgaatgttggaggtttcagggtaagaggcacagtttgctattatgtacatcactatagtggcatcctgatagctaaatatttgcctacatccctgattatttccttagtctaaattactgggactaggattttggtgtttgatacatgttactaaattgttttttagaaagattaaaccagtttatgctcttccagcccctgtggtatatgatagttcccattttcctgtaccttgccaacactgggtgatatccagttttaaaatctaaatcttgcattgctatgagaactacaattagagaaggcttatcttctactgcccattctctgtacagagcaaatccctctagacctgaagccccttggagttgtcaagaaacctttgagatgactccccactctgtatctgagctgtcaccagtattctccacttcttcaggattgccatggcaactaaattgatgaaaagatttaggaggccttttctctctttgcaattcctatgatcctttttgaatgtgggtttgggactctgtcaatatacccatcatctaattctgtccattgtgttttaaagtttaaggttgcaatttctgattacatctgccttagccatactgtattatatttgacattcaatatacaatgtccttgtttttctgtatttctaatcttattcccagagatgtgtctatttgttcaggattcattttgcaacgtgtttttactaagcatctacccaaaaccgttgaagtcagatttcaggctgtcttacgtctaaagtagcacaggcaggaaaaactattgaagtgggatttttttttccctttttgtactgaaccgagaaaaagtatatagatgatagagaattcctaatttggtatcattgatatctgggtttttgtttgtttttacagaagactgattaactatacttatttattaatttatcttctcattaataaacacttgctgagtgcttactgtctgctaggcattagggagacaaatatgattaagggaagcttcctcctatcaaggtcatgtgttccatttgggtatactaatgcattagcaatgtaaatcaagtagtgagagatcatctgttcccgataggagatggattattggtggggacttctgtgtgtgtgtgtgtgtgtgtgtgtgtgtgtgtgtgtgtgtgtgtatgtatgtgataaaataaatataggaaatgttaattatagattctaagtagtagatatataaacactcattgcaaagttgcttcaagttttctgtatatttgaaaatattcacaacatgtcgacaaaactagcatgataaagccactatttgtgctaagacttcagcttgtatctggattaggcttattatgtagtagtaggaacattagaaatagttttaactcattaaatacacatgttttatgggaaggttttatatatatatttatatgtaatgaatgtgaacaaacaagggtcagatatacactctgcttccctccagaccagttccggctgctctgctgcacatttcaggagtcttattagaattagccacattctgcccacttgcccttacttctcatatttcacaactcctcctggtggggacttaaggagacattcaaactaggccttgaaagatgagaatttttccaagtggaaaaagaggagtggcagcaagtaaggtaaaggtacagagtcatggaattcccaggaaacgtaaagttgtcatgtgttataggaaaacaacttgtgtgaggggtgttgggagaaatgagagataataccagggtataaagggccttttgaatgctatgttgaggaattttatcctaatggcagtaatgactaacaattatatagtgttcaaaaagtataaatcagcagtggtataccactaagggtttttttcttttctttttttttttgagacagagttttgctctgttgcccaggctggagtgccgtggcacgatctcagctcactgcacttccgccacctgggttcaagtgattcttctgcctcagccagtgtttcactgtgatggccaggatggagcactaagggtctttatggaagaaaaagacatgataaacaaggcttttagggaacttctacagtaatgtagctgtattaaaagtagagatcagagcagcatagtagaagtagaaggctagagctaattgaaggagcacttcagaattagaatcaagaagtcttagaaacctattggttttattctccctaatgtatttggccacttacctgctggggaatttgtctaagttataaaaaataattcctttgggaaacccaaaggaaagttatctattaataattaccccactactttttctgatttatgtaatggccacgtagaggttagatgtgatggttgtgacagtagtgactaatacagcctgtgaagcattttggtcagatatctatgtgctttcattccaggttgactgaggcaagactttggctagggtttgatcagtgatgtaactactcacgagtaccacgtggtggcaatggcattgctgcagaccttggcagcaaagcagtgttagagtagcagtagaaacctttgtgaagctaggaatacattttctggtcataaaaacctcctgaaaattgtgaactcagtgtagcaggagaaagaagatggcttgtttttagtaaagggcaaagtcatttttaaggatcagaagaagaaacggagagtgaaacaatgtgttcctgccctactcccccactggactttttggcaaccattgctgttccttctaaaagtgatttttaaacatgtatattttgaagccaggcacagtgactcacgtctgtaatcccagcactttgggaggccgaggcgggcagatcacctgaggtcaggagttcaagaccagcctggccaacatggtgaaaccccgtctctactaaaaatacaaaaattaggccaggtgtggtggctcacgcctgtaatcccagcactttgggaggccgaggcgggaggatcatgtggtcaggagatccagaccatcctggctaacacggtgaaacaccatttctactaaaaatacaaaaaattagctgggcatggtggcgggcgcctgtaatcccagctactcaggaggctgaagcagaagaatggcttgaacctgggaggcggagcttgcagtgaaccaagattgcgccactgcactccagcctgggcaacaaagtgagactccgtctcaaaaaaaaaaaaaaaaattagtcgggcatggtaacaggtgcctgtaatcccagctacttgagaggctgaggcagggagaattgcttgaaccaggtaggcggaggttgcagtgagccaagatcgcaccactgcactccagcctggggcaacagagcaagactgtctcaaaaaaaataaataaataaaataaattcttaagaaggatattttggaaaactccttacatacctaaattctttgtttatcaaatacttggacttagcacactcttctttgaaatggaccaataaacaacaggagcccataagcaaaaagaactcattattttaaaaacagtaactatccttacaggctttctcagggctctttctgttggatccttccctctcacaggtccttgctaatgatctctaggtggacacattctagatgagatgtccctgtctagaatggcagcaccatgagggctatatcctcagtactaggacagcgcctggtgcttaatagatagtaaatagttgtctaattaactgagcaaacagatagattcatgaattagctttttgctttttctgttagaaactaaaggttcaggtcaggcacaatggcgcatgtctctaatcccagcactttgggaggccgaggcgggctgatcacttgaggtcaggagttcaagaccagcctggccaacatagtaaaaccctgtttctacaaaaattaccaaaattagccgggcgtcttggcaagcacctgtaatgccagctacttgagaggctgaggtgggagaatcgcttgaacctgggaggaagaggttgcagtgagccgagatggtgccaacctgggtgacagagggagacttaaaaaaaaaaagaaagaaagaaagaaaagaaactaaaggttcaaagaatcccagaaaaggaagagtcctcacaagccagtaatctaggcaggattactgatagtatttttatatttgttgtatttttataaaatgccatagatagagggcttttttcaacattacatcagtctaaaaatcacacatttttatatgaactaacctaaatgtctgatgaatctcacaacaccaagtctttgaaatgtgcccatataaataaaatgttaacagattcatgctaattttaaatatcgatagtgtttaaatgccttaattattttttcactccctagctttaaaagaaaataaccaacttcaaaaggacatcacaataacatcaagtctatttgggggaatttgaggattttttccctcactaacatcatttggaaataatttcatgggcattaattgcatgaatgtggttagattaaaaggtgttcagctagaacttgtagttccatactaggtgatttcaattcctgtgctaaaattaatttgtatgatatattttcatttaatggaaagcttctcaaagtatttcattttcttggtgccatttatcgtttttgaagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaaggtgtgtattgttggccaaacactgatatcttaagcaaaattctttccttcccctttatctccttctgaagagtaaggacctagctccaacattttatgatccttgctcagcacatgggtaattatggagccttggttcttgtccctgctcacaactaatataccagtcagagggacccaaggcagtcattcatgttgtcatctgagtacctacaacaagtagatgctatggggagcccatggaagatacatggtatacaacatagctcttgctctattggaagctaagtggaatgggagaaattggtgacaggcaaccccataatttcagaaagctatgaaaaagtactcagacatattccttataacactggtgtcacatcacaaagacctatttaatgtgcttctgatttatagggagagacatcctatacttcaggaactgcactttgatccacagaaagcctagtgatgtagagctcctgttagttcaaaaggaaaagaaaagaacaacacagaaagcctaattatgcaatagagtcaagtgctttatagcaatgttacagttatcaaaaaaaatccagatggacctctgagaggatgccattggagtaaccaggcagatgcagttgatcagagctgacttcctataagaagtgagcactgagctgaggaataatggcataaatgaaggaaagtgagatggaaatttgagtttttaattggaaagacaatacatcaggcagatttttaaataggggcaaacaaacagacacataggagatgctaggcatggggtccccactaggatgctgcttagaaacatgcaggggtggtgagtactcccaaagtacacttcattcctagctcagtgattcttatctgagtgttaaagttccttcttcagcaccccgttccacagtccaactgggaactttaagacctttcttggagtctttctaggaactcaagtctgctacttatacagaacagtggctttggtccccagttgtgccttgcagtatttttgtgttcaggaagaaacagtagctcttggataaagaagctagctagaaactctgttgctatggcagtgcttcaaaatgtatttccttaaatgctttctttgtaactatcttcatttagttcatctctcagataatgagagatcagagtcccatccccagtataatactcttctttagggtactttcaccatcttcagtctaaacacagactagactttcaattataatgtgtaagatttaaaatgttattattgtgtgactttgaatatctgtgtaaatctactatctcctctttggtatatacgtgtgtttatttttttctggagatctgtaactgaaatgcttaatttctgaattgttttggatatcacaacttaataccaacataagttttgagcctttttctccctaaatctggtgtgagtctaactgaaactcaaatgaactttttaaaaataattttttcttttctttaattttttttttaagtagagacagggacgcactgttaactaggctggtcttgaactcctgatcttgagccatcctccccgacctgagcctcaccttatagagagggtcttgctctgttgcccaagctggagggcagtggcataatcacagctcactgcagcctctcgacctcctcaagcgatcctcctgccttagcctcccaagtagctgggactataggcgtccaccaccatacccagctaatttttttttttattttttgtagagacaaggtctccctatgttgcccaagttggtctcaaactcctggactcaagcagtcctctcacctcagcctcccaaagtgctggggttacaggtgtgagccatggcacctggccagaacttctagtaaaaagaatattgttgccgggtacggtggctcacgcctgtaaccccagcactttgggaggccaaggcaggcgaatcacctgaggtcgggagctcgagaccagcctgaccaacatggagaaaccacatctctactaaaactacaaaaaattagccgggcgtggtggcacatgcctgtaatcccagctacttgggagctacggtgcctggcctagtttattatttcttaatatctgttgtcttccagtgtcttccttaattcttcacaataccctgtacaatgcttagcacacagtgggcagtctgtaagtttattaaatgtttggtgtggcccatacttcctatccacaaagaatgtaacatgttaagacatctagatgagggaatgatttaagaggaactacaataatattctgaaacttggactctggatctctgcatttagactttcctaaaccagccagcaagtagatcatcatgtcacaaggcttaggttgggcttgctgttcagagaatgaattaaggattaaggagaaaaaaaagcagaaaggttttgctctgtttttcaggttctattgagttgttaacttctaacaagttatcttatttgcttcattgcatgaggcccattgtagtaagaagaggaatttatatgctaaatgttctggtgatagaatgacttttctttttttttacagtccaaaggtcttttttttttttttttaacacctattatgccatgaattcatagggaataggttccagctgctcaggctccttcccattggttctcacaaagtgtgcttctctgggtggagcaggctggtgcttcagttgaacccacgtacctttctctttggcttctttctttttctgatcattttccttcacgcgtttcaggaagctgtcttggctcttagagtgtttaatgtgctcaatacgcacattaattctcttggcaagaatcttgcccttaacttgtttacagcgatgccaacagcatgctgggtcacgttgtagacttttccagttttgccatggtaacacttgtggggcattcctttttgaacagtacccgttcccttgatgtctacaatttcacctttcttacagattcgcatatacatggccaaaggaacaactccatgttttctaaaaggcctagagaacatatatcaggtgcctctcctctttccctttgtgttcgtcattttggcaaattactgaaagatggtggttctggccaaaaggaggaatgactttttaatagctgtgtttgtatctgagccttccctctgcctttcattttttttgttttgttttgttttgtttttgtttgagatgaagtttcacttttgttgcccaggctggagtgcaatggtgtgatttcggctcattacaatgtccgcctcagcctcctgggtagctgggattacaggcacccgccaccacgcccagctaatttttgtatttttagtagagacagggtttcaccatgttggccgggctggtctcaaactcctgacctcaggtgatctgcccacctcggcctctcaaagtgctgggattgtaggcgtgagccacatcacctggccacttttttaactctttccaatggttaattccgtttgatatggttccttggaacttgcacattaccctttatcaattatcaccctgtattgggggtggggaggatgatacctctcttcatagttagatcctacttactttcaacagagttcttaacaatcctagaaactcacaggtccagaaaagacaagcataaaggaaactataaataatgcatttgaagactaactcaggaaatcaatgattatttccccccaggctacccagtgtcttaaaaaaacagtttaattaatacaatcttttgtttcaattttctacctatatttatggcttttagcttttctaataaaagctcaaaatgaattacagtcatcagtgactttttaatgaatagaagacatttgcaatttttcactatttgtttttacttattaaatatttccgccttggccaggcatggtggctcacgcctataatcccagcactgtgagatgccaaggcaggaggatcacttgagtttaagagttctagaccaggctgggtatggtggctcatgcctacaatcccagcactttgtgaggccaaggttggcggatcacccgaggtcaggagtttaagaccagcctggccaacatggtaaaaccccatctctacaaaaaatacaaaaattagccaaggggtggtggtgggcacctataatcccatctttttgggaggctaaggcaggagaatcgcttgaacctggaggcagaggttgcagtgagccgagatcatgccactgtattccagcctgggtaacagagcaagactctgtctcaaaaaaaaaaaaagtttgaaaccagcctggtcaacacagcaagacacccatctcgttgaaaaataacggtcgggcgcagtggctcacgcctgtaatcccatcactttgggaggccgaggcaggcagatcacctgaggtcgggagttcgagaccagcgtgaccaacatggagaaaccccatctctactaaaaatacaaaattagttgggcgtggtggtgcatacctgtaatcccaactacttgggaggctgaggcaggagaatagcttgaacctgggaggcagagaggttgtggtgagccaagatcacgccattgcactgcagcctgggcaacaagagcaaaactccatctcaaaaaaaataaataaataaaaataaataaataagtacttctgcctttaagccacttcctagaaggcagtggcacaaagtgatacatttggaggagtaaatatattacaaaatgaattaggctgggcgcagtggctcatgtctgtaatccccgcactttgggaggccaaggcgggtggatcacttgaggtcaggagttcgagactagcctgatcaacagggtaaaatcccatctctactaaaaataccaaaaaaactagctgggcgtggtggcaggcacctgtaatgtcagctactaggaaggctgaggcaggagaatcgcttgaacccaggaggtggaggttgcagtgagccaagattgcaccattgcacttcagcttgggcgacagagtgagactccgtctcaaaaaaaaaaaaaagaactaacatgccagaactttgccttcagtatgttttgtgatttttcccttcttgtgccatttcatcattagttccatgtattatttaagatttcttatcaaccagcaccttgggatttttttgtgtatgtgttggtttagggggtttatttgtttttttcttttttttcggtaattgaaaatgtgaagcaaaatgtcacctgttttttctttcatgtctgacactcatgtcttgtttacccccgacatgcagaagctgaaatccccatttcatacagtcttcaatgtggaggcagtagggatggagaaaataatgtactttgtgctctccggtactctttctttcctattgtctgaggggatttgggcataatttattttgctgcagagataaaaatttgttatatatattttttatcattcagggccaaggaatatagattttttttttcagccttgtctcagctgggtgtctttatttactctgtcttaaagtgttccttttattatcattattattttttaatcattgaattccatttggtgctagcatctgtctgttgcattgcttgtgtttataaaattctgcctgatatacttgtttaaaaaccaatttgtgtatcatagattgatgcttttgaaaaaaatcagtattctaacctgaattatcactatcagaacaaagcagtaaagtagatttgttttctcattccatttaaagcagtattaacttcacagaaaagtagtgaataccctataagccagaatccagaaggcctttctgctgacaagtttgaggtgtctgcagatagttctaccagtaaaaataaagaaccaggagtggaaaggtaagaaacatcaatgtaaagatgctgtggtatctgacatctttatttatattgaactctgattgttaatttttttcaccatactttctccagttttttgcatacaggcatttatacacttttattgctctaggatacttcttttgtttaatcctatataggttttttgaacctataacataagctacaacatgagaaatgtgcggttagatagatatgtcccttctgaaggtcagaaaaaaatataatggaggtaaaacctgaacaagcttggaaactgatggtagacttcttcaaggcagcccttgccctaattaaaattcttgtctttctagaaaaagtctagctgttgatttaccacagaaaataataataataattactattattattattttttgagacagggtcgccctgtgtcacctagattgcagtggtgcagtcatggctcactgcatcctccgtttttcaggctcaagcaatcctcccaccttagcctcctgagtagctgggtccacaagcatgcgccacccacacccactaagtttttgtatttttggtagagatggagttttaccttgttgcccaggctggtctcaaattcctggactcaagtagtccgcccgccttgccctcccaaagccagaaaacatttagaatatctttcagagatgtgtatttacaccactattaacacagggctgtatagcagtccagtactggactatgtagtccagtactattcttttccttactggagggccaggcgtggtggcaggtgcctgtaatcccagctactcaggaggctgaggcaggagaattgcttgaacctgggaggcagaggttgcagtgagctgggaccgtgccattgcactccagcctgggcgacagagcaagactccgtctcaaaacaaaaaaaaaaagagagagagagcagtaattcaggtctcacccatcttcaatccagggggcctagccttagtatttgacccatagtaagcacccaataattgtttaaattaattaacctctgaggccctttaaatctgttgataagtatcttattttgcaaagtcctaagcacttggaagagcagaggaactatttactgggtgtgtatgcttttctaacaatattttatagctggcttttgtttttagaatgaatttgaacattgaaaaggcaggcaatagggatgattctgtgaattctgctaaaactgagtagaaagaatgagtgtagagatgtcgacattgatcaactttctatcttcataagagatctgattctaacatatccatttagactcaagtagaatattgtgtatagagtgagtggcagtgagtaatttggtaaaaatttgctgacctgcttttattctttcctcctttctttcttcctttccttccttccttccttccgtcctttcctttcctttccctcccttccttccttctttccttctttctttcctttctttcctttcttcctttctttccttcctcccttccttttcttttctttctttcctttccttttctttcctttctttcctttcctttctttcttgacagagtcttgctctgtcactcaggctggagtgcagtggcgtgatctcggctcactgcaacctctgtctcccaggttcaagcaattttcctgcctcagcctcccgagtagctgagattacaggcgccagccaccacacccagctactgacctgcttttaaacagctgggagatatggtgcctcagaccaacccaaccccatgttatatgtcaaccctgacatattggcaggcaacatgaatccagacttctaggctgtcatgcgggctcttttttgccagtcatttctgatctctctgacatgagctgtttcatttatgctttggctgcccagcaagtatgatttgtcctttcacaattggtggcgatggttttctccttccatttatctttctaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctaggtaatatttcatctgctgtattggaacaaacactttgattttactctgaatcctacataaagatattctggttaaccaacttttagatgtactagtctatcatggacacttttgttatacttaattaagcccactttagaaaaatagctcaagtgttaatcaaggtttacttgaaaattattgaaactgttaatccatctatattttaattaatggtttaactaatgattttgaggatgagggagtcttggtgtactctaaatgtattatttcaggccaggcatagtggctcacgcctgtaatcccagtactccaggaggccgaggcaggtggatcagctgaggtcaggagttcaagacctgtctggccaacatggtgaaaccctgtctctactaaaaatacaaaaaaattaactgggtgtgctagtgcatgcccgtaatcctagctactctggaggctgaggcagcagaatcacttgaacccgggaggcggaggttgcggtgagccaggatcacaccactgcactccagtctgggtgacagagcaagactccatctcaaaaaataaatatatatatatatacacacatatattttatttcaactgttagacaagagtccaaaggccaaagaataaagttttaggccagtcctttattagaaaatgagtcaaatcccaaagcaagttttttttatgagttaatgaatataaatgactacatattttatgccttaaaaatcacttttaatgaatggtgttttatggcttgtaaatcagagttttaatcagtaaagaaagtttttaatcctcaaaaacacgttatcataaaagacactgtttggcatcaaatgtggtatttggccatgttcattagggtcattttaggaatctcatacattctacttagctatgcttaattcctgataccatggcattttctgaaatgtttcaaggatgacatctctgctgtttttaatttggtaatgatatctgctgatttattaagtgaaaaaagtaatggtgtcattaccttggatgaagaaacaaaaataaagcatttgccacatttttcaactttgttttcctttcttacaaaattgctataagctcattgcccccaaattggacaatatagggaataaaaaagataatttggggtggggttagacacgggtcttgttatgttgccgaggctggtctctaactcctggcctcatgcaatcttcctaccttggcctcccaaagtgctgggattataggtgtgagccacttcaccaagctgagatgccacctcttaaaagagagaataaggacagattacagccactgctcatgcctgtaatgtcagtactttgggaggccaaggtgggagaattgctcgaggccaagagttcaagaccagcctgggcaatgtagcgagacctgatctctatgaaaaggggggtgggggggaaaactagctggggccaggcgtggtgggtggcttacgcctgtaatcccagcactttgggaggccgaggcgggcagatcacctgagggcaggagttcaggaccaacctgaccaatatggagaaaccctgtctctactaaaaatacaaaattagccaggcttggtggcttatgcctgtagtcccagctactcgggaggctgaggcaggagaatcgcttgaacctgggaggcagaggtttcagtgagctgagatcgcgccattgcactccagcctgggcaacaagaatgaaactccatctcaaaaaaaaaaaaaatcagctggaaggtggcaaacacctgtggtcccagctactcaggaggctgagacaggaagatcacttgagtccaggaggtcaaggctgcaggtgagccatgtttgtgccactgcactgcagcctggatgacagaccgagacccttctcaaaaaaaaaaatattacccgtactcttttttgagacggagtttcactcttgttgcccaggctggagtgcaatggcgcaatctcggctcagcgcaacctccgcctcctgggttcgagcgattctcctgcttcagcctccccagtagctgggattacaggcatgcaccaccacgcccggctaattttttgtatttttagtagagacagggtttctccatgttggtcagactggtctcgacctcttgacctcaggtgatccgcccaccttggcctcccaaagtgctgggattacaggcctgagccaccgcacccggcctgtactcttattctttaataataaaatatttctgtgtttctttagtcattttacataaacttttatttatttatttatttttatttatttatttttttgagacggagtctcgctctgttgcccaggctggaatgcaatggctcaatctcagctcactgcaagctctgcctcccgggtacacgccattcccctgcctcagcctccctagtagccgggactacaggcgcccgccaccacgcccagctaatttttttttttgtattttcagtagagacagggtttcactgtgttagccaggatggtcttgatctcctgacctcgtgatccacccgtctcggcctcccaaagtgctgggattacaggtgtgagccaccgtgctcggcccataaacttttatttttaaaataatgtcatgataaataatattgcttaggtgtctttaatatattagtaacatttctgttttattgtacatcaacatttatattcaaattaatgggtgaagagtactccattggactaggtatatcgtaatttaatctcctattattggacaactacattgtttctaaaattatactattcctatgactaaacctttgcatatatcttttatctccctaggatatatttctaaaactagcattgttgactgaaagtgtaaatacgtgttaaggtgtttgctacataatgccatatttcctttttaggaaactaagctactttggatttccaccaacactgtattcatgtacccatttttctcttaacctaactttattggtctttttaattcttaacagagaccagaactttgtaattcaacattcatcgttgtgtaaattaaacttctcccattcctttcagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttgtgagtgtatccatatgtatctccctaatgactaagacttaacaacattctggaaagagttttatgtaggtattgtcaattaataacctagaggaagaaatctagaaaacaatcacagttctgtgtaatttaatttcgattactaatttctgaaaatttagatctagataaagctatagtgtggattattttatgtatatttacttgagaaaataattattaaatattagtggaaaagctatactttgggtatgatataggactttcgaattggaattttcctttctatctgtaaaagcaagtaggtatagttttattccccagaaggcatctttttctcccccttgtctcacatgggtgaatttaccagcatatttaactaaattcagactggttccaaatgtactgccagatagtagcatttctctagtgtttgttttcatcctggcttgtaagaatgccctgccacttctgccctgcaatatcccttgctattaggattttggcatcaccttgggtccttaatgccagaaatgggaattgcttcatactgtggaaaaatacccattaaaatattaagaccagtaaaacctcgtttctgcttgggctatttgtggatttcagacatcctgagaagtttaccacccctgtaattaattgtcattgtcatcacttcataataaaaataattgcatggccgggcatggtggctcaagcctgtaatcccagcactttgggaggctgaggtggtcagatcacctaaggtcaggagatcaagaccagcctgaccaacatgaagaaaccccatctttactaaaaatacacaattagccgggcgtggtggcgcatgcctataatcccagctactcaggaggctgaggcaggagaattgcttgaacccgggaggcggaggttgcggtgagccgagattgcaccattgcactccagcctgggcaacaagagcgaaactctgtctcaataataagaagaagaattgcgtgaatatttctttaaaactatgatgagataacataccagattatcaaatggattcagtagtgggtgtgccatttattgcacactgagagatgaccaagtcattctgaaatatctttattaatatatccttcctaggatttttcatcctaacttctccataggtagttacttagcataacatctctgtggccagatgtatcccactactaaaagggcaaagtaagctgtggctgccctggtagatacaatgagtaagtgcacagtgatggctataaatgttttcatctcataatcccatgtccagaccagcaatttgctctgaaagctcttacctgtgtctgtttcaatggctcttgatcacttgcctgcacgtccagaattccttatttattcattgaaaattagcgttctttatccctttgttttgcaagttcagctttttagagatggctaaaatggtctaatctttcttggcaaaggcaattctgagctgcagattagactacaagtggcttgggtacatgttgtctttaaacaagcgaagaggaaaactttgagctctattcagacttggtgaagtgtggtaaatttatgatgaaagctactgactgtattacacatgattaattctgaagcccatattaagatgatcttttcagcagttcagcattgctcttctaactgaacagtttcaaggctgggatttcagcaattaatcagttcagaattgctaatgatcctggcggagggtggtagcaaaagggggaggatgtcattagcttctctagcctgccttttttcagtgccctgtggcagtatggagtgaggcaacatgaaagaaagatggcctgaccttcatggcagtattgtgcaacacgtaaatactggtgtgagtggctgtggctatggctagtaaatgatggcccttggtaaacaaagttatttatcagacaatacctaccagctaggtcaactgtgcccataattgatctggttaatttcttttgctgcctattgatttttatttggttgatagataatagctagaggactctaaatttctttggggaagaacatgaaccccttctaagccttcttacgagagaattgatcgcttttgcactgacctttagtaacatcctgatttcagtgttttgtaactatcagagggttgagtcttggttttaagccatgtatatctgtagcataactttctgtgtaggctagttacctctcagcttataaagtgtaggctgataaatttatagtacagtagagtgtcactatgcaaagaaacgatcttagggaatcgaatgatatctgctattaaagcaaaattaatatatattttttctttttacttttttttttttttaaagacatgaaatctcactgtattgcccaggctggtcttggtctcagactcttgagctcaagcagtcctcccacctcagcttcccaaagtgctgggattataggcatgagctgccgtgtctggcccagtatatattttttaagttttaagttttgtggtacgtagtaggtttataatattattttgaatccttagttgtaattttatgtctgctgatgtgtacataatttttattaaactatttatttgagacttcaggtatcttttttttttttttgagacggagtctcgcactctcgcccaggctagagtgcagtggcgccatctcggcttactgcaagctctgcttcctgggttcacgccattctcctgcctcagcctcctgagtagctgagactacaggtgcccgccaccacgcctggctaattttttgtatttttagtagagacagggtttcaccgtgttagccaggatggtctcgatctcctgaccttgtgatctgcccgcctcagcctcccaaagtgctgagattacaggcgtgagccaccgcgcccagccgagacttcaggtgtcttagaattttttaaatgtaccctttctgagaaaaacagagacttaaagctaggataactggtattctattttttttttttttttttttttttacctccagcctgggtgacagagcaagactctgtctaaaaaaaaaaaaaaaaaaattcactttaaatagttccaggacacgtgtagaacgtgcaggattgctacataggtaaacatatgccatggtggaataactagtattctgagctgtgtgctagaggtaactcatgataatggaatatttgatttaatttcagatgctcgtgtacaagtttgccagaaaacaccacatcactttaactaatctaattactgaagagactactcatgttgttatgaaaacaggtataccaagaacctttacagaataccttgcatctgctgcataaaaccacatgaggcgaggcacggtggcgcatgcctgtaatcgcagcactttgggaggccgaggcgggcagatcacgagattaggagatcgagaccatcctggccagcatggtgaaaccccgtctctactaaaaaataaaaaaattagctgggtgtggtcgcgtgcgcctgtagtcccagctactcgtgaggctgaggcaggagaatcacttgaaccggggagatggaggttgcagtgagccgagatcatgccactgcattccagcctggcgacagagcaaggctccgtctcaaaaaaaaaaaaaaaaaacgtgaaaaaataagaatatttgttgagcatagcatggatgatagtcttctaatagtcaatcaattactttatgaaagacaaataatagttttgctgcttccttacctccttttgttttgggttaagatttggagtgtgggccaggcacggtggctcacacctgtaatctcagcactttgggaggccgaggcgggtggatcacctgaggtcaggagttcgagaccagcctggccaacgtgttgaaaccccgtctctactaaaaatataaaaattaggtgggcgtggtggcaggcacctgtaatcccagctactcaggaggctgaggcagcagaatcgcttgaacccaggaggtggaggttgcagtgacccaagatcgcaccattgcactccagcctggggacaagagcgagattcttgtctcaaaaaaaaaaaaaaaaaaaaaaggtttggagggtggtgagctgagatagtcaactattaactcctatctacctgctgggactacactggtgaggtggagcctaagtcctaaaacaacaagtgaggcagctggacgcggtggctcgcatcagtaatcccagcactttgggagcctgaggcgggcagatcacaaggtcaggagttcgagaccagcctggccaatatggtaaaacccagtctctactaaaaatacataaattggctgggcgtggtggtgtgcgcctgtaatcccagctacttgggaggctgacacagaagaattgcttgaactctggaggctgaggttgcagtcagctgagatcctgccactgcactccagcctggcgacagagtgagactctgtctcaacaacaacaaaagaaagaacaagtgaggcaaaacctggagaccccagcttcatgtaacacctagtttgagtattgttgagagtttttcaggaaaaaagtctgataacagctctgagatagtcttaacatatgaaaaagcaaaaaagggaggagacagatcatttgtcctatacctttctcttttaaggttttaattataacttgtgtaatacaggagacctctgggtgtttttagttgactataaactaaatctgagtacacatttcagggctgctaaaaatgcttatttgaaactgggccgtattaacacaagcagaggctctggagcaagtgaagtacagatccagagccccactgtattctccaatggagtgattgcctgaaagatgatgtcagttttaagcaccgtgcttggtttttaacatggtcactgacaaattggagagtgtttatccagaggtagatggtaaagatacataaaagtaacttgaaatactgtcttttgaagaagaaatgagaagatttaaggaaataagacactgtcttcaagtatctgaagaaccgttacccagaagagaactgttatctggaacaggattaagactcactcatggggctccagaaagcagacgagtgcatggaggacgcagaagatgcagattgtgtggctcaactctaaaatctttctaacaaaattagttctctggatgtgttccagttcacttgatgatgattcttttgtttttgtttttgtttttgaggtgtagtttttcactcttgttgcccaggctgctggagtgcaatggcacgatcttggcttgctgcaacctccccctcccgggttcaagcgattctcctgcctcagcctcccgagtagctgggattacaggaatgcaccaccatacctaattttgtatttttagtagagacagggtttttccatgtcagtcaggctggtcttggactcccgacctcaggtgatccacctacctcggcctcccaaagtgctgggattacaggtgtgagccatcgcgcctagcctatgatgattcttttcacagagatacaggcacttaaggagaggatctaaaccccttggacacattgccgttgaacttctaagatcttaggtttccacttactcatgaaaattataccacagggtcagagggtagtgttcattggagccaggtgccagaacaagttattacaaactactattttagagaaaaatgtcattaaagtttaagataccttaagctataggtttgcatcaaagttaatgaaaggtaaaaagatgccaagcgtggtggctcaggcctgtaatcccagcgctttggggggccaaggcgggcagatcacgaggtcaggagatcgagaccatcctggctaacacggtgaaaccccatctctagtaaaaatacaaaaaattagccgggcatggtggcgggcatctgtagtcccagctactcaggaggctgaggcaggagaatggcatgaacccaggaggcggagcttgccgtgagctgagatccagccactgcactccagcctggctgacagagcaagactgcatctcaaaaaaaaaaaaaaaaaaaatgcaaatcaaatctaaagtagttcagtctttaaactcaaagccaatacatttgctttgaactacaaatgaactgaagtttttaagtgtaataaatgttactaaatcggcttttgtagcagttaaacaaaaaacttcaaaaattgtaaggattctgtgagggagcatggctgctgctgctgctgctgcttgcagatagcctgctgtgtttaggatttagttaaatacatttctcctgtttaaaactaaatggtctttccttagtttgcttagttcttcagaagggcctttgaaacactgggaaataaacaagtgattctttagctactgctttctgaaatacttatataaaagctctgcactgtattctcccatccctctcaggggaatattagagggttaggactccccaggtagacattctaggggtgaaaatttgtcattacattgacatttcagatttaggttttcaacaatactgttttcttctttcacatattgccatctagtaatatagatgttctccgtccacattaatcaaaactattgacatggataattcctaattccttgaacactataatggagatctatagctagccttggcgtctagaagatgggtgttgagaagagggagtggaaagatatttcctctggtcttaacttcatatcagcctcccctagacttccaaatatccatacctgctggttataattagtggtgttttcagcctctgattctgtcaccaggggttttagaatcataaatccagattgatcttgggagtgtaaaaaactgaggctctttagcttcttaggacagcacttcctgattttgttttcaacttctaatcctttgagtgtttttcattctgcagatgctgagtttgtgtgtgaacggacactgaaatattttctaggaattgcgggaggaaaatgggtagttagctatttctgtaagtataatactatttctcccctcctccctttaacacctcagaattgcatttttacacctaacatttaacacctaaggtttttgctgatgctgagtctgagttaccaaaaggtctttaattgtaatactaaactacttttatctttaatatcactttgttcagataagctggtgatgctgggaaaatgggtctcttttataactaataggacctaatctgctcctagcaatgttagcatatgagctagggatttatttaatagtcggcaggaatccatgtgcagcaggcaaacttataatgtttaaattaaacatcaactctgtctccagaaggaaactgctgctacaagccttattaaagggctgtggctttagagggaaggacctctcctctgtcattcttcctgtgctcttttgtgaatcgctgacctctctatctccgtgaaaagagcacgttcttctgctgtatgtaacctgtcttttctatgatctctttaggggtgacccagtctattaaagaaagaaaaatgctgaatgaggtaagtacttgatgttacaaactaaccagagatattcattcagtcatatagttaaaaatgtatttgcttccttccatcaatgcaccactttccttaacaatgcacaaattttccatgataatgaggatcatcaagaattatgcaggcctgcactgtggctcatacctataatcccagcgctttgggaggctgaggcgcttggatcacctgatgtcgggagttcaagaccagcctgaccaacatggagaaaccccgtttctactaaaaatacaaaattagccgggcttggtggcacttgcctgtaattccagctactcgggaggctgaggcaggagaatcacttgaacctgggaggcgggggttgcagtgagctgagatcgcatcattgcactctaacctgggcaacaagagcaaaactccatcaaaagaaaaaaaaaatcgggtgcagtggctcatgcctgtaatcctaacactgtgggaggccaagacaggcagattgcctgagctcaggagttcgagatcagcctgggcaacatggtgaaaccctgtctctactaaaatacaaaaaattactcagcgtggtggcatgcgcctttagttccagctactcaggaggctgaggcaggagaatctcttgaacccgggaggtggaggttgcaatgagccaagatcgtgccactgcactccaacctggcaacagagcgagactccgtcttaaaaaaaaaaaaaattttgcagcgcaaaccaggatatcctctgttctcatttgttctagatttcaaaagaaacagtcctttctttggggaaaagagaaaggaaaaggagttttataaaaggaaagaaaagattcataagaacaagaagtgggcccacttgcatatacctttgtagaaaactgttcactgttgttgaagaaaagctcttcatattaatatgcagtccagatgcagtggctcacacttataatctcagccctttgggaggctgagacaggaagattacttgaggccaggagtttgaaaccagcctgggcaacatagtgagactctgtctccacaaaatttttttttaattagccgggcatggcagtgtgcttctgtagtcttagctactgaggaagctaagccagaagaatcacttgagcccaggagttcaaggctgcagtgagctatgatcataccattgcactcttgcacttgcacagagcaagaccctgtctcttaaaaaaaaaaaagtgtgtgtgtgcatatgcatatatacatatatatacatgcaaatgtatctgtttataattcagattgcttcaaaaagatgttgcactttatgatactgagaacagtgagaagtaaataagatagagtgtaggaggaggaataatttcagaacagccatctgagaacttctgtgacaacagatcaggcaaaatgaaatgtgaaagtaattttataggccaggcgtggtggctcatgcctataatcccagcactttgagtggccaaggcaggtggatcacttgaggtcaggagttcgagaccagcctggtcaacatggtgaaaccttgtctctactaaaaacacaaaaaaattagtcgagcgtggtggcatgtgcctgtaatcctagctgctggggaggctgaggcaggagaatcacttgaacccgggaggcggaggttgcagtgagcctagattgcaccactgcactccagcctgtgagacagaatgagaccctgtcttaaaaaaaaaaaaaaagtaattttataaactattgtgcacaattcgatgtattcataattaattaaatgattatttttgttggttttaacttttattcagtggctatttattgggagcctactgtgttctgggcactaggaatgcaacagtaaataagactaactaagtccctggtaggattcaggttctgtcgaggggagatacacaataaagatgaatttaagataacaataaatgctatggagaaatatacagaacagtggaatagtattagctgtcaaaggttgttgattactttcgtttaaggaggccagggaaagcctttctgaaaaaattgagctgagacctaaataacaagaaataattgtccttgaaaaatgaagggaatgcatcttataggcagaggaatagcaaacataaaggtcttgaggtaataatgagtgtggttttttgatttctgtattttggtttttttgagatggtgtctccctctatcccccaggctggagtgcagtggcacaatcttggctcactgcaaactctgtctcctgggttcaagcaattctcctgccttggcctcctgagtagctggtattacaggcacgcgtgctaccacacccgactagtttttatttttagtagagatggggttttaccacgttggtcaggctggtctcaaactcctgaactcaagtgatccaaccacctcaacctcccaaagtgctgggatcacaggcgtgagccaccatgcccggccagagcttggtttattttttaaaagataggccaatgttggtcgtgtgtggtggctcgtgcctataatcccagcactttgggaagccaaggcaggcaaatcacttgaggtcaggagttcgagaccagcctggccaacatggtgaaaccccatctctactaaaaatacaaaaaactagcatggtgtggtggtgtgtgcctgtaatcccagtgcctgtaatcccagctactccagaggctgaggcaggagaatcacttgaaccgaaaggtaggagttacagtgagccaagatcgcatcactgcactccagcctgaacgacagagcaagactcctgtctcaagaaataataatgataaaaggttcgggcacagtggctcacacctgtaattccagcactctaggaggccgaggcaggcagatcccctgaggtcaggagtttgagaccagcctggccaacgtggcaaaaccccatctctactaaaaaatgcaaaaattagctgggcacggctgggtgtggtggctcattcctgtaatcccagcactttgggaggtcaaggcggacagatcactgaggtagaaaccctgtctctactaaaaatacaaaaatttgcccagcgtggtggcgcgtgcctctaatcccagctacacgggaggctgagacaagagaatcacttcatcaacccgggaggtggaggttgtggtgagctgagatcgcaccattgcactccagcctgggcaacaagagtgaaactccatctcaaaaacaaaaaaaaattagctgggaatggtggcatgtgcctgtaatcacagctacttgggaggctggggcaggagaatcgcttgaacccaggaggcggagattgcagtgagctgagattgcgccactgcactccaggctgggcgaaagagcaagactccgtctcaaaaataataataataataataataggccagtgtagctggagtaatttgcaaattatgtgtggaggcagagattacacaaggaatgggagaaggtcatagatgagggccagatcacatagtatttggtggtaaggaattcagattttatccttgtggtaattggtggtgtggagatggttaaaaacaaggttggtttgggatgggtttgaagagaggacttgctaatggattaaatttggaggataaggtaaagagaaattgaaggagtgacacttgggttttggcttgaacaatagatcttgttagtaatattaaattagatgaagaaggcatggtagggaatatgggggagtgggaaaggcaggaagcaggaatggaaccaggaactctgttttagatgtgagaatttgttgttgttgttgttgttgttgttgttgttgttgttgttgttgtgacagcatctcgttctgttgcccaggctagagtgcatggagtgcggtagcacgatctcagctcactccaacctccgcctcccggttcaagtgattttcctgcctcagcctcccgagtagctgggattacaggcacctgccacaatgcctggctaatacttgtatttttagtagagatggggttttaccatgttggccaggctggtcttaaactcctgacctcaggtaatccacccacctcggcctcccaaagtgctgggattgcaggtgtgagccactgtgcccggccagatgcatgaattttgagatgtatactagacttctggatagagaagttaagtaggcagttggacacattgtatgaagctcaggggtacaaggaggactatgaacatgggagtcttctgacaaatttatcactagactcctcattcaagtaactaggaaatgtcagatattcttcccctagtaatagccagtggttatactcttgcctttagttttcttcacaatactcttggcaacacataaggccttccctacaatctgagtttcagtcagaattgtttctgagcgttcttcctcaaatttctccccagtctcattattctttattctcatgtccatgaccagtcataatagtaattatgaaaaacctctaactttctttagtgcattgaatgtatattttatcattttggttgtgttaactgtaaatctctcagtggaaatctgaaaagcctttatttccttagatgataatatacaattgatttaggagatagggaatttttcagttacctttataacagcacagtattagcagtctaatctaaatgctaagtgaatgttttgagaggagatagatgttgaaaattaaaatacattaagtcccagtgaggtgaaaagccgattgttaagttctgcacacaaaagatttgcttcagtgaattgatttcaacagctgagatcctagtcatttcacctggtctaccaaaaagaatgattttacttgcttttggtcaaatctctgcccagcaattctttttctttctttcttttttttgttttatgtgtgtgtgtgtgtgtgtgtttttttagcagagtctcactttgtcacccaggcgggagtgtggtggtatgatcacagttcactgcagcctccaactcctgggctcaagtgatcctccagcttcagcttttcaagaaattgggactgcaggcacatgcaactatgcctggctgaggttttatgtatcttttttctagagaaggggtctcactgtgttgcccagctgggtctccagctcctggtctcaagctgtcctcctgcctcagcctcccaaagtgccaaagtgctagggttataggtgtgagccattggtgcccagctactgcctgcctggcaattctgaatgccttaaatttttttttttttttttttttttttttgagacagagtttcactctgtcacccaggctggagtgcagtggcatgatcgtggctcacagcaacctctgcctcctggattccagcaattctcatgcctcagcttcccgagtagctgggactacaggtgcatgccaccacgcccagctaatttttggtttttttgtttgtttgtttgtttgttttgagacggagtctcgctcagttgcccaggctggagtgcagtggcgtgatctccgctcactgcaagctccgcctcccgggttcacgccattctcctgcctcagcctcccgagtagctgggactacaggcgcctgccactacacccggctaatttttttgtattttaagtagagacggggtttcaccgtgttagccaggatggtctcgatctcctgacctcgtgatccgcctgtctcggcctcccaaagtcctgggattacaggcgtgagccaccacacccggcctaatttttttttttttaattttatttttaattttttgagatgcgagatggagtctcgctctgttacccaggctggagtgcagtggcaccatctcagctcactgcaacctccacctcctgcattcaaaagattctcctgcctcagcctcccaagtagctgggattacaggtgcctgccaccacgcccaactaattttttgtatttttagtagagatgaggtttcaccatgttggtcagactggtgtcgaactcctgacctcaagtgatctgcctgcctcagtctcccaaagtgctaggattacaggggtgagccactgcgcctggcctgaatgccttaaatatgacgtgtctgctccacttccattgaaggaagcttctctttctcttatcctgatgggttgtgtttggtttctttcagcatgattttgaagtcagaggagatgtggtcaatggaagaaaccaccaaggtccaaagcgagcaagagaatcccaggacagaaaggtaaagctccctccctcaagttgacaaaaatctcaccccaccactctgtattccactcccctttgcagagatgggccgcttcattttgtaagacttattacatacatacacagtgctagatactttcacacaggttcttttttcactcttccatcccaaccacataaataagtattgtctctactttatgaatgataaaactaagagatttagagaggctgtgtaatttggattcccgtctcgggttcagatcttagctgataagtggaagagctgggactttaagcagatgagaatctaaagactttgctcttttcacttcactggggtgtctttctctctctctctcttgctctctctctctctttttttttttcccaagacggagtctcactccattgcccaggccagagtgcagtggtgcgatctcagctcactgaaaactcatcttgcccaggctggtcttgaacccctgaccttgtgatcctcccgccttggcctccccaagtgctgggataggcgtgagccaccgtgcccagccaataatagctaaaatttatataatgttcactgggccaggcacagcggctcgttcctgttatcccagcactttgggaagctgaggcaggcagatcgcttgagccaaggagttcgataccagcctgggcaacatggcaaaaccccatctctaccaaaaaaaatatacaaaaattagccaggcgtggtggcatgtacttgtagttccagctactcggaaggctgagttgagagtatctcttgagcccaagaagaggggactacagtgaacggagattgcgccactgcactccagcctagacgacagacagaagatctcaaaagaaaaaaaaaaaaaaaagatcactttatgctgggactgctctaaaggcccaaccatgttttaactaattaacaattttatgacaactctatgagctatgtactgtaattatgcctatattacagatgtgaaaattgaggctcagagaggttgaataagttgctcaaagtcacacaggtaataagtgatggaactagaagttgaactcaggaagtctagctccaagtctaaattctttgttaatttatttttcgggccagagtcttactctgtcacccaggctggagtgcagtgccactatctctgctcactgcaaccttcacctcccaagttcaaaccttgttcaattcttgtgccttggcctcccaagtggctaggattacaggcatgtgccacaacaactagctaattttttgtctgattctgttggccagtctggagtgcagtggcgcaatctcagctcactgcagtctccagctcccaggttcaagtgattctcgtgccttagcctcccaaatagctgggattacaggcacgtgccaccacaccgagatagttttttgtatttttaatagaaacaaggtttcaacatgttggccaggctggtctcaaattccagacctcagatcatctgcccgcctcaggctcccaaagtgctgggattacaggcatgagccactgcacccggccttaatttttatatttttattagagatggggttttgccatgttggccaggctggccttgatctcctggcctccagtgatccacccgccttggcttcccaaagtgctgggattacaagcatgagccactgcacccggcctccaattctaaactcttaacaacaatactatagtttcttgaaaagttgttgaaggcttcacggagggaaaaaaaatggagcattctaacaactttgcagatgagacccaagaagactcaatgactttctcctgatcatattgtagcagatgacttagccagaactctgacttcctcacagggagaaagtctgcaagatttcacacttacctgtcaggcctgagctggctgctttctcagctccctaagtgctatgttcccagtctgcttttcttcctttttcaagtgtgcactaccaggcatttcagaacatcccaggctggtcgcggtggctcacacctgtgatcccagcactttgggagcccaaggcgggtggatcacctgaggtcaggagttcgagaccagcctggccaacatggtgaaaccccatctctactaaaaatacaaaagttaactgggcgtggtggtaggcacctgtaatcctagctcaggattactcgggaggctgaggctagagaatcggttgaacccaggaggcggaggttgcagtgagccaagattgcgccactgcactctagcctggggacaagagggagacttcatctcaaaaaaaaaaaaaaaatcccagctgggcacagcggctcacttctgtaatcccagcactttaggaggccaaggcaggaggatcacttgagcccaggagttcaagactagcctgggcaacatagtaagaccctgtctctacaaaaaaatttaaaaattaattgggtgtcgtagcacactcttgtattcccagctactcaggaggctgaggtgagaagaatgcttgagtctgggaggtcgaggctgcagtgagccatgatggtgctactgcactccagcctggccaacattgtgagaccttgtctcaaaacaaaacaaaacatccttctactgagcactttctgtccctttatagaaacttaagagggaaccagtagaggtaatttcctaaggaaaactgctttgggacatgatcacaaatgaagcctggagttttgaactgctgaggtcagcctgtttttaccttctgagcctatcaagtaattgttccagatgccaagaaaagctgctggccttatttctgcttctgcctttaccacaggggagcgccatgtgagccagtcctctgtttttcctccactgtatgctaggcagtattagcaccagattcttcccctctttaaaaagaaattctagtgctttggattttttcctccatgcagaatagcaatgatggaaagtatgtggtcaaagtaatgacattctgaaaatactaaatgtcaccatagtatttttctctggaagagaaatgtatatgtagaggtgaaacttcaaatttctttttttttttttttaagacgaagctttgctcttcttgcccaggctgaagtacaatggcgcgatcttggctcaccgcaatctctgcctccagggttcaagtgattctcctgcctcagcctcctaagtagctaggattacaggcatgtgccaccacgcccagctgattttgtatttttagtagagatggggtttctccatgttggtcacgctggtcttgaactcccgaccccaagtgatccacccacctcggcctcccaaagtgctaggattacaggccaccgcgcccggcctgaaacttcaaatttctttttttttttgagacagagtctcgctatgtcacccaggctggagtgcagtggcgccgtctcggctcactaccagctccactccacctcctgggttcacaccattctcctgcctcagcctcccaagtagctgggactacaggtgcccgccaccatgcccagctaattttttgtatttttagtagagacgggttttcactgtgttagacgggatggtctccatctcttgacctcgtgatccgcctgcctcagcctcccaaagtgctgggattacaggcgtgagccactacgccaagcccgaaacttcaaatttcttatctcataactaggcatccttatcactgagtgttagcctggatataaacattcctaatcttttgtacttttcatgtcagcatttggctccacttggctgcctggggagaacttctagcattatgagcatgcaggtcctatcaacaggttgggggtgcggtttattcatacaggtagtgagagtggcacagatggatgctgtcccttaaaacaaacagacttgtctttgggagcctgaggcgggtggatcatgaggtcaggagttcaagaccagcctggccaacatagtgaaaccccgtttctactaaaaatacaaaaaattagccgggtgtggtggtgtgcacctgtaatcccagctactagggaggctgaggcaggagaatcacttgaacccaggaggtggaggttgcagtgagccgagatggcaccattgcactccagcccaggcgacagtgcaagactgcgtctcaaaaaaaaaaaaaaaacacacagacttgtcctactgccatttcttttcactctggcggtaaagtaagagtgtgtgtgtgtgtgtgtgtgtgtgtgtgtgtgtgtgtgtgtttctgtccgtctgtctgtcaagggggagggtgaccactttctaaaaggccatccgtgtatttttagcttcctgatttttttctctatcgcagtctctttgaagccaggtgaattttaggccttggcaattttctttttattgcaatgggaaggtcaagacactgagagtcacccaaaacatatccatccaaaatgatacaattttagggtttatttttaagtgatacccaagttatttgctaagaacctatgccagtgtgtttatgagaatttgcactgtcccacactgttgccaccagccacatgggactgtttaaatttaaattttacaaattagccagtcatggtggtgtgcacttgtagtcccagctacttaggaggctgaggcaagaggattgcttgagcccggaagttcaataccgcagcaagctatgatcgtgccactgtactccagcctgagtgacagaatgagacctcatctcttcaaaaaaaaagaaaaaaattaaaatatgaagtttagttcttcattcaccctaaccacatctccagtgctcaataactatatgtgactcatggctaccttattagcatagatatagaacattgtgactatcacagaaagttgttttgaacagtgttgccaagccctgtaagtggaagaggcagtgcagtgtgatctgtgtcttcaggaaaccaggtagtcagactagttcaatgaggagaggcagaacctggcttcacttctagattaaaaactgcttaggtggcctaaagatacaatggccattctcagagtagtgagaaggaaggaacagatgtttagggggctagaagaaagtcagagagggccgggcgcagtggcttatgcctgtaatcccagcactttggaaggccaagacaggcagatcacgaggtcaggagttcgagaccagcctgaccaacatggtgaaaccctgtctctactaaaaatacaaaaattagccgggcgtggtggtgcgcgcctgtaatcccagctactcaggaggctaaggcaggagaatcgcttgaaccctggaggcagaggttgcagtgagcccagatcgcaccactacgctccagcctaggtgacagagagagactccgtctcaaaaaaaaaaaaaaaagtcagaggagacaaggagcatgtacacctaaaatcaacatagacccctctgttgatggggtcatagtgagtacttgaggtaccaagtctggataaacatcaaacttcagccaataactttgagtttctagccatccaagcctcttattaaacatacagaaggaccttttttcccttgcatctaacaagttaaagcacctgcagagatcattagggaggagccttggcctgattggtgacaaaagtgagatgctcagtccttgaatgacaaagaatgcctgtagagtgcaggtcaactacatatgcacttcaagaagatcttctgaaatccagtagtgttctggacattggactgcttgtccctgggaagtagcagcagaaatcatcaggtggtgaacagaagaaaaagaaaagctcttcctttttgaaagtctgttttttgaataaaagccaatattcttttataactagattttccttctctccattcccctgtccctctctcttcctctcttcttccagatcttcagggggctagaaatctgttgctatgggcccttcaccaacatgcccacaggtaagagcctgggagaaccccagagttccagcaccagcctttgtcttacatagtggagtattataagcaagatcccacgatgggggttcctcagattgctgaaatgttctagaggctattctatttctctaccactctccaaacaaaacagcacctaaatgttatcctatggcaaaaaaaaactataccttgtcccccttctcaagagcatgaaggtggttaatagttaggattcagtatgttatgtgttcagatggcgttgagctgctgttagtgccaacatgttagtgagaaaatatctttggataggtaaaaatcaaggaggagttctcctcttcctaaaccatcttaatttacttacatagaagaaagcacagcagctggcccaccatggacgggcccagagcaggggaagattctcggtgaacatttcttttttttttttttttttttgaggtcgagtctctgttgcccaggccagagtgcaatggcgcgatctcggctcactgcaacctccacctcccgggttcaagtgattctcctgcctcagcctcccaaatagctgagactacaggcgtgtgccaccacgcccgactaattttttgtattttttttttagtagagacggggtttcaccgtgttagccaatatggtcccgatctcctgacctcgtgatccacccgcctcagcctcccaaagtgctaggattacaggcatgagccactgtgcccagccctctccatgaacattttctaattaaacttgacacttaatacaatgttatgcttaggactgctataaagcttacctctggagttgcgcagcacaaaggccttggtgtgtgtataaatttggtttgttcttttcacagcaaaagctacccacctttgcctcctgtgcctgcttctgcccagggacttaggtcctcttacaccttagagaaaggccttagcatctggtcacaggcagatgagtgacagcaagaaaacctggctgcaatgtaattttgtttccatcctctttattagttatcaattggatttttatgaaatttccaagttccactcaaggatttctcagtgtttttttactttggtatagtggaaaccagggttgccagaaagtattattttgggggtgagttagtcaaccttcgttcagtcagacagacaggagcacctcagcaattcccagaaacgggctgatgggaaagagcaacatacatgaatgtcttgaagaacacagccaacagagcccattgggcagttctgattttccaggtacacagcatctccacagtctcttctgatttttattcccctgagtatatggattccagctcagcatgtagcctttccctgctgagtctctaaccaggataacatgtatttttttgactggatgaattatcttcccatctcttgacatttacagtaattaccaccaagtatggtattttcagtggccgtgattatcagttaccaacacagaattaggatgaagggaggaagggagggaaggaaggtgggtgttttttcacacagtgtcttagccagcaatttagcaaattaatggaaattagatctttgatttttttttctttcaagcattttatttgagagactatcaaaccttataccaagtggccttatggagactgataaccagagtacatggcatatcagtggcaaattgacttaaaatccatacccctactattttaagaccattgtcctttggagcagagagacagactctcccattgagaggtcttgctataagccttcatccggagagtgtagggtagagggcctgggttaagtatgcagattactgcagtgattttacatctaaatgtccattttagatcaactggaatggatggtacagctgtgtggtgcttctgtggtgaaggagctttcatcattcacccttggcacagtaagtattgggtgccctgtcagagagggaggacacaatattctctcctgtgagcaagactggcacctgtcagtccctatggatgcccctactgtagcctcagaagtcttctctgcccacatacctgtgccaaaagactccatctgtaagggatgggtaaggatttgagaactgcacatattaaatatactgagggaagactttttccctctaactctttttcccatatgtccctccccctcctctctgtgactgccccagcatactgtgtttcaacaaatcatcaagaaatgatgggctggaggctgggcatggtggctcatgtctgtaatcccagcactttgggaggccgaggcaggtggatcacttgtcaggagtttgagaccagcctggccaacatggtgaaaccccatctgtactaaaaaaaaaaaacaaaaagtagccaggcctggtggagcatgcctgtaatgccagctatttgggaagttgaggtgtgagcatcgcttgaacgtgggaggcagaggttgcagtgagccaagattgcaccactgcactccagactgggtgacagagtgagactttgtctaaaaaaaaaaaaagagagagagagagaaaagctaggtgcggtggctcacgcctgtaatcccagcactttgggaggctgaggtgggcagatcacgaggtcaagagatcgagaccatcctggccaaccaacatggcgaaaccccgtctctactaaaaatacaaaaattagctgggcgtaggggcgcacgcctgtagtcccagctacttgaggggctggggcaggagaatcgcttgaaccccggaggcggaggttgcagtgagccaagatcgcgccactgcactccagcccgggcgacagagcgagactccgtctcaaaaaaaaagagagagagagaaatgatgggctgggccagtgccccacccctgtaatcacaacactgggaggccaaggtgggagaatcgcttgagcctgggagctgaagaccagcctgggcaatacagtaggacctcatgtctacaaaaaaattattaaaaattagccaaggctgggtgcggtggctcatgcctataatcccgggggtgaagttgagcccaggagtttgagaccagcctgggcaacatggcaaaaccctgtctctaccaaaaatacaaaaaaattagccaggggtggtggtacgtgtctgtagttccagctacttgggaggctgagatggaaggattgcttgagcccaggaggcagaggtggcagtgagctgagatcacaccactgcactccagcctgggtgacagagcaagaccctgtctcaaaaacaaacaaaaaaaatgatgaagtgacagttccagtagtcctactttgacactttgaatgctctttccttcctggggatccagggtgtccacccaattgtggttgtgcagccagatgcctggacagaggacaatggcttccatggtaaggtgcctgcatgtacctgtgctatatggggtccttttgcatgggtttggtttatcactcattacctggtgcttgagtagcacagttcttggcacattttaaatatttgttgaatgaatggctaaaatgtctttttgatgtttttattgttatttgttttatattgtaaaagtaatacatgaactgtttccatggggtgggagtaagatatgaatgttcatcacaaaaacataaatcaaggccgggcatggtggctcatgcctataattccagcactttgggaggtcaagatggaggtcaaggtgggagcctagaagttcgagaccagcctgggcaacataaggagacttcatctgtacaacaaatttaaaaagtagctgggtgtggtggcagatgcctgtagtcgcagctacttgggaagctgaggtgggaggatcacttgagctcaggaggttgatgcttcagtgagccacgatcacaccactgtactccagcctgggcgacagagcgagaccgtgtctcaaaaagaaaaaagaaagtataaatttacacaaaaacaataaaataatcccagtaattccaccacttggagatgatcaccataaaactccaccaggcatatgtgcgtatatatacacgtgtattttataaaatgtgatcataattacactgttttgcttttttccttaagatattacatacatttttccacatcgttaaattacagtgctgttttcctggtggctttcctttaacagattgaagttcatgttaatacagttgccagaggctgtgggctttcactgtcaccaggagtcactcctagggcctcttcagagcaaggccttatgtcctgaagcattgccttttttttttttttttgaggtggagtctcactctgtcacttagcaggctggagtgcagtggcccagtcttggctcactgcaacctccgcctcctgggtttaaatgattctcctgcctcagcctcagggcggatcacctgacatcaggagtttgagaccagcctggccaatatggcgaaaccccatctctactaaaaatactaaaaaaaattagccaggcatggtggcacgcacttgtagtcccagctacttgggagactgaggcaggagaatcgcttgaacccaggatgttgaggttgcagtgagctgagatcacaccatcacaatccagcctgagtgacagagtgagactccatctgaaaaaaaagaaaaaacaattagcctggcatggtggcaggcacctgtaatccctgctacttgggaggctgaggcaggagaattgcttgaacccgggaggtggaggttgcagtgagctgagatcgtgccattgcattccaggctgagcaacaagagcaagactccgtctcaaaaaaaaaaaaaaaaaaaaaaaaaggccaggtgcagtggctcacgcctgtaatcccagcactttgggaggccaaggtgggtggatcacctgaggtcaggagttccagagcagcctggccaacattgtgaaacccccgtctctactaaaaatacaaaaattagctgggtgtgatggcatgtgcctgtaattccagctactcaggaggcagagacaggagaattgcttgaacccaggaggcggaggttgaatgagccgagattgcgccatcacactctagcctcggcgacagagcaagactccgtctcaaaaaaaaaaaaaaaaaattagcttctacctcattaatcctaagaactcatacaaccaggaccctggagtcgattgattagagcctagtccaggagaatgaattgacactaatctctgcttgtgttctctgtctccagcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaccatgaatgactgttcttgagacttaggccagccgactttctcagagccttttcactgtgcttcagtctcccactctgtaaaatgggggtaatgatagtatctacctcctaggatttattgaggcagcttaaataccttttgtatttcctgttgctgccaaaacaaattgttgcaaggtcagaagtctgaggtggctcaactgtttctttgtttcaggtttcatgaggccaaaataaaggtgttcgcagggcgtgttcccttctagaggctctgggtccttgcagttctaggactaagatccctgtttcccactggctgttggctgggcatcattctcagcttcttgaggctccccacattcctaggctcctggcctgtctgcctccatcttcaaaaccagcaatgggtggtcaagtttttctcacactgaatcttgctgactactgtatctttctaactcctgccagagacatttctctgtttctaagggctcaagtgattagattgcacccacttggtaatccaaagtgatcttcatatcttaaggcccatagccttaattatagctgcaaagtcccttcgcagcagtacctagattactgttggaatgaataaccagaagacagcaatcaagggaggacatctttagaattctgcctaccacttgtatttaacatgcttaatccacagatgacactctctaccattatttcctggtcctcacactgctcagagattggaatcctttttgagcaaagagaatgaagtcatcacatagttcagtcctgctgtatttgctggaaacagtgaaggaagatagagaaaatggagctaactgccaatattacattttatatcagtcttcatcatagccctatgaagtgggtatttgttacctcattggaaaaatgggagttgaatctcaagttccttgtttgtaagattttactcagatttgcacagctaaaaatgactacatggagacccaaagccacctttctgttcccatcatcagctttccatctgcctctgtcactgaccccgggacagaaggttcaagccttaagggaatttggagagagaactagattttgaggggaactcacactcacttcccttttgggccacagtaggagacagtaaaagcagccccatgtcaggcaaagggtcttacaggagtggatcatggctgctgtttccacttctctctggcttcccagcttatgactgtgtatcttagttgtcaaagccttccagttcatcctcacctacagcttgacttcccaagggcccatgccagctccctgtctacctgccagtgagttgatgagtctcggtgttagtagtaaaggcaggcgggaagcaagcagaagtgctactgggccttgagggtaagccaggcctcagccttctgaccccatcactgatgggttaataggaaaagcagtatccatctagtacagcctgccttttcaggaatagtgagtaaaagcaaagatgactaaaatacattaaagttttctgtaattgtctctaaggtctcccaacaaacatataccccatctgtttcaagctctgcataacctttcccagaagtcaagttcaggccctggcctcatggtgcctggcccaggttaagagtgctacctgatgatggagttaatacacgttgctttgacctctgactttaagatgtcctcccacttttccaccccgcaatctctagccctctctgggcacagcagcaattgggaactagttcctgtactgcctttatctcattttacaaaacaaacttctacaaagaagctggaaaggaaggaggagaaaggattatcatgcaggcacagggagggggcctagagaagagctctggcagattatgtccctcttaaaaaatgcaaccagaatcatcaacaaagtatcacctcaaaaatatgcaggagaaaaagaaaggaatcaatgttggggtggttggagcagaaggagccaa

SEQ ID NO: 12666 - DNA, 85152 bp, Human; identical to SEQ ID NO: 12665

SEQ ID NO: 12667 - DNA, 85152 bp, Human; identical to SEQ ID NO: 12665

SEQ ID NO: 12668 - DNA, 85152 bp, Human; identical to SEQ ID NO: 12665

SEQ ID NO: 12669 - DNA, 37613 bp, Human
caccacgccgggcctctctttttaagataataaaaattactaaacatcataatgacatgatttgggattactctttcagagaaacagttcctaaaggtttacttcagttagtgatttttatttttattatttatttattttttgagatggagtctcactctgtctgccaggctagagtgcagagacgagatctcagctcactgcaacctccgcctcccagactcaagcgattctcctacctcagcctcctgagtagctgggactagtagctggaactacaggcgcccgccaccatgcccggctagttttttctattttagtagtgacggggtttcaccgtgttgcccaggttggttttgaactcctgagctcaggctcaggcaatctgcctgcctcagcctcccaatgttctagggttacaggcatgagctactgtgcctggcccagttagtgatttttaaattgtagttccttaaatgagtattttggatttcactccacaatgttcttcaactgtaagatctacttgaggttatttgatttgctggtttgcaagaactcgtctacacgttgtctttatcacaaagaaattctggagcgtttgagccctgttcaaaaaaaaaaggcaagaagaaacttcaggaacaaataacctatttgaccctgtaatgaataatattcacacattttctaatttaagagctgttgattgatttccaacttttagaatctgtttcagacaaaacatggaagtttagtaacagttttttctattctgtaataataattgccacaaggttaaaaaaaaaaatttacagaagaacatatttgagggtggtcgtgggggcaagaaagctggaaggacgggtggggtgtgttaatagccttgtcttgtgaagtaagtcctcagagacgctgtcctagttggaagaacaggcagtgaaggtgtgcgtctgttacggagaataggactccagtgatctagctggtacttagagaggtgggggtgatcaccaaaaaaacagctctgcctctgggagcggagaggactgggatagaaagtatttgtctttcattttaagcccttctgtacgatttgacttttcttttttttttttttttttttttttgagatggagtctcactctgtcacccaggctggagtacagtggcacgatcttggctcactgcaacctccgcctcccaggttcaagcaattctcctgcctcagcctcccaagtagctgggactacaggcacctgccaccatgcccggctgatttttgtatttgtagtaaagacaggatttcactgtgttggtcaggttggtcttgaactcctgacctcatgatccacccccggcttttttttttgacacggagtttctcgttacccaggctggagtgcagtggcgcaatctctgctcactgagacctccacttcctgggttcaagcgattctcctgcctcagcctcctgagtagctgggactacaggtgtgcgtcaccatgcccggctaatttttgtatgtctaatggagacagggtttcaccatgttggtcaagttggtctcaaactcctgaactcaggtgatccacccaccttggcctcccaaagtgctgggattacgggcgtgagccaccatgcccggctaaagcaagaaattttcattgcatattttaagcaaaggcaaatgcatatgtggatagactgttttaatttgactaaagtcatattgaatccatgaattttagaagctcaaactattggggaacaataattaccaccttggagtgaaaatacttaatttccacaagatttagtaaaggaagagttttttaaaaaccaccttaatgataatagtatgtacagatgttaagaaatgaaataggaatgtgtaatgttggaaacacaaatatttttgcttctgagaataaaactaattttttctcccaattttctcttcctttttcttttttctgttcccccctttctcttccagaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtaaaagggttgtgggcagctagtggtggttgcaggagatagaaatctgggaattgcggtttgacctaccaccctttgctcgttaaaggagcagctttgaaatctggactgcagggatatccaaaacaacaactgcatgtttctaagggagtcgactctccttagaggagttcttgtacaatagccctgggcaaaaacagaacttgccctattttttatactgaaaaggacagctggacaaaatactgaacgcaatttttcccctaagaaaaagcattatttccctaaaatgtcttatattaggaacagagcacttgaataaacataattgatttataaaaactgaggctatacacttacctatctgttcagtacaaacaggaagcttcaaatgtaaacgtgaattctcatacacttataaatgcatatctttatgtggacttgttaaaatgaaattggtatttaggaatttggagatttttagtagttacacaagaatcaatgaaaaagaacgaagctggtttccaaagctgatatgtctgatttggttcctttcttctcaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatctgctgagcagcgggatcaatggcagcttcttggtgcgtgagagtgagagcagtcctggccagaggtccatctcgctgagatacgaagggagggtgtaccattacaggatcaacactgcttctgatggcaaggtaggggacccttggcagggggcgctgatgggcccagggcaggggaaccagaggtcctgctgtcggattgataaattattgcaagaaagctcaaccaagaagatgtttaaagaatctttcaggtgggagtcattccattagccttatgaagaccctttattgaggatccgttctgtgatattacaagttcctgggactggtatgattctcttattgtcttgctagagttttgttgttagcaagttacttaaaataggaggaatatctgttgggttttggacacattttttacaataagattcttcctttaaaaaaaatattttataatgatagaaatcatccccaacgagaaaaattcaaataatagataacctttcttagagcgaaagaccactttactatcccctcccccacagacgcctggcacgtgggcttcttcctgcggatgaacacattcatggagaggtgtgtggacatacgtgcatacacgcatgcagttttcagtgaaaaccgggatcaaacccacagcttaccaaacccaaagtgtggtgttgtaagggaggtggcctatatgattttgtggtcttcatataaataatccttaagagtccataaagagaagggaggagttaacattgactgaggtattgctataatacctgcatctttgcattaaagaaagggaggcataaagagatcttgcccgatgtcaacctagtgagtcactgatggaataggcttggatcccacagtttattctactgcaccaggctgtagttgaggtacagtgttgataggtggtcccgatggtgtatgtttgtttgtttgtttgtttttgagatggagtcttgccctgtcacccaggctggagtacagtggtgcgatcttggctcactgcaacctctgcttcccatgctcaagtgatcctcccaccttagccttccgagtagttgggaccacaggcgcacaccaccatgcccagctgttttttgtttgtttatttgttttgagatggcattttcgctctcattgcccaagctggagtgcaatggtgcgttctcggcttactgcaacctccacctcccgggttcaagcatttctcctgcctcagccttccaggtagctgggattacaggcatgcaccaccacacccagctaattttgtatttttagtagagacagggtttcaccatgttggtcaggctggtctcaaactcctgacctcaggtgatccacctgcctcagcatcccaaagtgctgggattacaggcgtgagccaccacgcctggccgtttttgtatttccagtagagacagggtctcgccatgtcgcccaggctagtctcaaactattgagctcaagcaatctgccctcctcggcctcccaaaatgctgggattacaggcacgagccactgtgcccagcctatattttttaaatagtatgtaatgcatgcatatggttaaaaaaaatcaaaagaacaaaatgaattacagtaaaaagtaatcgtctcctaattcacttttcctgcccagaggcaagcactggtactagttccttctagagttacctggacacagatggatggtatatagatgtttatgtggatgtttatattcaaaaaggcacgcaaatgatacatgcacgcgaatgcatcatgcttctcccgtgtgataatacaccttcgagattgttttatggcaacaggtttagagctgcctcattcttaccagtgactgtgtaccgtggatggactgtcacttatttcagtagtcccctgctggttgacttttaggttgtttccaatctttagttattgtaaataatgctgatatgaggtggctttcaaaccttttcaaaaatctggttctgctgtaagaaaaactcattttacaccaccacccagccctcacaatataacaaaagtttcatgaagtcttacctacccttactgtatgtaacgcactctgatagtttgtatttcattctgttctatttcattttttaaaaattctggttgtaatccactaaatttatttcatagactgactagtggcccatggcctggtttgaaaatgcgttgcacgtgcttctttatgtgggtgtaagtgtgtgcagataagttgccagaactgactgaaggttatgtgcatcaccaggtcaccctctatagaaattgtacaaatttgttctcccacaaacaatccatgaaagggcttgtttccccttaacccacaccaacagtttattattagacatgtaaaaacacctttgtcactctgactggtaaagaatggcatctcattatgttgaatatccatgtggcatattttgggtcatctttatgccatttagtaaattcatctttttcctacatgttagaaatataccaagtgtatatgtgtatctaggcctgttgacctctctgttctcttccattggtctgtctatccgtatgccagtaccaaacttgtaattgctatggcttcataccatgttgtggtatctgataggctagtccccacttacctttttaactttttttttttttggctgtcttcacacattcacttgtaccatatgaacatacatatacttcctttttaatgttcttatttttcttcacatcccaaagtcttctggctgaaatcctattgcccatatctgatgctttccaccactgcagaattctttagtaccaacactgcagtgtgcgtgacggacaaaagagcctgttatccctgtgtgactagacgtgggcctgtcagcttgctttttgggttattgttcttatcccagaggtggagctgcgttcttccattctgagggacgtacttcaggacattgggccctttgaaagagccttcagaccacaagggtacctttctagtgaatcagaacaccagggtgcaccgcccatggggggtgattttctggagcagacagcttgcttcccatgtgtgctatttatccaaggcaagtcatgctgcaccgagatagtcacttgaggtttgcaccgaacaggataatggtttcttttccctagagctgtttaatcagcaaccttggaacagatgcaggcaggcatgatctagtgtgacagctcattagctaggggttgatctaaaatactgttcaaatgggcaaggaaaggcctgcgtatgggatatgtgatttgcagaatttgagattcatccaaagagggagaatctgcctaagatgcctctgtctaaaagctagtatgtgccaggtgggtttgtttcattccaggtagagcacagggagcttatgtgaccaggcagtgtccaccattgggcaacacatcacacttcccttggcgtcttgcctcctccctccccgtctggcacagactctcccatcagccgtttgggcacctggggacttctgagcccacagcgtcatccagcagaccgtctgcggaggttccttcctgtgagggccgcactcgagggggtgtattgggtgggatcgtatcactggaatgagtgaacatcgttagagggagctcccacagctatgcgtgtgaccgtgtggctcgccgctgaaaaatgctgctcacatagcagaacttcgatgcaatcctttttggatttctaaggggaaattttaagaccgataggaggaataggctggggttgaataagtttggttcttatttttaaattagctcatctttagaaaacaactgaatttagaagattcttctgtaaggccccaaaggatttctttctgcctccccgctcttggctcttatttgtgtctctcctcgtgttctgagcttttcagcagcccttgtgggtcatcagccgaggaccatcagctcggggcccagagctggggactgggagttatgagctggactcttgaaggggccaatactaaaccgagccgttgccatttcctaggagccttgacaggctcaaacatctctgggtacccggggatttgactgtcattgttctgatcctttcccaaagttgtaaccctctgttgacatagcggaattgaagattgatttttcttcaccaccttctgcctaaagttcttagttctgaatgtgtccacacctcattgacttctatgagatgcccctgtcacgttcctcgattccttctagtccttaatagagtctttccttttcttgaaagaaatttgcccagttgacatttattttcatcgtctgctgaagtgacagatccaaggccctaagcttcagcagagttgcaggaagggaccatttacacagcctcttagatgtttaaggtttacccgccctgacagtggctcagcaggcgtaggcctcctggtgaaaagccgagcacatggctaacctgctctggtggaggggctttggaccgttcttgtgtactgcgaggcttgccttcctgctggtgtgtgagcagctctcgggggaacttgcttcctggctgagcaacctgtaaacagtatgtctgaggtgggactcccgggcccaaagcagccaaaggttgcacaagtctaagctccgttaggcctgtcagtgtggctgtcaaaagaaacgctgtttcttttctttctttcctttttttttttttttttttttttttttttgagacaggctgtcacccaggctggagtacagtggcacaatctcggctcattgcaacctgcgcctcccgggttcgagcgattctcctgcatcagcctctcaagtagctgagactacaggtgcccaccagcatgcccggctaatttttgtatttttagtagagatggggtttcaccatgttggccaggctggtttcgaacgcctgacctcgtgatctgccctccttggcctcccaaagtgctgggattacaggcgtgagccactgctcctggcaaaatgctgtttctaagcgtttctttgacaagtcccatccttcaggttcatgcatgattagggagaggcagcagccctgactgagcacctgagtgttcatggaaccaggtgcatagcgtaatgacatgccattcatgacactactttcttccctgaacatgccatgaattcctgatgattacacagttccccaacaagtgctgctcaaaacctggaactaatcagaaggaagcaccagccttgactgttagtgggacacggggaagatggctgtgaaccgaatatgcggtgcctttgggggagaatggttttagtatttagtaagtgtcagtatgtaagttttatgttgaaaaatgaactaagtcacaacaaggtctataaatttaattattgaaaaggataaagttgggccattcagtgaaacctcctgtaactgaagtctctaacacagtagccaatgggggaatcaaatgagcccaagaagaaattctgcgtaaactaggacttaggggagcccttagcattccactttggagtgaaggaacccgatccgccagttggggaacgctcctttgaggcccatgtgcttcctgctccgacgggagagagggataatgagacttgctcccaggtgccctgccctggagcccagcaggccacacgggctctttgactctgtactgtgccagtgatttccaagatgggagtggtgctctgattgcaggaatgtcttcttggaatggcttttctcacttctctagagtccttggtagggagcacatcatcagctgagctaacgtgagaacaggggttggagcacttgccaccggcagtgaagtaatcggacagctgacagtcttttccagagggtcggggattgggagctgaccccaggtcccgctccgttttctttgtgtgcagcacttgtgttggtgaccagcagtgaagagagtgcgtggacgtcaccgtgtggttatgaagctaacggcagccctcagcggtgccgacttccgctccccgacacattcctgtgtgcacgttcgtgggtctgagcgtgactcatggtgtgtgtccctagagcagttcactcagaggcttctcttccgtgctctcaagaataaaagcagggccgccacatcctgataagtcttgccattcagcggtcctgtcttgcagagggataagccagtgtccccaggccacagtccttacaccttgagcaagttccccagagtgaagcaatctttctagacaagttttgcgtttctcagaattttattttagtgatattgttaccaaaagattgtaaccccaaaatgtgtgcctttggcttgcctgttttaggaattcacttgtgttatctccccaagcaaaacaaaagaaagagaaaccttcctgttgacgaatcctttttaccttcttgagagttgtcaatgggactaacttgtatatttctttgctaccttcttttaaaaacatttttcttatttactattacagacgtatagtaatggtgcctgacataacccacagccaaaggccttggccttgctgtgtgtatttcaggctttttcttcccttttctttttttttaagtaataagatattacagttatagctgaagcctgatcctgttcccttttctccctctcgtcccaagcatcaccactgtcccaaatctgctccttcttcccacatctttgcagtttgggcaagtcttctgaatgcctagtcatgattttaagtcttctttccaccttcagtgatggttggctaccctgagcaagccagtagattcagttatgtgcctggagtccagatgttttatgtggatttttcatgtggaattgtttttggtaaggaagtattcccttgccacaccaatgaaaagagaagaaaacaggtagctggcacccactgcattgttgctttctgccagcctgctccttctccttcctctccagctctgttgtgtccagatgcaaactctacatgcagggtttgaccctaggtcctcacctgctgtagctctcacacggggaccgaatgctcttgtgtcgtaaatccttccttttgcttcctcgtgttggatgtgtttagtggttttcatcttctggtcactatttcattctaggtttatcccctttaaattataaattaaatgaattcttcgcttttcctaccagcaactacccaccaagttctaccatgtgttaatttaatcaacagttatttattgagtacttattacatgttgatttcctgttctcaacattggaatgaagacagcttagggttctgctttcatgaagcttgcatgctcttaggtggagacagacagtaattaagcagataaacaggaaattatgagctagtagtgggtccattgctgagaagtaagacaggtggtaggatgacccgtgccgtgtgatgactttagattgggtggttggggaagacttcacggaccttaaaactggccttggaacgggaagcgagaactgggcacggaagatgagggagtgggagatttcaggcagagggagcagcagcaggtacagaggccctgaggccttttattgtgtctttttgcttgagcgagtaacttagagcacacgtagagaaagacagcagaagtgatcttctaaacactctgtcctgtgtggagagctccttatgtgagattttgctgtgtagtgaattaaggctcagccaaactggctcacgtgagctctttgagcttgcctgtctctgtgggctgaaggctgttccctgtttccttcagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggtaggctgggactgccgggggtgcccagggtacgtggggcaaggcgtctgctggcattaggcgatgcatctgcctggaagtctacctcctgcctgctgtccgagggcttcattggcgccacggaattgacttttccgtcttatatcattcctgtgtctttgtaggagtggaatcattctcatagtccgagtgtgtttccacatatggtgagagctgacaagcatggaggggttttggtgtaaaaagattagtcatttggagaggttttctcattttatggcaaggttcttttaaagccgtggatttccatgctgttcgtgcggcatggagatcacttcctaccgagagttaaggaggaaaaaaagatctctgagttttgaaagaagatttaaccaaaatgcatttgactcttctgtggatttttgttggctgatttggaaggcaggtgccctgggcatccccagtgggttccaattctgcagctgcccagactcctgcaggcagaggtggaagtgtccccgctagaaaggcatccaggaaactcgcttttgaccaactcagatacagtctggtctttcttgttaactgggactttaccctctccactaatgaatagtgtttgtagtttccaggcaggtttttttcttcttttgaagttctttgaaacccttaggacgccaagggaaggaagttttcattttcagccctttgcattcttcaaaatgtgatccaggcttttccctgtggcgagggtgtcccctagtgttgacttacattatttccacttgttttaaatgaactttgattaccttgacctgtgcacagaaatcaagagaggcagcccctttttagagctgttagaaaagaactgaaacatccacctctgggaaaaatagagtttagtttgtgcatgtgtctcagaagtcaggtgcacacattgagactggtgcagccacatgcctgccttttagggactccttgactgacctgatgccttcacccaaaggcatagtgaaatgggaagtatgatttctgactggtatgaagtggctgctttagagaaaagatcacattctttagtcctagaaaccaaaggtggcttcctgatgctcttattcagcacgtgcctgtctttgaggcaggactggcactggggtgggggcatggtttggggttaccttaaggaccctggatatttctcagataggactttttcttttctttttttgagacggagtcttactctgttgcctaggctggagtgcagtggcatgatctcagctcactgcaacctccgcctccccaaattggcgattctccttcctcagcctcacgagtagctgggattacaggcacccgccaccacacccagctaatttttgtatttttagtagagatggggtttcgctgtgttggcctggctggtctcaaactcctgacctcaagtgatctgcctacctcagcctcccagagtgctgggattataggcatgagccaccacacccggccctggactttttcttaattgaataaatatttatcaagttcttcacttctatttgacggttcctgggctcaacactggattagaaaatgaatgggacagagttcttcatctgagacatagggtggtccaggtagtaggaggaagaaggattgcagcgcagcagtcctcgggacaccaccagggggtgaacgaaggagggacgggggagctgtgcaggtgccccagctccttgggttgcacagggttgaagaccagacccaagaaatggggccttgaccagctcagcaaactgagaatggcctagatttcagcacactttcaccaggatttgtcaaatgaaggaagattccaagcgcaaaataccctagatttcaaccagtaaaagcttgtctgaaaacttccaagatcgggttgtacaacttgacatttgaggaaacgctacttcagtagatggtgctgtggcattgttttctgaacaactgaaggaggagactccagagaagggtacctgctggagacctgtgtggtttgtggggtgggtttcttatatcactgaatctaaagtgggtgcctttcagaatgtgctttactaataatgtgttactctgcttttaattatacttctaataatttttcccaagagcctaattaacttacgatctcacagttggtaaagaattacaggatgtcattgcgtggatttctgtgggcagtcacccggagtggtatctaattagggaaaaggcagtatgtccctttctggaagtgtgttaactgaaaatacggtactaagcaactgctaaataaattagccctccttcctcctggccgtgcgcagaaacatccctgcagtatgttgcctatttgtcaaataagattagtgtaaatatggggcatttacctttgctatagaagctgaaattgccaggcacggtggcttacgcctgtaatcccagcactttggaaggccaaggctggtggattgcttgagcccaggagttaaagaccagcctgggcaacatggcaaaactctgcctctacaaaaaataccaaaaatcagccaggcgtggtggtgcgtgtgtattcctagctacttgggaggctgacatgggaggattacctgagcccgggaggttgaggctgcagtgagccgtaatcgtgccactgcactcctacctggggagcagagtgagaccctgtctccaaaaaaaaaaaaaaaaaaaaaagctgaaatccttgagtggattctaaatcatggcagtggctaacattcagcttcatcgtgcccttgctgtgtgcctggcagagacctctgtgcttactacatgtcgcatctcattgaatcctcacaaccttaagatccttccaggttgagcatcccggaccctaaaatcccaaatcctaaatgctcccaaatccaaaactttttgagcaccggcatgcagctcagaggaaatgcatactggaacatttcagattttggattttctaatttggagtgctcatctggtaatatagtgtggatattccccaatctgcaaagatctgagctccgaaacacttgtagccccaagcctttcagttaagggacattcaccctgtatcaacattttaatgctgagaaaatggaagagagagaggttaagtgactgacctggcatcacacagccaggagtggcagcatcaggatttgaactggggcactcagctccaaagctcagctcttcttttttaaaattgaacccagattcttatttctcaaataccataaaatatttacataagccacagttatgccttttaaaaaaaaatcaccttttccccccactctcccatttacttcctttgcagtttgtggctacgatctaccttcctcttcaaaacccttgaaaaatccttgcagccttgcccaagcgtccttccctcagccgatttttgggcctcagtttcctcccatccagcctgtttcctatcgctggcttctccaagggcagagccagagtcctcttttgccagcagggggagcaagggcctacttttaaccgcaactccatagtgaacaagtcaagcaaccttgggtcattcatataccttccaggcagaaggaagacagaagagaacaggaaaaaagcaggacactaggctgacccctgcagatgggaagctggaattacagcaaaggctcattgattgggaactgcacccttgaattttgatagtattgggcaggacatagtcttgctatctgtgttaaagggaggacgtgcttaagaaaaccaacagtcaagtacaagaagctctaattttttttgaggtgggggaacggggtctcactgtgttgcccagctggcctcaaactcctggctcaagcagtcctcccacctcagcctcctgagtagcagggatcacaggcttgtgccactgtgcccagctaagaggctgcaattttttaatgaactgtattcagagtttgtacatcagtgtcttttttttctatgaatcagttctctaagtaatagaatttggaaaagaccgctggtgatctagctgtggcatttagattgactcatgagctaactgacaaatttactacttaaacagtggaaaataatgtgcaggatatatttttttgaataggttgtcccaccctcgagttctgtgtctttcctgagtccgcatatgtgaaccttgttttaaccaggtgacagcatcccataggcacggatctctgtcttctgttgtccacatcatgtgtcttggcagttgttccttattgatatacataaggttgtcttgtttttgtatggatatattttaacatgtaccagtgttcagtgggcctttctcttatttccaatattttgctgttctaaacagcagcacagtgattcccctcatttgcatgtatgtgaaactatcctggtgggtccgcttccagaaactactggatcagggaccatgtgcatttatggccttgaccatactgccagagtaccttccaaggagtttgtgtcatcaatttgcactccccagtggtgttgagagagtgcctgtttcctccacccagcacagtgtgtttcggttttatttctcccaggaaatgggtgttagttggggagctccagaaagaagccgagaagaagggcagtcgtacccttggcagttgtacgcagtggctctctggccgcacaaggagggctcggagcctgctgttgccaggttgcacttgctcttgcaagacaggcattccttgcagtgggttctcctctggccagggagatgagttctgggggctcctctacgaggtggtctctcctgggctttcctctcgagcttcaagtcccacctctggagtgtgaatcgccttcctcagtctaactctatccctccagtggtttttttttttttgctttttgtttttgtttttgtttttttgagacagagtctcactctgtcacccaggctggagtacagtggcgtgatctcggctcaccgcaagctccacctcccgggttcaagcaattctcctgcctcagcctcccgagtagctgggactacaggtgcctgcgaccacgccggctaattttttgtatttttagtagagacagggtttcaccatgttagccaggatggtctcgatctcctgacttcatgatctgccctcctcggcctcccaaagtgctgggattacaggcgtgagccaccacacccagcagtctcttcagtgtatttagctgtgttgatcctgattcatctgatgggtgaaggaatattggaaataaggataatccctgtggtgtttcactgtgcctgtaacctctctcacctagcatttggttaaccagaaacagatgtggaaactgatctatctgtagataatggccctgctcagggagggggtccctgctgagagcgagacattgaaagcctgctacacagaaactgctggaaggccaagccatttcttttttctttttctttttttttttttttttttttcagacagagttttgcccagtagttcaggctggagtgcagtggcatgatctcagttcactgcaacggcctcccaggttcaagcaattcttctgcctcagcctcctgagtagctggcattacagactcctgccaccacgcccggctaatttttgcatttttagtagagacacggtttcaccatgtggccaggctggtctcgaactcctggcctcaagttatctgcctgtctcggccccccagagaggccaagccatttttaaaaacagtgttctttttcatgctgtagaatacctgtgcttgggggtgagcaaaaaggaggaaactgattagaaaatacctatgagggccgggtgcagtggttcatgcctgtaatcccagcactctgggaggccgaggagggcagatcacaaggtcaggagatcaagaccatcctggttgacatggtgaaaccccgtctctactaataatacagaaaattagctgggcgtggtggcaggtgcctgtagtcccagctactcgggaggctgaggcaggagaatggtgtgaacctgggaggcggagcttgcagtgagccgagatcgcgccactgcactctagcctgggcgacagagcaagactccgtctcaaaaaaaaaagaaaatacctgtgagatgttgagtctgggagaatgtatctgtgagaagacaaacaaccctagtattcattaaagaaccagcctttgttttctacaagctatctgttcagtctactcaggaatagagataaactgccttaatagtaataaaagcaagcaccgctgagtgagtgctggcctcatgccaggaactgctcttggcactctgtgcacaagggagatactgacattctttctgttgtgcagatgagaaaacaggctcagagaaggtgagtaacttaccatggtcacacagcagcagagctaggtcagtataatccacaagtcattctcttaaccgctccgccataccgcccagaatgttcatctgcatctgggccagcctcgtcagtccgtgcaaagaggccagttgacccatctccctccctaacaagcacagaagagaccaggctgaaaattcatagctttcactcaaagtgtttccttcacctcattcatctgagttagctttattttactatataaagagaattttcttcagcaaaatgataggaatttttttaatgaaagtaaaggaatgtcacagaattgcgtcagggatatttccagtttaacacaactacaaacgtaggctgttttgttgttgttgttttggttttctattttgagatgaagtctcactctgtcgcccaggctgaagtgcagtggtgcgatcttggctcactgcaacctcctgctcccgaattcaagtgattctcctgcctcagcctcctgagtagctggaactacaggcatgcgctaccacgcctggctaatttttgtatttttagtagagatggggtttcaccatgttgaccaggttgttccggaactcaggtgatccaccttggcctcccaaagtgttgggattacaggcatgagccaccacactcggccagctgttgttaatagttaaaattataaattggacaaggtctgattccagcagggggagacaaattcacattgatttttctataagaaaaggaattatttgtactttcctcccttgtgtgtttgtgtgtatgtaagagagacagatgagaagagggctgcctttgagagccatgttccttttgcatgtacatacctctcaagattattacatgggtcttttagaagagggtcagtagctataaaagcaaatgatatttatgaaatgatttcattgtatgtggtttattatgtagtcttcaaaacagaaaaaccccacttgcttcgaaagcttcctttgagagctactttttaaccatattgttgatcaagcaagattcttaaagccccagtcctatacgtgagcagcattgaatccccggatactggcaggcgttcactgtccagcctttgacattagcatgtcaccctggtaaatcagagcactccatgccaaaaaacagcatggtctgctgagcacattaaggagcagagagggctcagaagaattaaacggccaatggggtggtgacagaggtgagctctttccccctcggacagcttggcatggtgactaccaatgaggtttaattgacattaagagcagctcaccatttttaaagagcgataaattgtttccaagtttcagcctcacggagccctgagctaagagataatgggctgacacatagcctcattggtcacgcttcacttgtaaacaggattggccaaagcaagaaggctgtaagtaaaggttggcccgtcctctggaagcctcccccacagcagggtggggaactggggcagccatagcaagcaggaccatcaggacacggtgtctcccaaacgggccggaacatacaaggttctacgtttaatagaaagttgatcaagccttcctctttggggagcctaatttttaagccattcactctctgttcccctgcagtcttttctctccaaactctgttgaaacttggaggcatctcgcttcctcctttggcctttgtagccaggttttcgcagcaaacagaccatatcatttaacacccacctgcttcttgttctgatagtcagttcagtagacagtagcattttttaagtcaaaaagaggcttagtgatgtaggccaaggtcaaggctctgtgtcatggggctctccccagggctcagtgccacggcacttcagacttgaccccagactgaaaagatgagaggacctgtagaagtcacggcctgtctgtcccgggcccatgctcctatctttttctcccccttggcatttagataccatggacttgttaaaatgtgacatgtactgatgatccttatgaatttgttggtaggggagctgctggtgaggattattttagactgtgagtaattgacctgacagacagtgatgactgcttcattaagagcccacgaccacgtgccagaatagttcagcatcctctgttgctactgtactttgagacatcgttcttctttgtgatgcaatacctctttcttgtcatgagggtctcttcccttaaatcaggtacatttcagattcttcaggtgatgttttttaggctgagtgtgttagcaccccttggaaaccaggttccctggggaaagtgtgtcacgtttgtggtgtttgcccgtatagctctcccacacccccacgagctccaagaggtggggaagcacatgtggcctgcctagcaggcaccagaagcaggttgtcggcacatgcaagccagctttgccctgttgcctgggggagaattgaaaagtttggccccaaaggggaaaattctttctgccatcaagttgctggtcagctgtcatggaacctgtctgcagcaatgtggctgtcacaaaacgcagcccaggacgagtatgcgctgaagctccattttgcattaactagtcaagtacttacccactgaaaagcacttcctgaaataatttcaccttcgtttttttccttctgcaggaggacaccatggaggtggaagagttcttgaaagaagctgcagtcatgaaagagatcaaacaccctaacctggtgcagctccttggtgagtaagcccggggctctgaagagagggtctcgcgccgcacccccagggtgacacaggcgctggggaagacgcacgggcggctcactgcacaaaacctcgttggaatatttgtgctctgccgacgttcagccgcgggtaaaatgaggcctgtatgggatgggtgtgtgcgtgtgtgcacatatgcacatgtatgtatgagagggagaatgtgattattttaagtggatacctaaaagcagtcaaatgcaaatctgaaattagtttctgaaacttgggcattttccagagttttctcactgaagtgattctgtaagtagacacataaccatcagacctaaccattcaggggtaaactgacggtggtgaaggtcatttgaggtggggccaggtctgcgtctgaattctgtggcagcctctccctgcgtaaattcaagttcactggcttgagaagaagaaaagagcctggccatgtccctcccacacgagcacagtctcaggatgcaggtgcttgggaccatgttggaagttgggcccaggactgaggagcagagtcagaatccttcagaaggctttttctttagacagttgtttgttcagttgggagcggagccacgtgttgaagtcctcgttgtcttgttggcaggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctggagaagaaaaacttcatccacaggtaggggcctggccaggcagcctgcgccatggagtcacagggcgtggagccgggcagccttttacaaaaagccccagcctaggaggtctcagggcgcagcttctaacctcagtgctggcaacacattggaccttggaacaaaggcaaacactaggctcctggcaaagccagctttgggcatgcatccagggctaaattcagccaggcctagactctggaccagtggagcagctaatccccggagtaaggaatatttcatttttgaaccattttgggctaagtggaatattaaatgaagttcataaaaggcgtccttcctaataatcacagtcccctctgaaagagagtactcattgttcctccggggccagcgcccagcagtaatggcctcttcctgggagccgctggcattgcttttacgcaaactcatgggaacaaccagtacatggcttttgttttttagtgtgtgtgtctttttttcctgctttctctttattatcttttcattctccacttaacttgctgtcctctgattcagggatgtttccacaattgtcagaattgtgtatgtggaggtctaaattaagtgtctttgctgttttaaaccctgaagtgttttgaccttcaaatgtgccacaattatcttggtcttcaaattctttgctggtggaaatggcttcccagcaaagcgacggcctgtgcaggacagagcctgatgggctttgctggcgtcttttatacgagatgttctccacaccaccactgtgacctttcctacccaattagctcaagtatgaaacctctacatgagatttcatagcaaggaataagggtagcatgtgtgaaatgctggcggctccttgtaagacagattttctatgctccatgagagcctgatccagatactcctggctttcaggaaagtgaatcctctgatgctgcaaattgagattgcttgacttctggtttgcctggcacggccgggtccgttccttcttcattcaagcgaacttaaaatgctttatcaaaatcctcttaggcacaactcttctgtatttaatttcactcttgttgctgacgatcaggctatctcacgcagccatcacctcaagctgctgccccctctcattccgctcttcccgtttgccttgtgatttcatggttaatgttcatgaaccaaagattagactcctacctccctgggagaatcaggaagtgagaggaagcagattatacaggagagagttttttaggatacatttgggtacacctcaggaagaaagagggaagtaggaaacacagtttgggtaaagaatgccatgggctttgttttattttgtcccatcaagtctgaataggacaagtggagatgcactctgatagaagtttcttgcaatcaaggactgggctcagtgtttgtctccgtgcctggcatagagtagcaataactgcacttactattctcgacacttcaatcaaagcacttagcatattaattaattacactcacagcaaccctaagaggtaggtgccattattatcgtcttcattttacggatgaggtaactgagtcccagggtaattaacttgctccaggtcatgaggccagggagcccgctcccagcaccagcctctccccatgttgggatctcagggtgtgtttgctgagaggctggcactgtgttaattgccgtgggcattaatacaaacttccagggcattggactcaatctttccattgtcagcattgcacctttgctcagcagtggtggatttgtgaagtggaaggttggccaggagctctcatgggtgaacattttcctttcttagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctggggtaagggctgctgctgcactgaagtggtccttcctgactacaggagggtttttttctgcctctttcttgctcttccctttcttttcttcctttctttttgtttttttgagacggagtctcactctgtcacccaggctggagtgcagtggtgcaatcttggctcattgcagcctctccctcccgggttcaagcgattctcctgtctcagcatcttgagtagctgggattataggcacccgccaccacacccagctaatttttggtatttttagtagagatggggtttcaccatgttggccaggctggtctagaactcctgacctcaggtgatctgcctgccttggcctcccaaagtgctgggattacaggtgtgagccactgtgcacagccacccttttttttttttttttaactgtgtatttggcctgaggtccaaatatggtgcacagtgtatctgctgatctgttaagtctcctctataagccccctctccatgtctttatttcccttgctgtttattgaagaaaccatccttagagtttcgtacgttctgggttttgctcattgtctcccatggtgtgatttaatatgttcctctgacttcagtattcctagtaatgggtggctggatctggaacggcctcatcacattcaggtttgactgtttctcttttagtaagagtggatcaggggagatggtgtgcccttccatcagtagatacaaaatgcttcatttatttccttccttcctttcctcccctctccctcccctcctctcttctccttctccttccgacggagtttcgctcttgttgcccaggctggagtgcagtggcacgatcttggctcactgcaacctctgccttctggtttcaagcgattctcctgcctcagcctcctgagtagctgggattataggcgcatgccaccacccccggctaatttttgtatttttagtagagacggggttttaccatgttggccaggatggtctccaactcctgacttcgtgatccacccacctcggcctcccaaagtgctgggattacaggcgtgagccaccacgcctggccccaaaatgcttgatttgctatcgtttttttgtgggggtttttttttgagtaatttttggcagttactgatatacagtgcctagatccaatagtttgctaggtattgccaggtaggaattctctaattctgtcattcctgttaagttactagtggaaacttgtatgaggagaaacagttcctcatctgtgtggttactcagtggtacagttcatgtaggaagagcagggtcaattcttgcttctttgtttttatttaccagtttttaaaataacaaattactttttctttttttttttttttttggagccagagtcttgctttttctggggtacaaagtacaggctggagttcagtagcatgatctcggctcactgcaacctccgcctaccagattcaagcaattcttctgcctcagcctcccaagtagctgggattacaggtgcctgccaccacgcctggctaaatttttttgtatttttagtaaagatggggtttcaccatgttgcccaggctggccttgaacttctgagctcaggcagtccacctgccttggcctcccaaagtgctgggattacaggcgtgagccaccatgccctgccacaagttggtttctttttttttttttttttttttttgagacagtctcactctgtcgcccaggctggagtgcagtggcatgatctcagctcactgcaagctccgccttccgggttcacgtcattctcctgcctcagcctcccgagtagctgagactataggcgcccgccgccacactcggccaattttttttctatttttgtagagacggggtttcactgcgttagccaggatggtctcgatctccggacttcgtgatccgcccaccttggcctcccaaagtgcacaagttagtttcttaatacccttcagtggtggccaattaggtttttgctgtcattggtggtattatgaactctcagatttatatatatctgatgtgtttcagtccactgcggttattttccctgttgatattcagattgtctcgtctttggccagtgggaacttcacattagctcctagtcattttgacattaactttgtagttttccatgacgtccgcgccctcaaatgacaagctattgcaggttcattctgtgccccaggcctgaatcacccatttctctaaggaatcttatcctttaatgggaaatggaattttaaggcaataatctcagatttcaaaactttcaaagatttcataagatttttatgaaatgtttagagttagaaggggctttggagatagtcttgtgcacccagaaagcagtggtggccggttaggcacagagctggttggtcacagagctaagagttaacatggccagctgacttccggcgccaggttccttctaccacatatcccagcaagatggtcacattacctaaaagaccccacagggtctgaaactcatcatctgccctcctctagcatgtttgtggggtaagtttactgagtcttgttctgtcctggtctcctttttttttttttatttttgagacggggtcttgctctgtcgcccaggctggcgtgcagtggagcaatatcagctcactacaacctccgtctcctgggttcaagcaattctcctgcctcagcctccaaagtagccaggactactggcgtacaccaccacacctggctaaattttttttttttttttgagatggagtctcgctctgtcacccagcctggagtgcagtggcgcgatcttgatcttggctcactgcaagctccacctcctgggttcacaccattctcctgcctcagcctcccgagtagctgggactataggcatccaccaccacgcccggctaatttttttgtatttttagtagagacagggtttcaccatgttagccaggatggtctcaatctcctgacctcgtgatccgcccgcctcggcctcccaaagtgctgggattacaggtgtgagccaccgtgcccggcccctaatttttgtatttttagtagagatggggtttcgccatgttggccagggtggtcttgaattcctgacctcaaataatcctcccacttcagcctcccaaagtgctgggattacaggcgtgagccaccgcacccagccttgtcctggtcttctgatgataaagagcctggtaaaatgtcagagcctgggctgctgctggggccatcccttctgaggtctgctgcaaaggtaactgattttaaatgtagtgtagtgaaatgctacacatcttgaacagcctttctctttcggttttctttcagcatttggagtattgctttgggaaattgctacctatggcatgtccccttacccgggaattgacctgtcccaggtgtatgagctgctagagaaggactaccgcatggagcgcccagaaggctgcccagagaaggtctatgaactcatgcgagcatgtaagccttcctcagcctgttctcacgagtatatgtgggcattccaggaaattcaactgtgcaggagtgtgtacacaaagttgaaagtttttccatgagctctctccattccagttcttcagatgcagctaatgtagccatttgatacctattgacctttatttacagataaatagtatgtgcgtgacttgtcttttaaagcaaaaatggtattgatagataccaaacctgggtgtattcctaaatacagattcctgggccctgccttcacagacattctgctatagtagctaagctcatgaggtgattttttttttttttttttttgagacggagtttcgctcttgtcgcccaggctggagtacaatggcgcaatgttggctcacttcaacctccacctccctggttcaagcgattctcctgcctcagcctcccaagtagctgggattacaggcatgcaccaccacgcccggctaattttgtatttttagtagagatggggtttctccatgttagtcaggctggtctccaactcccaacctcaggtgatctgcctgcctcggcctcccaaagtgctgcgattacaggcgtgagccaccacgcccagctgcgaggtgatttttatctggtcgttttatactgattacatatgtgttatctgtactatgcacacacaggatgttttcatatatcttataaggtatttatatggccatttcttacactgttttcccacacatgtctttccacgtccatatattcagatctctccctctccctacctcttatttatgtatagctgcccagtactccatttcactcattcatccggtcctcttttgatgtgcatttggttgttttacacatttgtttggtttttgcccttataaacaaagcagaaacaaatattcatgtacacgaatctctgggcactttggctggtatttctaaaagttgaactgttggttccaagaactgtgtgggttttaaattttgatacattttaccaaactgttaaaaaaggttgtgccattgtatgctccagtcagacgcatatgggagtgactgttcctggtccccagtactaggctttgtcagtctgtttagtcctcatgttagtctcattttcatgagaatttctttacttcagactttgataaccgtgaagaaagaacaagatagaaggtgagctgtttggcttagtaattttctacacctactagagcgggactgggaaaaatatatttgtaaatgcagttcttgctgtcactgtctctctggggttttacaatccatattcctgccagcatctaacgtcttttcaaattcttaatgtctataacaggacatgatgacattcatcgttttgacttgttgcagcaaaagatggttagcaggattggaatgttgctttcattctagacttttccttgagaactgctagccccgtattgctagccagatctcatggatgatctgacttgggtttcatctgtccaggttggcagtggaatccctctgaccggccctcctttgctgaaatccaccaagcctttgaaacaatgttccaggaatccagtatctcagacggtaaagtacccatcccggggtacctgcagtggggtgaaagggcagccatgtgggactgcagcctgggtcattcggttcacttcctggtgaaagttcacagaccagcctgtcctgagaccagaaagctgggcagaggtgtggagtattgtgctttcttgtctgctgcagccctgcagagttctaagaaatgctaagggctgtttctccggtatccacgtgccttttctttagttgtatgcagatgagcactgttaccttacaaagaaagagaaccaccacaccaagccaacaccagtactgatggctgctggatttttgtttctgtccctgtatgattcttagaagtggaaaaggagctggggaaacaaggcgtccgtggggctgtgagtaccttgctgcaggccccagagctgcccaccaagacgaggacctccaggagagctgcagagcacagagacaccactgacgtgcctgagatgcctcactccaagggccagggagagagcggtaagtcccccgcttcccccaaccccactgctcttcccttccctgccagaggctacattcaggccatcataggccaacgggaagctgtgaatggagcccgcacagaagggcagccatggcctttgtcaatggttcagcttcggaaggaggaaggttctcctctccccacctgcctcctatcccctccctctgagagtccccgaggagcataggctccagcagtgagttcagtcctgtaggcagaggtgcttctgaagcccgccaaggagctagcccatctcccacctattacccgcggcatctgtggttgctgtctcagagcagattcaacaatagtaagcaccaggctgcgtgacaagcagctcacggtgaaggcactgatgtgagaagctcgctgcagccaggtggaaccaggacacgcacatggacagaacccgtgtcctggtggtctctgggaagagcatctttctggtgccattgcctaggcgagcaagggagttgggatcagctcaggagggggtctcaagacactagcaaaaataataatggccaacatttatgtagtgtgcctactacaggccaggctctgttctatgttcatggttgacccccagaaccagcagtccaggttctgctgcagaccagctgaacaaaagcattgaggggtgtattagtctgttttcatgctgctaataaaggtatacccaagactgggtaatttataaaggaaagaggtttcaccgactcacagttccacatggctggggaggcctcacaatcatggctgaaggtgaatgaggagcaaggtcacatcttacttggcggcaggcaagagagcttgtgcaggggaagtccgctttataaaaccatcagatctcgtgagacttattcactaccacgagaatgtgggagaaacctccccatgattcattgatctccacctgaccccaccgttgacacgtggggcttattacaattcaaggtgagatttgggtggggactcagccaacccatattggaggtggggggtaggccaagcatctgggttcacagaggatcctggggatggcaatggtggactccattctaatggactgcagactgggtacatgtgaagggactggacaaagccctacttcttgaagatttatggtgggatgtttactgacagcagaatctataaacctgagttttatcacgtactctcattagtaaaaaaaaaacaaaaaaaaacagaacatgcagcccatatatatggtatataaagtacgtatgtccactactgtaggagtagagtgcgtatgttatgtaccaaaacgcacatttaaaaggcttgcatgctaaataagtccaaatttgcaatacttcccgccccgctgggccatctcactcacctacttggaggttatggcgtatagactctccagaatcttccacccttcctcctcttatcggttttcctgatttcaggtggctgagcagtagggaggagaggcctctgggaacgctgtgcttattaagaacccagtgatcagcagtcatgttcatttacgcccgtcagtttcatctgaggggtattttgatagtgatctcttggtgagccgagggtgtcaattaactgctcagtgctgaaactgagtggtgcataattcattgcaatttcactctcctggcctccttccactagattaaagttttgggagggctttggtgttccctgattcagatgtcccgcgtgctgccttgggttctgataaatgcatactggtacctctgttgagttacaggtgccaacagaaaacctcttcttgcaagctgacctctgagggagaattctgttactcactagcaggagcttggcaacaccaaaaagatttccttttttttttgagatggagtctcactctgttgccaggctggagtgcaatggcatgataccagctcactgcaacctccacctcctgggttcaagcgattctcctgcctcatcctcctgagtagctgggactacaggcgtgtgccaccacacccagctaatttttgcattttttagtagagacggggtttcatcatgttggccaggatggtctctatctcttgacctcatgatccgcccacctcagcctcccaaagtgctgggatgacaggcttgagccaccgcgcctggctaccagaaagatttcttatgagctatgattcatatttaaagagtgcccattaaaaaactgttggccgggcgtggtggctcacacctgtaatcccagcactttaggaggccgaggtcagcgaatcacaaggtcaggctcccgtggcacaagctgggggctgcccccaccccatgctccccagaggagcacccaagcgtctgggctcagacaggcctggatctgataaccggctctgatgccaccatccctgaggccaggcaagtcccagccgggctacagcactgttgtgagaatgcagatgaggttgtaaaggtgaagcacgtgtcacgcttctctcaataaagccatcattgctgttaggattgtcattaggaaaggctttgggccgggtgcagtggctcatgcctgtaatcccagcactttgggaggccaaggcgggtggatcacctgaggtcaggagtttgagaccagcctaaccaacatggtgaaaccccgtctctactaaaaatacaaaattagccaggcgtggtagcgggtgcctatagtcctagctacttgggaggctgaggcaagagaaccatttgaacctgggaggcggaggttgcagtgagctgagatcgtgccactgcactccagcgtaggcaacaagcgagactccaactcaaaaaaaaaaaaaaaccacacacacgctttggtctctttccctgaagatgggaacaaaaagctggacggccctggcctcttcatccctgcactggtttacttgaaggcagcagccccccacccacccacatcactctctagtgagtataaaaacgatgacaaggccaagcaaagggtcaaaacctgtggctctcctgccagccagctagccgagaggcctatgaggagctctgggaataaggggctgtgtcccacagtggggaagggacaatgggccattatgcacaggagataagaagggatgacctttgacaatttttttgtttgtttgtttgtttgttttgagatggagtctcactctgtctcctgggctggagtgcagcagtggcactctgcctcccgggttcaagcgattctcctctgtcagcctctagagttgtctggagttgtcagctcttccccttgcgtttcagatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgcctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagctggaaagggcagtgccttagggacccctgctgcagctgagccagtgacccccaccagcaaagcaggctcaggtgcaccagggggcaccagcaagggccccgccgaggagtccagagtgaggaggcacaagcactcctctgagtcgccagggagggacaaggggaaattgtccaggctcaaacctgccccgccgcccccaccagcagcctctgcagggaaggctggaggaaagccctcgcagagcccgagccaggaggcggccggggaggcagtcctgggcgcaaagacaaaagccacgagtctggttgatgctgtgaacagtgacgctgccaagcccagccagccgggagagggcctcaaaaagcccgtgctcccggccactccaaagccacagtccgccaagccgtcggggacccccatcagcccagcccccgttccctccacgttgccatcagcatcctcggccctggcaggggaccagccgtcttccaccgccttcatccctctcatatcaacccgagtgtctcttcggaaaacccgccagcctccagagcggatcgccagcggcgccatcaccaagggcgtggtcctggacagcaccgaggcgctgtgcctcgccatctctaggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgacagcaggcagtggtccagcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccgtgacagtggctgacaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgcatttcgggaagggcatgcacgggcatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaaaggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctgcgcacaggtgggaggaaagggcctggccagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagatacgggggctgtgactctgggcagggacccggggtctcctggaccttgacagagcagctaactccgagagcagtgggcaggtggccgcccctgaggcttcacgccgggagaagccaccttcccaccccttcataccgcctcgtgccagcagcctcgcacaggccctagctttacgctcatcacctaaacttgtactttatttttctgatagaaatggtttcctctggatcgttttatgcggttcttacagcacatcacctctttgcccccgacggctgtgacgcagccggagggaggcactagtcaccgacagcggccttgaagacagagcaaagcgcccacccaggtcccccgactgcctgtctccatgaggtactggtcccttccttttgttaatgtgatgtgccactatattttacacgtatctcttggtatgcatcttttatagacgctcttttctaagtggcgtgtgcatagcgtcctgccctgccccctcgggggcctgtggtggctccccctctgcttctcggggtccagtgcattttgtttctgtatatgattctctgtggttttttttgaatccaaatctgtcctctgtagtattttttaaataaatcagtgtttacattagaattcttggcagattgcttcggcctgtgatcctgccctgttgttctgagcctgtgcggtggcggggccgggatgtagtgggttctggtttcccgacggggctggggcccggcatcaggtcttacagagcagaacggtggcaggttgcccccagctgcccagggcctctgcggcctgggtgcccacagccatctttcaggcacttgccctgctatgctcggaccctttctgtacccttggcgcttacctgctggcagcctggccccaccggcatcactgggagtgggctgtgccaccatacaagccacatctgactggcggtatcaggctgtcgcagcgacgtggaagtggggtgaggaggtcacgtcccgtgcttcttgctggctgagggcaaatccctccccacgtgcgcctgttctctctccacctttccgccctaagcccccaggtgcccttactcactcatgttccttgagccaggtgtcttaggtctttgtgtggatgaggaggagcggaggtgtgaggtgtgctgggccttcagggcctgggaaggccatcccagactgagccccaccgccctttcccagctcagtccccaccgagctgacagcttggaaaggggcggttgggaagtgagtagcaccctctgataatgatactgatcaggccagcaggtttgtcaggggtgcacatcctgctcagcagagcatatgaagatcacagcttggtgaagctccactcgagagacctggagcgagactgctgtgcggtgggtgacaggtggaactccagccgggccggggctggtggagcccactgcgagcagtgccaggcacaagattctccccctctcatttcacagggacaaaaccaggctggggcccccaatttccttgccggttgaaccatagctggccaccagatccaccaagcctggggcttctcttgtcctttgaatggctgcttctcccaggtctgaacgaagacataggacaactctggtgacagccacagctggtggccgcttcctcgtgtcagatgtggacggtcaccccgccctcccagcgctaagcgctgagactgcgtgtccagagtcggctcctgcacgtgaggccaattggtcacactgggccagtgtggaggaagacgcctctcatctcccaaatggggatctttcatgggtgtcacctgagcttatagagcttagtttagtctagccattccaagacagtggtttcttaaccttttctaggtcacaaaacctcctgagaacctaatgaaaactggatcccagccccagaaaaatgcacctgtgtgcacacacccagcagtttccaggtcatttcaagtcctgccttcgaggtccattgttattatttacaaaacaccagcctaaggtattggacattttcttaaaaggccaggcaaggtggctcatgcctgtaatcccaacactttgggaggctgaggtgggtggattgcttgaggccgggagttcaagaccagcctgggcaacatagaccccatctcacaaaaaatacaaaaataagctgggtatggtggcacctgtagtccagctactcaggaagctgaggtgggaggattgcttgagcccaggaggtggaggttgcagcaagctatgatcgtgccactggattccagctccagagtgagaccctgtctcaaaaaaaatttttttttcttttttctttttgagacagagtttcgctcttgtctcccaggctggagtgcaatggcacaatctccgctcactgcaacctctgcctcctgggttcaagcgattctcctgcctcagcctcccgagtagctgggactagaggtgcgcaccaccagacccggctaatttttgtatttttagtagggacggagtttcaccatgttggtcaggatggtctcgatctcttgacctcatgatccgcccaccttggactcccaaagtgcttggattacaggcatgagccagcgcgcccggcccaccac

SEQ ID NO: 12670 - DNA, 87523 bp, Human
cgcaccctgcctattgtaccatatttagtttcccaattttttgctatataatattccatgaatatctttgcccaaaatttttgtagattgtttctaagaatagttcatcagcattttaagacatcctattaatattagcggactgcaatcagattgaagtagttcacaaatagatgggttttagcctgtatttgttcaatactgaactattgtatgtatcaggcactgttatgtatcaggcactgttctcagcacttgtaaaatgtatatgtgctgctgacaagcatgagcacttgtaaatgaacaaactaaaatccctactcttgttaaagtgggggaggtgaagaattttaaaaacatcttttttcgttcaaccttctcccacaacttatctttcattctgctaatggaaaatattacttttgttcttaaatatgaagcttttgtgtgtaaaaagtattagaatctcatgtttttgaacaaggttggcagtgggttgggaggagggattggagattgatgcgataggaatgtgaagggatagcttggggtggattttattttttaattttaatttttattttttgagatggagtcttgctctgtctcccaggctggagtgcagtggtgtgatctcagctcacgggttcaagcgattctcctgctgcagcctcccgagtagctgggattacaggagcgcgccaccacacccggctaatttttttgtatttttagtagagacggggtttcaccatgttggttaggctggtctagaactcccaacctcatgatccgcctgcttcggcctcccaaagtgccggaattacaggcgtgagcgactgcacccggccgcttgggggtggatttttaaagaaactttagaagaatgtaacttgcccagataccatgtaccgttaatttcattttcggttttttgaatacccatgtttgacatttctccgttcaccttgattaaataaggtagtattcattttttagttttagcttttggatatatgtgtaagtgtggtatgctgtctaatgaattagacattggtactgtctttaccaaaactggacaaagagcaggcagatgcaaaaatcaagtgacccagcaaaccagacacattttctgctctcagctagcttgccacctagaaagactggttgtcaaagttggagtccaagaatcgcggaggatgtttaaaatgcagtttctcaggttctcgccacccaccagaagttttgattcattgagtggtgggagagggcagagatatttgcgattttaacagcattctcttgattgtgatgcagctggttcgcaaataggtaccctaaagaaatgacaggtgttaaatttaggatggccatcgcttgtatgccgggagaagcacacgctgggcccaatttatataggggctttcgtcctcagctcgagcagcctcagaaccccgacaacccacgccagcgctctgggcggattccgtcaggtggggaaggccaggtggagctctgggttctccccgcaatcgtttctccaggccggaggccccgcccccttcctcctggctcctcccctcctccgtgggccggccgccaacgacgccagagccggaaatgacgacaacggtgagggttctcgggcggggcctgggacaggcagctccggggtccgcggtttcacatcggaaacaaaacagcggctggtctggaaggaacctgagctacgagccgcggcggcagcggggcggcggggaagcgtatgtgcgtgatggggagtccgggcaagccaggaaggcaccgcggacatgggcggccgcgggcagggcccggccctttgtggccgcccgggccgcgaagccggtgtcctaaaagatgaggggcggggcgcggccggttggggctggggaaccccgtgtgggaaaccaggaggggcggcccgtttctcgggcttcgggcgcggccgggtggagagagattccggggagccttggtccggaaatgctgtttgctcgaagacgtctcagggcgcaggtgccttgggccgggattagtagccgtctgaactggagtggagtaggagaaagaggaagcgtcttgggctgggtctgcttgagcaactggtgaaactccgcgcctcacgccccgggtgtgtccttgtccaggggcgacgagcattctgggcgaagtccgcacgcctcttgttcgaggcggaagacggggtctgatgctttctccttggtcgggactgtctcgaggcatgcatgtccagtgactcttgtgtttgctgctgcttccctctcagattcttctcaccgttgtggtcagctctgctttaggcatattaatccatagtggaggctgggatgggtgagagaattgaggtgacttttccataattcaggtgagatgtgattagagttcgatctgcggtggtggcagaggcttacaagaaacactaacgggacatgggaaccaattgaggatcagggaataaagtgtgaagttgactaggaggttttcagtttagaacatggcagagacattctcagaaataaggaagttaggaagaaagacctggtttagagaggagggcgaggaagtggtttggaagtgtcactttggaagtgccagcaggtgaaaatgccctgtgaacaggactggagctgaaaacaggaatcaattccatagatttccagttgatgttggagcagtggagaagtctaagctaaggaaggggaagaggaggccaaggcaaacacttaggaacacttgcaacgagggggtggaagaagagcaaggagccagctgaggagaatgagtgtggttggagaaccaccacagcgcagggtcgccagagctgaggaaggggagggaagcttcaggaaggaaaaggttggcagggattttgagtgttaggcctggtgtagcagaaggaacagaagatttagagcagcgctagccaatagaaataaaatgtgaggcccggggcggtggctcacgcctgtaatcccagcactttgggaggccgcggggcggatccttgagctcaggagttcgagaccagacaacacggcgaaaccccggctctacaaaaaattagctgggcgtgggggcgcgcgcctgtagtcccagctgctcccaagcgaggctgaggcaggagaatcacttgaacccgggagaaggaggttgcagtaagccaagattatgccactgcactgcagcctgggcaaaagagtgagactgtctcaaaaaaaaaaaaaacctgttttgtttttcttttggagaaaaggcatacaaatttattagcatgcagactgggagaaccacaaggtgattatccctattttaaattttctaataaacatactattatttatttatttatttatttatttatttatttattttttgagacggagtctggctctgtcgcccaggctggagtgcagtggcgcgatctcagctcactgcaagctccgcctcccgggttcacgccattctcctgcctcatcctccccagcagctgggactacaggcgtccgccaccacgcccggctaatttttttgtatttttagtagacacggggtttcaccgtgttagccagtatggtctcgatctcctgacctcgtgatccgcccgcctcggcctcccagagtgctgcgattacaggcgtgagccaccctgcccggccggctatttatttttttagagatgggagcctcactatgttgcccaggctggtcttgaactcctggagtcaagtgatcctcccgccttggcctcccagagtggtgggatacaggcacaagccactgtgcctagccataaacacatttttaaaggtaaaaaaaggccgagcgcggtggctcacccctgtaatcccagcactttgggaggccgtggcgggcggatcatgaggtcaggagatcgagacatcctggctaacacggtgaaaccccatctctactaaaaaatacaaaaaaaaaaaaattagccgggcgtgatggcgggcgcctgtagtcccagctactcgggaggctgaggcaggagaatggcgtgaacccgggaggcggagcttgcagtgagcggagatcgcgccactgcactccagcctgggcgacagagccagactctgtcaagaaaaaaagaaaaaaaatgtaaaaagaggctgggtggccgggcgcagcggctcacgcctgtaaacccagcactttgggaggccgaggcgggtggataaccagatcaggagatggagaccatcctggctcacgcggtgaaaccccgtctctactaaaagtacaaaaaattagccagacatggtgccaggcacttgtagtcccagctactcgggaggctgaggcaggacaatggcgtgaacccaggaggcggagcttgcagtgagccgagatcgcgccactgcactccagcctgggcaacagagtgagacttcgttttttttttaaaaaaaggctgggcacagtggctcacacctgtaatctgccagcactttgggaggccgaggcaggtagatcacctgaggtcaggagttcgagaccagcctcgccaaaatggtgagaccctgtgtctactaaaaatacaaaaaattagccgggtgtgttggcgtgtacctgttatcccagctactcgggaggtgaggcaggagaatcgcttgaacccagaaggtggaggttgcagtgagccgagatcatgccactgcactccagactgggctacagagcgagactccataagaaaaaaagaaaaaaaaggggggcaaaaagaaacagatgaaaccaatgtgaataatttattttaacacaatatacctaacatatttttatttcaatatctaaccagtataaaaatttacttgttttgccctctagagatagtaagctccttaagtaaacagaagtaatacctgattaattagaattcccaaccctcatcaagtgtgtgcttatatagaagaaacccagtaaatgtttgttgattgaaagatattaatactcttgcttggatgagagtgaggaaaaaggtattagtattggcttttcacaacgccttgtacggtttcttgtttaagttgatcaaagcaaaagaaagactgcaggcaatgctaaatataacaagtgatttacaaattaattagacgtaaataatcatttttcattaaaaattagttgtattctgtccatttcctcagaattttagacaatgattttgaataatcatatctcccttatagagttattgaaattaaataacttattgggaaagattctttataattatacaaaggtatataggaccatagtctcatatccagagttctgaaatccgaaaactaaaaggtttttctttttttgctattcttttttttttttttttttttttttttgagacagagtctccctctgtcgcccaggctggagtgcagtggcacaatctcagctcactgcaacgtccgcctcccaggttcaagtgattcttctgcctcagcctcccgagtagctgggactacaggcgtgtgccaccacactgggctaatttttgtatttttagtagaggtggggtgtcaccatattggccaggctggtctcgaactcctgacctcgtgatccacccgcctcagcctcccaaagtgctgggattacaggtgcgagccactgcacctggccaaggttttttataactaatttaacagcaaaatctggcctagttatcgtctttattttctttttttaatgtgatttaaaactattcatttgtttcactatagcttaataatttgtttgcttttctgcttctaagaccctgtaggggcattatataacttctggcatttgcatagtacctttacaaaatccaaaaaaatctgaattctaaacacatttagtcctaaaagttacagataagggattctggacttgcgattctaagtctttgttcgtttttattgcattttctgagccaacataaccattatttaaaaacaagttgctatagtaactctacattacagacctcccccaaactcagcagttcagagcatgtattctcactcagggctctgcttccttgtaggtagatgtgtggatcggtgagggcagttcttatttgtatgccttattctggggcccaggctgaaggggcagtggctatccatgataagcttttctcaaggcaccagcagaagtacaagaagtcaaggccaactgcataagcatagttcaaatgtctggttatgccacatctgctaagattgcattgaccaaagcaagtcacatgatcatgcccaaagacttaggagtgggtagtagactgcaaccaccatgcagccaagcaaactacagagccaagcctataacatcactggagagaggtgtattcctcccttggccaggctgggggagggagtgaatattggctgaataataatctaatctaccacagatggttaacagaggtggagtgggatggaaggagaaaaaaaaaaaatcaccaaatgggatgtatcactacccttgctctttttagcgtctgctgctttcacaaagccttttatagggctggagaaatgatttgctcctagtctcttaaaaaccagaggagtcttttgaggatgtattcctaaagtttttaaattagtttaaaaattttttttattaatttcaattataggctgagcacagtggctcacgcctgtaatcccagctaaggtggtggatcacctgaggtcaggagttcgagaccagcctggccaacatgctaaatgaaacccccatctctactaaaaatacaaaaattagctgggcatggtggtgggcgtctgtaatcctagctactcaggaggctgaggcaggagaattgcttgaacccaggaggtggaagttgcagtgagccatgatcgtggcattgcattccagcctgggcgacaagagtgaaactacatcttggccgggtgccgtggctcacgcctgtaatcccagcactttgggaggcagaggctggcagatcacgaggtcaggagatcgagaccatcctggctaacacagtgaaaccccgtctctactaaaaatacaaaaaattagccaggcgtggtggcgggcacctgtagtcccagctacttgggaggctgaggcaggagaatggcctgaacctgggaggcggagcttgcagtgagctgagattgtgccactgcactccagcctgggcgacagagggagactccgtctcaaaaaaaaaaaaaagaaaagaaactacatctcaataataataataatttcaattataggttggaatttagagttcggttacatttactattggatgtgatcctttaaaaactcaagtagaggcttttccagcccattcataacattagaagttgggccgcctgtccagggagaagctttcaaagtaacactgaggctgattaaatacttttgtaaaataaagaataaatcacaagctcattggcacttgaaacttagcattgcagtgcagatgcagcagaaaatacttgtagcagttttctcagtgaaagagaaactagtcaagtagcttagagacattaaaacaagccacaagccctttgtgctagagatcatggttaaaagtcccctgaagatgtttttccacagtagaaattttgtttatatttatgtctgagagtgaaaaaagaaaatggaatcaataagtaaccatgttctgcaggagtttgaggttttgttgttacattgggatgtagtgagagaagaaaacgtattaattcttttctgttggtactttcttgaattacatttttaataaacttattgtgagattctgaacattgctcctgtgataatttctgaagtgctgatgagtagaaggttttctggttagacttctgttcagcacatctgagcttcgagattatttgtagttctcctggggcttttaaaatctctttgtatataatagataaatgctagtttcccatcagagaaggatttctttttccttttgtctgattgagcaagtgtcttgagattaagaaaatggatgtcagtgaattcaagtgttgtgctctgtcagtttgcagcaggtgaccagagagcaaaaacaccaaagtagattctgtccctactcccacctactcctcaattcgggtcccatgaaagatcctcagatctgggtaactgttgttgtttttgttgttcacagggctaagaatgttcatggctaagaatgttaaaaagtctcctagtgtcttttgccacgctgcctgaacagtggggtcattgaccgccatgcaatcctcaattgttttcagctgatactggaccgaaatcaaatctagctttgcctgcccctttctttgtaccagtagcgcttgtttgttcaccaggcctgactgaagacctagccctgttgcctgcctctgcttcctaccgagccccctgtaaagagcagctctcccagggaggctcaccttgtagcattgtgatctttggaagcatcaagggaggcacaagatttctctgggtgaactggaaaagacttgggctgggcatcagaagacttgggttctgcaactggcattgtttacactctctctgtaactctgtgcaggcaaaatctttcaccttttctgagtttttttttacatgtcagtacagattcctttcctcatgaggtttctttaagactcaaatggaagaatagatgtgaaaagaactttgaagatagtattggaaaatgctaaagtgactgctgtgttattgatgatttttatgggatttgtctgagaaagctccagtgtgaccagtttgtaccagcttgtatggtttcttgtaataaccgaacagatcctgttagcatagggtaaaaatggaaactacttcttttaaaatgaccagtggctgcagtggctcaggcctgtaatcctggctagttgggagactgaagtggtagggttgcttgaggccaggcaagaccagcctgggcgatacagcaagaccctttctctaaataaaaaactagccacccatgtagtcccacctgcttgggaggctgaggtgggaggatcgactgaggccaggagttcaaggctgcagtgagctatgattgccactgtactccagcctgggtgacagagtgagaccttgtctcttaaaaaaaaaaaaaaaaaaaaaaaaaaagatttgcattatagcttatctttttttttttttttttttttttgagatggagtctcactctgtcacccaggcaggaatgcagtggcgtaatctcagctgactgcaacctctgcctcctgggttcaagcaattgtcctgcctcagcctcccgagtagctgggactacaggtgcacgtcaccatgcctggctaatttttgtattttttggtagagatcgggtttcaccatgttggccaggctggtctggaactcctgaccttgtgatctgcccaccttggcctcccaaagtgctgggattacaggcgtgagccactgcgcccagccagcttatccttttttaaaaaaacataaatactaggatattgagattattgaaaatgcttttggtgcttcagttttgaatttatacttagagcagtttttgaagtttaagatctcatttacttctaagtaatagatttactagtaatcaaaatcgcttcaaaataccgtaatcctcattgctgtaaactcctacggggcaggtttggagttttataaagaggcaatatagtgtactctgtgaattccaactcctcacttgccagatgtgaccttaagcaagtgaacttctgtgtgccacactgttttcatctgtaaaaggataaagggaatatcataaattagtttgttaagccttagtttaataatgtctctaagttttacatataagtagacagtgtctttcttgtttagtgaataatcattcttattatttaatagtatctctactaaatttattgtgtaagattatactaatcttgtttagtgcgtggtaatcacttctgctcatatttaacctataagcataatatagtttatttatataccatttatttattttattttattttttgagatgcagtcttgctctgtcacccaggctgcggtgcagtggcgcaatcttgcttcactgcaacctccacctcccaggttcaagcgattctcctgcctcagcctccttagtagctgggattacaggcacgagctaccatgcccagctaatttttgtatatttagtatggacagggcttcaccatgttggccaggctggtctcgaactcctggcctcaaatgatctgtgtgcctcagcctcccatagtgctgggattacaggcatgagccactgcgtccggcctacttaccttttatttttgcttgcattaccctttctttgccttgtttcatttggctaagactgtcttgtttacttgctttgcttctgagggattatatgagagttctatgggtttttccataatggagtgtacttttattattttattatttgtttttttgagacagggtctcactctgtcactcaggctggagtgtagtgatgcagtcactgctcactgcagctttgactttcttggctccagtgatccttccacctcagcctcctgagtagctggaaccacaggcacccaccacccacacccagccaattttttttgtatttttagtagaaacagggtttcaccatgttggccaggctagtcacgaactcctggcctcaagtagtaacacccatctcagcctcccacagtgctgggattacaggcatgagccaccgagcccggcctcatgcaatttattgactacttcactgaaagtgaacttgtatggatactcaaaaagtacagtttgtattgaatacatattgtttttgcatcatactaaagctgaacagttctaaactgaactgtcatcagggaccgtctgtattgtgaaatcttaattttgtccatattaaaagacaggaacagggctggttcgtggtggctcacacctgtaatcctagcactttgggaggctgaggtgggtggatcacttgtggtcaggagtttgagaccagcctggccaacatggtgaaacccagtctctactaaaaatacaaaaattagctggacatggtggtgcacacctgtaatcccagttattcggggggctgagacacgaaaattacttaaacccaggagttagaggttccagtgagcgagatcgtgccactacattgcagcctgggtgacagagcaagactgtgtctcaaaataaagacaggaacaaaggtatcgataactcttaagtataggttaaattcccacaaaaatctagttttaaaaaatctttttttttttttttttttttaaaaacagagtctcactctgttgcccaggctgagtacagtgacgagatcttggctcactgcagcctctaattcctggactcaagccatccccccacctcagcctcctgagcatttgggactacagatgcatcccacctgcacccagctaattatttttttgtagagatagtgttttcctatgttgcccaggctggagactgatctgcaactcctggccttaagctctttattttttaagcaaatttgcactgttttcaattaatatgaatttgcatttcgctgatctcatgctagctgacaatgggctgaaggtgaggggaggagaaagatggacatggtacataaaagcatgtatgataaagtggaatgtcaccttggttaaaaatgtgtaatgatttgaatgatacaaatataagtagttaagggttattttgaacttgatacctttgctggaggaaaaattactttatgcatttttgatgaaaaatcattagaagaaaaaaaatggaatatttagaggaaagagtatcctgatgttaaaagtgaaaatgaaataggacattgagaaaatttttttatgtaaatgtgtatatggtaatgtattaattagcgttaggtatgtacacggatttttgccttctatatttctgaaaaccttctgtgaaaaggaagagttgaaatcataaagaattggctgatggaaattaaggtagacaggcaaatgggaatgtggcccccctaggagggtgaactctgagagacacagtcatccctgtaaataaggctgcgccaagatcaaaggagaggtctgaggctgggagtcaggagtcagccattcttttttttttttttttctgcaacctccacctcctgggttcaagcttttctcctgcctcagcctcctgagtagctgggattacagatgcgcgccaccacacccggctaatttttgtatttttagtagagatggggtttcgccatgttggtcaggctggtttcgaactcctgacctcgtgatccgcccgccttggcctcccaaagtgctgggattacaggcatgagccaccgctcctggctgagtctgcgatttcttgccagctctacccagttgtgtcatcttaagcaagtcactgaacttctctggattcccttctccttttgtaaaataagcatgttatctgtccgtcctgccttgggcattgtgataaggataagatgacattatagaattttgcaaaattaaaagcgctagacaaatgattttatgaaaatataaagattaggttgaatttggtcagcatagaaaaaggaatgttgagaacattccttaagattactcagctccctttgctggaaatcagaagtcattaagtatctttgtggttgaaaatgtttggtgtctcaggcggttctacttattgctaaagaggtctaccttgagcttatagtaaatttgtcagttagttgaaagtcgtgacaaattaatacattcctggtttacaaattggtcttataagtatttgattggtttaaatgaatttactaggatttaactaacaatggatgacctggtgaaatcctatttcagacctaatctgggagcctgcaagtgacaacagcctttgcggtccttagacagcttggcctggaggagaacacatgaaagaaaggtttgtttctgcttaatgtaatctatgaaagtgttttttataacagtataattgtagtgcacaaagttctgtttttctttcccttttcagaacctcaagaggctttgttttctgtgaaacagtatttctatacagttgctccaatgacagagttacctgcaccgttgtcctacttccagaatgcacagatgtctgaggacaaccacctgagcaatactgtacgtagccaggtacagtgtcagtctctgaaactgcctttgccagactggattcacttatcatctcccctcacctctgagaaatgctgagggggctaggcaggctttctctactttaccacatttataatatatttggtgaacttcagctgattgctggaggacacagggctgtttaacacataggtgttgatacagttcctacctaattcacatatcaccacctcagttgaagccttctccagcttcccaaggtgtgcagcgcctcatagttcatgttgtttattattttacctatcttgctcttattcttctacggctgagtccattttatttactgtattcattacctaacagttccttttagtgctcagtaaatattcattatgattgtacaatgcaaggataagtgtagaagttctaagggttcaaaggagggattcaggaaaagaacgtaatctgtgctgtcggacaaagagattcctcaccagctacatacacagacatgaaatttgactgcaactctactagctaatcatcataaagtgagagcagaggccaggcacggtggctcatgcctgtaatcccagcactttgggaggctgaggcgggcagatcacctgaggttaggagttcaataccagcttggccaacatggagaaaccccatctctactaacaatacaaaaattagccgggcttggtggcaggtgcctgtaatcccagctactcaggaggctgagccaggagaatcgctggaacccaggaggtggaggttacagtgagctgacgtcgcgccattgcactcgagcctgggcgacgagcgaaactccatctcaaaaataaataaataaacaataaataaatagagaaaaagaaagaaaagaaaagagagagagcatggatgtcctgtgagacagttggagtatctataggatttttagaggtggacccagaatagaggaaaacacaaggccaactataagctatccagttgcactaggtgtggggtcagattttcctctgttaggaccagagagcagagctaggaacagtggtggaagttaccaggcaataaggtctggatcaataaaaagaactttctcatagcctggcatggtggtgcatgcttgtagtcccagctactcaggaactcaggaggctgaggtacgaggattgcttgtctaagagtttgagtccagcatgggcaacatagagaggttctgtgtttttttttttttaattttcccacagttatggtacatctgggctgccttgtaggcttgtgtgtacatttcactacaaacagtcacaaaaggctggaaggccactccagcaagatctgtagaggattagtccgtgaattccgcagttgaactagagcactgaatggcgtggaacttccttttacactctgaagatttaggattcttcacttttcccatcagtaaaattaggtaatttactagataatttgaaaattctttcccagctgggaagttttgatgtgcccagaagctaggatgggcagttgtccaggtttgtttaaaactagaggttctagaacacaggactttcagttttaaaattgggacagtcctgagcagtaggatcaagtcagttgtctaccagagtataatcaaattgaaataattttggatctgactaaccaagtcttattcaattagttgacattgttgtttaacttcgagtactattacagttctatattgttatagttcaaatagaagataacatctaaagcatttctcattccaaaggttaaatcttgcctttagcttcatttcttcaactctaagcaaatactgtgacgagctgctatagcctggaaaatagttttccttttgtgggctgctgtgcataatctcattcatagtaaagggatttgaagtttgatgacagaatagtcagagagctgaagttgtgtttgtttttttagcccaaatatttatttctcaagtttttgttgtgaaatgtttctagcacatacagaaagtatggcacataatgtaataggcacccatgtacctatcacccagctttattaaaccttaacatcttatttgctgtttttttgataagctttttttgcttctattgcttattgatcctacactaaatgaaatcctaactaaacaaaacaagattttgcatttaatttgaaaagagactagttatatgacaaaaaattgcagataaaattgaagtgctcctcccccattctttttcctcttttctcaggatagttactgtcctgaattgggtatttaccatgtttaataaaattgagtattaggcttactataatatttatgtacataaatcgtatcgcattatgtaatacacttggcatgttttaaaactttaggctgggtgtggtggctcacgcctgtaatcccagcaatttgggaggccgaggctggtggatcacaaggtcaggagttcaagaccagcctggccaacatggtgaaaccctgtctctactaaaaaaaaatgcaaaatttagccaggcgtgatggcaggcacctgtaatcccagctactccagaaactgaggcagagaattgcttgaactctggaggtggaggttgcagtgagccaagattgcaccactgcactccagcttgggcaacagagtaagactctgtctcaaaaaaaaaaaaaaaaaaaaaaagccaggtgcggtggctcacgcctgtaatcccaacactttgggaggccgaggagggcggatcacgaggtcaagagacagaccatcctggtcaacatggtgaaaccccgtctctactaaaaaaatacaaaaattagctgggcgtggtgacacgcgcctgtagtcccagctacttgggaggctgaggcaggagaatggcatgaacctgggaggcggagcttgcagtgagccgagattgcaccactgcactccagcctgggcgacagagtgagactccatctaaaaaaaaaaacaaaaaaaaactttatgtggtttatgtctgaaagttgaagagaatttccacatatatgttagtatatgttgcaaaagagacattcctatgtagaattttgggcattcatgtatatgtagatgcatgtagctctagcatttgttttctcttgtgaatatataaaaataattctgtttacaaacatttggtaggttccagtttttcacaataactgacagtgctgcagtgacatactaattcattagtctgtgtgcacttgtgtgagtttctcaaagatagttgctgtgattggatatatggatcttagaactattttagagattgctaggattcttccaaagtgtatattgcaggccaggcatggtggttcacggctgtattacatctatctcagaaaaataagagaagaaaagcatgggtgatcttggtgatttccccctttcattttctaaatgttctataatacagttatttaataatttaaaaagctattttgaaaaagtaatctcacgctgtcaccaaagctggagtgcagtggtgcaatctaaactcactgcaacctcgacctccttgagaccagggtggtctcaagtgatcctgccacctcagcctcccaagtagctgggaccacaggctcatgccaccacacctggctaatttcttgtatttttggcagaaatgaggtttcaccgtgttgcacagtctggtcctgaactcctgagctcaagtgatccacatgtcttggcctcccaaagtgctgggattacaggtgtgagctactgcgcccaacctaaaatattttatatatatatatatattttttttttttttttttttttttttttttttttgagacggagtctcgctctgttgcccaggctggagtgcagtggcacgatctcggctcactgcaagttctgcatcccgggttcacgccattctcctgcctcagcctcccaagtagctgggactacaggcgcccgccaccatgcctggctaattttttgtatttttcatagaggcggggtttcaccgtgttagccaggatggtctcggatctcctgacctcgtgattcgcccgtctcggcctcccaaagtttttttatattttttaatgtgaggaaaggtcacaaaagaatagtatgctacctgaggaatatctctggaaagggatcaagcattcgaggttttctgtgatgactgactaaagtcatggagttagaacagctgatacaaaagaaaccaaaaaaggccaggcatggtggctcacacatgtaatcccagcactttgggaggccgaggcaggtggtcaggagtttgagaccagcctggccaacatggtgaaaccccatttctactaagaaaaaaaaaaaaaaaaagtcaatgggtgtggtggcatgtacctgtagtcccagctactcaggagactgaagcacgagaattgcttgaacccaggactcagaggttgcagtgagctgagattgtgccactgcaccccagtgcagtgtgacagagtgaggctgtctcaaaaaaagaaaaaaaaaacccacaaaagctcggtagcatgagatctttgagagcattcttatgttcttattggtaattggagtttatattatgcccttgtcatcaataatagcttcagttatgtttcttagtctccatttgaaaaaagaaatattcgctgggcatggtggctcacgcctgtaatcccagcactttgggaggccaaggtgggtggattacttgaggccaggagttccagaccagcctggccatcacggtgaaaccctgtctctattaaaaatacaaaaattagccaggtgtggtggtgcgcccttgtaatcccagctacctgggaggctgaagcaagaggattggtttcaaggttcacctgggaggtcaaagctgcattcagccaagatcacaccattgtactccagcctaggtgacaaagtgataccctgtctcaaataaatacatagacaaaaagcaaacctatgagctatttaaaggaccttgaggagaaaaaaaataaatgaaatgggtgatctaaatttaaatagaatctgcagctctggttagcctttgacagtgttgttgtatcattatagttatgaatttgttttctcagttgtgttaaagtggagtaaggcaaaaaagaacttgaaatctcaacgacctccagagaaacatgctagcttttgcatgagtaaaatctcttaggcacaaatattaataatatgttaagaaactttaggcttaagcctaacataacagccccataagtgttcagtattatctctaaccagttatgtcaactgtttgtggaaatgacagcctttcttggcattagaggaatggttaaacctctgactccagggaatcacaaagcttggtcagatgctgaatggaattatgtgtgttgttggaagcatgttccctatgattaataaatgttttcaagttttccacttaacttgccagttctttggttaagccactcttctagtcctgtcctacagagcaggcttagagccccacatttgtcattgtagaaattcaaacaatatccattaagtcatttttttttttttttgcccattaagtcttaaaggattaatacattttctttccttttttttttttttttgaaacggagcctccctctgtcgcccaggctggagttcagttgtgcgatctcggctcactgcagcctctgcctcccaggttcaagcgattctcctgccttagtctcccgagtagttgggattaacagggttgtgccaccacacctggctaattttagtattttagatagagatggggtttcaccatgttggtcaggctggtctcgaactcctgacctcaagtgatctgaccacctaggcctctcaaagtgttgggattacaggcatgaaccaccgtgcctgccaatacattttcttacaaatattaattattgaaaaaatgtattttaagtaaatattcagactataaatatatcagcataattgaatacattataaccacgtaggcatgttaactgcttacatgcgtgcatgaaatattaagggaaaagggcagaatataatatttgtaaacacaactatgtatacctgtgtgtatatattgaaaaacgttagcatttggggtgtcgtaaaaataagtttctgttttctttataaaattacctaaattcatattcaactacacacaattataaacttaattgcagagctaggtgtggtggctcatgtctgtattcctagtactttgggaggctgaggcaggaggatcccttgaggccaggagtttgagactagcttgggtaacatagcacgatcttgtctctacaaaaaaaaaaagtgaaaattagtggggtgtggtagtgtgcttctatggtcccagctacttgggaagctgaggcaggaggattgcttgagactaggaggtcgaggctgcagtgagctgtaatcatgccactgcacttcaacctgggcagcaaagtgagaccctgcctcaaaaaaagaaaaaaatgtgtggcaaaaactgccatgaacaaagtccaaaacaaactaggacaaaggcttgaaatatatgacagatatatcccaatatacatagaattcttatgaaattaaaaggaacatgaacaacttaactcagtagcaaaggttacaagcaatatttatggagtaagaaatagaaatggcaataaatatatgaaaagcctagttgatcagccttactaatagggataaaaattaaaacttcacttcttacctatcagtgagttaaaattgatacactgctgctgaggttgtagggaaataggctttcttgtatgctgtgttctttggagttaagttagtatttatttggaggcaagctcttaattgaatctacagatacacatgccttttggaaataatttagcaattaaatctaacctaatctgatctcacctagcatttcacttctgaaagtttatcctataaaaatattaccatagaagtgccaagaatttttattgaagttttatttataacagtgagaatgtggcagtaatctcaatctttatcattaattgcttatggtttacccagttagtagtgtaaaggtactagttaacagtagggtctcttgactaaacagttggactttgaatctccattctagaacttcttagcattatgatctttggcaaattaactggcctcgctaaacttcagtttctttatctgttaaatgaagtttatagcaattaacttagagttttatttaaattaaatgagataaactgaatgattagtacactacctagcacatacttgttcaataaatattaacatttcttatcaaaattgccatatttaagaatgaggtatatttatatgtctagcatagaatcaaatatatattatcattattattttttttttgagacagggtctccttctatcacccaggctggagtatagtggtgtgatcatagctcagtgcagcctgtaagtcctgggctcaagtgattctcccatctcagccttgtgaatagctgggagtacaggtgtgtgccaccatgcctggctaattttttttgctgttagtttcactttttttgtagagctggggtctcgttatgttgcccaggccggtcttgaactcctgggctcaagcgattctcccgtctcggcctcctgaagcatacagattttttagggcagtgaatctattctgtatgatactgtaatcatggaaacctgtcattatctgtttatacaaacccatagactgtataacaccaaaaagtgaaccctaaggtaaactgtggactgtcaatgtaggttcatctgttgtaacggtttaccacagtggtgcaggatgttgatagaggctgttggaggggttatgtgggaactccgtgtactttctgctcagttttgctgtggatctaagtttgcatttaaaaatattttatggcttggtggctcatacttgtaatcctagcactttggaaggctgaggcgggtggatcacttgagttcaggagtttgagaccagcctgggcaacatggtgaaaccccatctctatgaaataaaaaaaaaagtaaataatactaatagtaattaactgggtgtggtggcatgtgcctatagtcccaggtacttgggaggctgaggtcggaggatgacttgagcctgtgaagtggaagttgcagtgagcagtgatcatgccactgcactccagcctgggcaacacagccagactcggtctcaaaaaataataataataaaataaataatataaataaaaataatattttgaaagaaaagagctatcaagccacaaatgcaaaaggcttcaagttcctatcttttagaaatacatactaaaatatttatgaaggaaatgatatatctaagatttgcctcaaaataatactggagtggcaaagtgagcgggggagtagatgaaacaagattagcatgagttcataattattgaagttgaataaattgcacatgggcttcattgtacatttctgacagtatttgtttgaactttttccataataaaaagttttgtttgtttttttttttgagatggagtcttgctctgtcacccaggctggagtgcagtggcatgatctcggctcactgcaagctccgcctcccaggttcacgccattctcctgcctcagcctccagagtagctgcgactacaggcgtccgccaccatgcccagctaattttttgtaattttagtagagatggggtttcactgtgttagccaggatgatctcgatctcctgaccttgtgatccgcccgcctgggactcccaaagtgctgggattacaggcatgagccaccacgcctggccttttttttaaaatggtcttacaggtaataccatgcatgcttaagtcatcattctcatatttagctaccaagatttttcctttcggaaatccctcagtattctagtaccactttcctctcatttgacacttttcaaagcacctacacactcccttgagaaagatacctttttttttttttgcgagggagtttcactcttttgttgcccaggctggagtgcagtggcatgatcttggctcactgcaacgtctgcctcctgggttcaagcgattctcctgcctcagcctcctgagtagctgggattacaggcacgcaccaccacacccagctaatttttttgtatacttttttttttttaagtacagatggggtttcaccgtgttggccaggctgggctcaaacttctgacttcagatgatccgcctgcctcgatctcccaaagtgctgggattacaggcgtgagtcaccacgcccagcccaagaaagatacatttttaaaaacagctttattgtggtataattgacgtaaaatgtacatacttaaagtatacagtgtgatgttttgatatatatgtatactcttgaaaccaccaccacagttaaaataatgaaaatgtccattacctccagaagtttcttcatgttttgttgtaatctctccttctcctccctgattcctccccatccccaggcaaccatgttttgtcaccgcgcgcagccatttactattatgatactattttatataaatagtatcatacaggccgggcacggtggctcatgcctgtaatcccagcactttgggaggtcgaggtgggcgatgacttgaggccacctggccaacatgaaaccccttctctattaaaaatgcaaaaattagccaggggtggtggcgtgcacctgtaatctcagctcctcaggaggctgagacatgaggattgcttgaacccaggaggcagaggttgcagtgagctgagattgtgccactgcactccagcctgggcaacagagtgagtctctgtctaaaaaaaaaacaaaacatacagactcttgtctggcttctttctttcagcataattattttgaaattcgtccatgttatgtggttcctttttattgctgagttgtataccacagtttttgatctatttacttgttggtagatatttggattttcagttctgaagcattacagatagtggctgttacggatattcatgtacagatctttctttgtatgggcatatgctttaatttatcttgggcaaatacctaggagtagaatatgatccaatatggtaggtgtatatttaacttttttttctatctatctatctatctatctatctatctatctatctatctatctatctatttttaagacggagttttgctccatctggagcaaaggctggagtgcagtggcatgatcttggctcactgcaacctctgcctcctgggttcaagtgattctcctgtcccagcctccccagtagctgggattacaggcgcctgccaccacacccagctaatttttgtatttgtagtagaggctaggtttcttcatgttggccaggctggtcttgaactactgatctcaagtgatctgcctcggccccccaaagtgttgggattacaggcgtgagccatcacacctggccagtttttatttatattttttatagaagatggagtcttcctatgtttcacaggctgatcttgaactccaggcctcaagtgatcctcccgccttggcttcccaaagtgctgggattataggcatgagcctctatgcccagccttatatttaactttttaaggtactaccaaagaactttccaaactggttgtataattttacatttctaccagcagtatgagttccagttcctccacatcctgtcagtacttgatactgtcagtcttttaaattttttagctcttataaaaaggtatatagttacatctcattttggttttaatttacatttctctattgagtaatgatgttgagtttcttttcatgtgcttgtcatcctgatatctttggtgacttgtctgttcaaatctcttgcccatttaaaaattgctttcttaatggattttaagaattatttacatagtctggatacaagtcctctgtaatatatataatttgcaagtgttttctcccagactgtggcttttctttttattaacagtgctttttgaagggcagatttttttttttttttttaaagagacagagtcttgccctgtcacccaggctggagtatagtggtgtgattatagctcactgcagcctcaaactcctgagctcaaagaattcttctgcctcattcttccaaacagctaggactacagatgtgtgccactgcacccagctaattccgtttgtatttcattgattgtgtttttggtgtcacatcttaagaaactttggcctacttcaagttctcaggagttttttcctgcattttcttctggaagctttatagtttcatgttttacattaggtctgtgatccttttgaagttgattgttatacgtggtccaaggtatggatcaaagttcatttttctgcatatggatattcaattgtttcagcactgttttttaaaaaagactattttctccactgaagtgcctttgtacctttgcaaaaatcagttgtccatatatgtgtcaatctgttccatcagtcatgggtcaaaggctgttctcatggggaggcttttgaatttgaaaaactgaaactctatactcattggacaactttatacccattgaacaactccccattttccatttctctcagcccgtggcaatatgctttctgtttctataacatggactacttgagtttttttcttttttttgatgacaagatctcactccgttgcccaggctagagtgcagtggcatgatcttggctcatggcagccttcacctcctgggctcaagctgtcttcccacctcagcctcctgagtaactggaactacaggtgcactctatcatgcctcgctaattttttaatttttttgtagagacgagttctcgccatattggccaggctgatctcaaactcctgggctcaagtaatcctcccactttggcctcccaaaatacagagattatgggtgtgagccatcatgcccagctggctagatatttcatgtaagtggaatcatacattatttctcttttagtgacttgcttattttgcttagcataatgtcctcaaggttcatctatattgtagcatgtgacaagatttcctttttaagggctgaataatattctgtgttatgtatataccacatatctgtgagtagacatttgggttacttccacttcgtggctatactgaataatgctatggtgaaagtggctatgcacatatctgtttgaggtcttgtttgtaattcagttcgtttttatatatactcattggtatttatataaatgggattgctgggtcatatggtagtttaattttttgaggaacctccatattgttttccatggtggctgcaccattttacattcccaccaacaatgcatagtggttccaatttcttcacaactttaccaccgcttgttactttctgttttttggtagtggccatcctaacgggtgtagtttttttttgcatttttctaatgattagtgatgttgagcatcttttcttttttccccccatattacacagatgtagagcatcttttcatgtgcttgttggctatttgtatatcttctttgaagaaatatctgttcaagtcctttgcccatctaaaaaaatctgatgatttgtttttttccaattgtttaattgtaggactttttttttttttttttttttttgagatggagtctcgctctgtcgcccatcctggaatgcagtggcgcgatcttggctcactgcaagctccacctgccgggttcatgctattgtaggactttttaatgtattctggatattaatctcttaccagatatatgatttgctttttttttttttttttttcgatacaaggttttactgtgtcacccaggctggagtaaagtagtgatgtaatctgggctcactgcaacttccgcctcccaggctcaagcagtccttccacctcagcctcctgagtagctggaactataggcactcgccaccatacccacctaatttttgtattttttgtagagacggagtttcaccatgttgcccaggctggccttgaactcccaggctcaagcaatccacctgccttagcctcccaaactgctggggttgtagatgtgagctaccacacccagcctgatttgcagatattttctccagttctgtaggttgccttttcactctgatgactgcttcctgtggtgtgtagaaatttggtgtaggcccatttgtctatttttgtttttgttctttaatttctcttagcaatattttgtaagtttcattgtacaggatatttggggatctgtaagacaaccctcaggttcagtaatttgctagaaagactcaactcagagaatgttttatactcaaattatagtttagtacattgaaatgatatggattaaatttagcaacagaaaaagacacatagggcagggtccaggagacaccccaggctcaagctgtcaatagtcctctcccagtggagttgtgcacacagtgcttaatttttccagcaacagtgtatgacaacacacgtggaatattggcaaccagggaagctggctgagccttggtgtccgggtcacacatggctgacctcagttctctggccccttcagaggccaagctgatactgtgtgacacaaggccctcaccgtagatcacattattagcggaaacttgttggcatgacccaatgcctcatgtaaacagcgcagtggctgtttataggccgggcgcagtggctcacgcctgtaatcccagcactttgggaggctgaggcgggcggatcacctgaggtcaggagtttgagaccagcctggctaacatggcgaaaccccgtttccactaaaaaaaaaaaaaaaaaaaaaaaatagaaaaagaaaccaaaccaggtgtggtgataagtgcctgtaatcccagctactcgggagactgaggcaggagaatcactctaacctgggaggccaaggttgcagtgagccaagattgcgccactgcactccagcctgggcaacaggagcaaaactccatctcaaaaaaaaaaaaaagttaaatagaaaaaggacataaatgaaaaagcactcaaccatcctgataataagagaaatagatattaaatttatgccaagattccatatttctcccatcagattggtaaaaatctaagcacttgctaacataaggtgttagcaacagtgtggtaaagtaggcaatctcttgcattgctgattctctaaattggtgcaatccacagggagggcaatttggcatgctctcgttctctctctcgctcgctcgcgcgctctctctctctctctccatgagaaggagagagagagagagagagagcacgcgaacaagcgattgagtgagagagagagcacgtatctgcagtctcagctgctcaggaggctgaggtgggaggattgcttgagcctaggaggtcaacgctgtggtaagctgttgactatgccactgcactgcagcctagtgacagagaatctgtctcaaagataagaagaatgaggatattctttatgtactgatgtgtagaaaaatctctaagatacatagttaagtggagaaaacaaaatgctgcatggtgcatttactgtactaccatttgtgtgaaaagggggagtaagagtatgtgtttgtatttgcttgcatatgtagaaagaaactttgaaaggattcaccaaataacagtagtaagcagggggattaggaaactaggtatatattaagagggagcttttgtactctataccttttaatactttctttgagaccatgtgaatgttttacctatgtatttatttatttttaatttttgctttgcctgcttttaaacaaataaattgtactttttttgaagagctctatttttatttcctttcgattatcatctgtagattcttatgtcacattttactttaacagcacatttagacagaatacagtctttaaatggaagccgacaattgatttccctggaaaatttttgaagtacaataacatttgattgattgaactttatttagtaagaattcttagcaaaattccctcccaggcacacctacatggtgcttcattttcagtgaactacaaatctctgaaacccaaaactgcaatctaaaagtacaagatggctggactcgatggctcatgcctgtaatcccagcacttcgggaggccaaggcaggaggattgcttgagcccagaagttcaagaccagcttgggcaacatggtgaaactttgtctctacaaaaaattagccgagcttcacaaacaatcttacaggagtcattcattaattaactcaacaaatatttatagagtacaggagacactagagatccagcaaaggtcaataacatgtgctgtcttagagaaaacttatattctaagaatagtcaagtgacaaacaggagctacatcaaataatcacaagtacacttcagagaattaaaaccagatcaacgtagagaaaggcttccttacattcgatagtcaggaaattctctctctaccaggagggaactgagtgacaaggaacagtcaggtgggagaagggcattccagatgaaccagccctgagcggggaactagaaggccagtttgagaaaaggaatggagagaggaggaacagtttgtggtcagagcaaggaccaaaccattttagacttcatgagcctaagaagttttgattttgttatgagcatgacaagaagccattgtaatcgagttttaaacaaaggaatgacatgatctcattttgtttaaaaaaaaaaaatcatcctggctgtagtgtggagaatggactaggggagcataaaagcagaaagaccaattggaagcctattaacagtaatccaaatgatagataatagtggtttgaaccacaaagattatggacatagaaagaagcagatagatccaggagatgttttggaggtattctggcagaatttgctggctgactagacagaggtactaaggaaaagaatcaagaataattcctagattcgggacttcctagaaactgggagaatggtgctgctgtttattgagataaatggagaagacagaggagaagcttagaatagagttctaggagaggtcagagatggagatcaacatttgggagacagaattttctaattccatagtgccgacgattttctattgatagactaaaaatgtctggaattttatatgcagtttcatctggacaataccctaagaggagatcagttataccttggcacctgctaatagccataggaatatgtatatgtagaataaatggtaaaactactgaatgcttaatatgtgccagacaccgtgagatacgtctttgaagtactatcccagtagaatttacaacaaccctatcaggagatactttttttatcaccattttacagatgaagacactgaagttcaaagaggttaaataactcgccccaaatcacactatatagaagagaaatctaaatcctggtagtctgaccccagaacttgggctaattaccactatataatacagtgtcactggggtaaacccaagatatgataacataagttagagacttttaaattccaaatttcacacactatgatttcacccataaaatgtagtgattcagccatagtcttctgattagttggagtaccctatgcaatactttaggaacttgcttcttttattttcatatatatatatgttcattcataaattaaatctggacagccagtgaatctgccatttttgtctctaaccaacacttctgtcacaaaattgtacttttttttgtttttttttgagacggagtctcattctgtcacccaggttggagtacagtggcacgatcttggctcactgcaacctctgcttcccgggttcaaacgattcgcctgcctcagcctcccaagtagctgagattacaggtgcccgccaccacactggctaatttttgtatttttaatagagacagggtttcaccatgttggccaggctggtcttgaactcctgacctcgggtgatccgcccgcctcagcctcccagagtgctgggattacaggcatgagccaccacgcccggcccaaactgtgctttttttaaataaagaaattaaaacagtatttttttccttaaagatggtgtctcactacattccctggctcaaacgattctggctcaaacgaattcctaggctcaaacgattctcctgcgttagcctcctgagtacctgggactataggtatgtgccactattcctgaaaacataatcagttttgaaggtagtgtctgggctgggcgcagtggctcacgccttcaatcccagcactttgggaggccgaggtgggcggatcacctgaggtcaggagttcgagaccagcctgaccaacatggataagactccatctctactaaaaatacaaaaaattagccaggcatggtggcgcatgcctgtaatcccagctactcaggaggctgaggcaggagaattgcttgaacctaggaagcagaggctgtggtgagccgagatcgcaccattgcactccagcctgggcaacaagagtgaaactccgtcttaaaaaaaaaaaaaaaaaggtagtgtgtggccgggcgcggtggctcacgcctgtaatcccagcattttgtgaggccaaggtgggcggatcatgaggtcaggagttcgagaccagcctggccaacatggtgaaaccctgtctctactaaaaatacaaacattaagccggcgcagtggtggatgccgataatcccagctcctcgggaggctgacgcgggagaattgcttgaacctgagaggcagaggttgcagtgagccaagattgtgccactactaggcgacagaatgagactctgtctccaaaataataataataataataataaaataaaaataaaagtagtatccagcgtactacaaagaggaagagtttgtgaatgtgtatgttactgttaagttaaacagtgttctagtatccatctcattatcagccttgggcagggcagggttgagttggctaatgttcattataaaccagatcatccagttggggactctgaatgagcatatgattgcccctttcatgctagacttagctaattaaactgttcatatgacctaaaaggatggctgtggtgccatagaaagaaaacaagttttgaggcaagagactttagtttgattcctacctctgctgttttctggttgtgagatttttggatcagttgcttttgtgttcatttaccaaaacttctcaagacaaaaagaataaatgagataatgtgacagtgccttgtaaataccaaatactatatagagatagctattattacttgtatgtttattgtgaacattaatcagccaatcaagttgttcagacttgtactgctgaacatcaattgcagatataacattcttggcagatgacttagtcacctccttctgtggaagaatagaagatagacagctccttgctgtctatcacagtatgttctggtcccgttggcctcaccttccatataatcatttccattctactgggctttagccactctggtgacttgagttcagcaaaaataatctttcttgatgggtggtatatatatttctaccttttatgctttagaatagtttcctttccatttctcatagggtttggatcttcataactgtttgaagagaaatcctgacctccagactgaaggaaagcacaccatgcctttataacgccagcctcggtcttttttttgttcccctctgtcttagttccttttgtattgctataacagaataccgcagactgggtgatttatttatttatttattttgttgttgtcatttgttttcttcttttttgtatcttttgaaattcttttcattgttgttgttgttttgagactgggtgatttgtttattcagctcatggttcttgaggctggaaagcccaagagtatatggtaccagcacctgattatgccatggtggatagacagaacggcaagagagagcttgcttttgtaacaaagtcactcccatgataactaacctactcctgtgataacgacattgcaggttcagtatccctgatttgaaagtctgaaattcaaagtgctcccaaatctgaagctttctgagtatcaatgtgatgctcaaaggaaatgcttattggagtgttttagattttggatttttagatttggtatgttcaacctgtaagtataatggaaatattccaaaatgcaaaatctgaaacacttctggtcccaaacatttcagataaaggatactgaacctttaatccattcatgaaggcagagtcctcatgacccagtcacctcctaaaggcctcacctcttgatactaccacaatggcaaccaggtttccagtacatgaatttttagggggatcattcaaactatagcaccctcctttatcccttaccctattccattagttttaatccccactttgtctcttcctctaatcttcagtctacactgtgacatgataggtatgctcaagtctctaacagctctaaaataacgttttctgtttttttttttgtcttcatttctggtggggttggataagaaaagtttttcaagttaaatcactctctattgcaagcctcttccaccttttttttttttttttttgcttcgaagaatgattgcctttaccttctcagttctcagttattttccagcacattatgattttatgaccttgatacagaagggctgggctcctggctaaattccacccttaaacctggaactgcaaccctaagtgaaaacagctaaccccattttttttcccacccaaatgttgcctctttggcctgccatgcccctatcctgtgctcataaaaatatttcagctgggctgggtgcggtggctcactcctataatcccagcactttgggagaccgaggcaggtggatcacctggggtcaggagttcaagaccagcctggccaacatggcaaaaccgtatctctactaaaaatacaaaaattagttgggcatggtggtgggcaccataatcccagctacttgggaggatgaggcaggagaattgcttgaacctgggcggcggaggttacagtgagcccagattgtgccagtgcactccagcctgggcaaccgagtgagactctgtctcaaaaaaaaaaaaacaaaaacaaaaaagatttcagcagctgggagaacaatataagcagctgacgtcagggatataaatggctgtgtgttgggaatacaagcagctgattgtcggaaatacaagccactgagtgttggtgatacaagtggctgagcagcgagcagagaatcaggtgagcgttggagactatggatgggacgtggctaacttcagatggtgcagctttggagaataggcccagccggagatggcctggcttcagggaaagatcaccttcttcccataccatccctttttcaactccccattctgctgagaaccacttccatcgtgcaatacaatcttctgcatatactacccttcaatctgttcatgtgatctgattattcctggacactggaagagaacctgggtgccaagaggagagggcaggggctgccaccctgaccctccactgagctggctggcacctggccatccccgaatggccgcgttgaaggagcattgattgtaacacacttggatgctgctgcggggccgcatagagcctgcgcctgccagagaggagcaactggctggttcccgcattcgtttgctctgattcccacactcactcactcgcttgcacactgcctcttgcaaggggtttgagtgtgtggtggccgagtaaacgagccacgctccgagccatgagggggtcaagggaattatccagtctcatctcaatccgacttccctcttcactgttttacttttgtaaaacccttgatgaacttcccattgtcaattcagggtctttttagctctcatcctgccagactgttgataacacctctgatttgtgctccacttttggcttctgtgtcatattgattcctgagttttcttccttctcctctattctcttaatctcgttttctggttttctcccatcacctgctggttaagcttaggggttatttacacttctctccttggtcatctttttactgtatttttccctccacagctatttcatccatttctgaggcctgagatttcatccatttctgaggctatagagaccagtgacttcctctgactcttctgagcttgaaattcctattggtaactgccattggacttaactgcctggttatatctctaactaaagtacttctctcttccagcctgtttatcttattgtgttccattgtgttccttatctctaccaatgctagttccttatgctagaaatctcattcattgccactcaatcaagtttgctaaaaacgaaacatctgattgtgtcacttattcaaccttaccaatttttttttttttttgagccttgctttgtcacccatagtggcacgatctctgctcactgcagcctccaccacccaggttcaggtgattctcctgccgtagcctcatgagtagctgggattacaggcatgtgccaccatgcccgactaatttttatatttttagtagagacggggtttcaccatgttggccaggctggtctcaaactcctgacctcaagtgatctgcccaccttggcctcccaaagtgctgggatttcaggcgcctggcctgttacttgattatatgctaaacaaggggtggattattcatgagttttctgggaaagaggtgggcaattcccggaactgaggatccctcccctttttagaccatacaaggtaacttccggacgttgccatggcatctgtaaactgtcatggtgttggcggggagtgtcttttagcatgctaatgtattataattagcgtatagtgagcagtgaggataaccagaggtcactctcctcaccatcttggttttggtgggttttggccagcttctttattgcaaccagttttatcagcaagatctttatgagctgtatcttgtgctgacttcctatctcatcccgtaactaagagtacctaacctcctgcaaatgcagcccagtaggtcttggccttattttacccagcccctattcaagatagagttgctctggtccaaacgcctctgacacaaggattttaaagtcttattaattaaggtaagatagttccttgcatatgtggtctgaaatcacagaaagctgaatttgaaaaaggtgcttggagctgcagccagtaaacaagttttcatgcaggtgtcagtatttaaggtacatctcaaaggataagtacaattgtgtatgttgggatgaacagagagaatggagcaagccaagacccaggtaaaagagaggacctgaatgccttcagtgaacaatgatagataatctagacttttaaactgcatacttcctgtacattgttttttcttgcttcaggtttttagaactcatagtgacgggtctgttgttaatcccaggtctaaccgttaccttgattctgctgagaatctgatttactgaaaatgtttttcttgtgcttatagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctgtacgtatgagttttgttttattattctcaaagccagtgtggcttttctttacagcatgtcatcatcaccttgaaggcctctgcattgaaggggcatgacttagctggagagcccatcctctgtgatggtcaggagcagttgagagagcgaggggttattacttcatgttttaagtggagaaaaggaacactgcagaagtatgtttcctgtatggtattactggatagggctgaagttatgctgaattgaacacataaattcttttccacctcagggccattgggcgcccattgctcttctgcctagaatattctttccttttctaactttggtggattaaattcctgtcatccccctcctcttggtgttatatataaagttttggtgccgcaaaagaagtagcactcgaatataaaattttccttttaattctcagcaaggcaagttacttctatatagaagggtgcacccttacagatggaacaatggcaagcgcacatttggacaagggaggggaaagggttcttatccctgacacacgtggtccctgctgctgtgttcttcccctactgactagggttagactgcacaggctaaactaattccaattggctaatttaaagagaatgatggggtgagtgctttggcaggagtcagggaagagcaggtagcaggtaactggaatgagggtggagcaggtaatggaaaaacattgctttacgaggaagttaagtttaaaagtagaaggcaaagaattgaacatactggcgtattaattctttgaaatttagaactcacatctaacattggcttaaatgttaaatcctcaaagataacattcctgtttctcctaacacgattaagtccttcttggtatcttttctcatagcaacttgtcctttctcacttgtcacaatttgcaaatatatatttatttacattgtttatttaatgcctaatttccttctttattgcaaggcctgtgagggtactgagtctccagggtgaggtgtataataaatggccaaacgaattgttaattgaaaggatgaacaactaattcaagccagcactctctagactcctggggggctatcatgtgggttccctggtgctgctgatgtcagcccttggcctccaagaaaaatgcttgattcaaatgtcatctagttccatctctacgactctcatggggtccaaagaagagttttaattgagttttagaatttgaagttgtgaagtgtctgaaaaactacatggtgttctgaaagccaaacttttagccttttgggagagcatctaagacagcaggtgaagggcaggggttagaactagagggattgaagaatattatccatataggttagggttaggtttggcaacgtattatagaacaaacattggcaagctacagccacaggccagatctgtctgctacctttccacaaaggtgtaataacaaagttattcacaaatttgtgaataaactttcattggaaagtgaccacgctccttggtttatacattgtctgtggctgctttcacactacagtagcacagttgagtgtttgcactggagaccatatgacccatagagcttaaaatattcagtctggctttttacagagatgtttctgactttgttaatagaaaatcaaaacaactggtttaaataatgcacatactttctctctcatagagtagtgcagaggtaggcagtccagattagtacggtggcttcacgttcatcaaggactcaatctccttctttcttctttagcttctaacctctagcttacttcagggtccaggctggagccctagccttcattctgacagtaggaaggagtaggggagaaaagaacataggacatgtcagcagaattctctccttagaagttccatacacaacacatctccctagaagtcattgcccttacttgttctcatagccatcctaaatataagggagtcagaagtaaagtctttttggctgggaatattggcacctggaataaaaatgtttttctgtgaatgagaaacaaggggaagatggatatgtgacattatcttaagacaactccagttgcaattactctgcagatgagaggcactaattataagccatattacctttcttctgacaaccacttgtcagcccacgtggtttctgtggcagaatctggttctataacaagttcctaataagctgtagccaaaaaaatttgatgaggtattataattatttcaatataaagcacccactagatggagccagtgtctgcttcacatgttaagtccttctttccatatgttagacattttctttgaagcaattttagagtgtagctgtttttctcaggttaaaaattcttagctagattggtgagttggggaaaagtgacttataagatacgaattgaattaagaaaaagaaaattctgtgttggaggtggtaatgtggttggtgatctccattaacactgacctagggcttttgtgtttgttttattgtagaatctataccccattcacagaagataccgagactgtgggccagagagccctgcactcaattctgaatgctgccatcatgatcagtgtcattgttgtcatgactatcctcctggtggttctgtataaatacaggtgctataaggtgagcatgagacacagatctttgctttccaccctgttcttcttatggttgggtattcttgtcacagtaacttaactgatctaggaaagaaaaaatgttttgtcttctagagataagttaatttttagttttcttcctcctcactgtggaacattcaaaaaatacaaaaaggaagccaggtgcatgtgtaatgccaggctcagaggctgaggcaggaggatcgcttgggcccaggagttcacaagcagcttgggcaacgtagcaagaccctgcctctattaaagaaaacaaaaaacaaatattggaagtattttatatgcatggaatctatatgtcatgaaaaaattagtgtaaaatatatatattatgattagttatcaagatttagtgataatttatgttattttggatttcaatgcctttttaggccattgtctcaaaaaataaaagcagaaaacaaaaaaagttgtaactgaaaaataaacatttccatataatagcacaatctaagtgggtttttgtttgtttgtttgtttgttgaagcagggccttgccctgtcacccaggctggagtgaagtgcagtggcacgattttggctcactgcagactcaacccaccagtttcaagcgattctcctgcctctgcctcccaaatagctgggattacaggtgtgtgccaccacactcggctaatttttgtatttttagtagagacagggtttcaccatgttgaccacactggtctcgaactcctggcctcaagtgatctgcccaccttggtctcccaaagtgctgggattacaggcatgagccactgcgcccggccctaagtggttttaatattttgattgacagtatactgaagaaatatactctaagacctttatgaatctcctcattcacaaataacactgtaggatataatggtccctataaaatacggtataactaaaatcagatttttatattggagtacagaacaataaagccatcttcagatgctggtattaaactcactggtgactggtcacaccttgcctaaactggtagccaccatgcatcctctcaccatctccactgtactacttccttccttgggaagtcgggcgctgggaggttgtacaggaaagatacagacccacccttctcagcctctcctcccctagctcgctcttttgccaaagtgacctactgctgagtttcaaagtgacctactgctgagtttcagccaactagcacgtttcagattcataccttagaaaaaattacacattatcacaagtcatgcaccttttaaggtcattttcaaataatagaaattataagtgttcggccaggcatggtggctcatgcctgtaatcccagcactttgggaggccaaggcaggaggattgcttgaggtcaggagttttttttgtttttttgtttttttccccgagacgaagtctcgctcttgtcccgcaggctggagtgtgacagcgcgatcttggctcactgcaagctgtgcctcctgggttcaagcgattcttctgcctcagccccccgagtagctgggattacaggcgcctgccaccacacccggctaatttttgtatttttagtagagactgggttttaccgtgttggccaggctggtctagaactcctgacctcaggtgatccacccacctcggcctcgcaagggctgggattacaggcgtgagccaccatacctggccgaggtcaggggtttgagaccagcctgagcaacatagtaagacctatctctaccaaaaaaaaaaaaaattaactttccaaatgtaggagtctactctgtttccttctagtatttatttctgtatacttttctaacatggttaaaatgtgtaatcaatatgtgtccttttactttggtgtgaacattttttctattataaattcttagaaaatatttctatggctatgagatatttgattcaagtgccttgtaatttacttctcaaatgtccctgatgttggacatttgtttctagtgtttcactattttaaaaaacagtaatatctgtctttatgcttagagctttttcagtttttcaaattatttccttagggtaaaatcctagaagtagaatttttggggcaaattatctacatatttataactgtcttggtattcaaaatctcgttttcaaaaagcttatatcaatttgtacttaacaccagtagtgaatgagagtatctgtcgtaccccaccagtgctgaatttcttttttaaaactgtgctggtttttataggtaaagaaaatgtcttaatttgcatttagttggttactagtaatatcacataccttttcaatgcttgtgaactttaagcttatacagagtttaaccttgcatgttgaacatttgagtgagtggaagtgttaagtgatggccatctgtataatctattagtaatgtatggagaccattaaagatgacaggtatgtgtgatgatgacaggttgttaccaacactcagaaggccaaaaagcaagtgatataaacccatgctgggaagcattcacctcccccactttaaaaatgctagtttcttaattccttttctttatccctttttttgtctgcacgtgtttacttgcctttagtttccctgctttagtaggctgaccttgtgacttttaccaggatcccattatacttttgttcttctgtttatttctcagattttattggagggtggaattctactttttctttcttataatctagaatttacattcagatttcctgcctttcccttacaaaatacctgtgtagttggataggtggagctctggactcagagttctttcttctagtaatcttaggaaattatttaatttttctgtgttttcatattttcacacataaaagagaaaacaccatttctaaactacctcttcttttctctgcttttaagcatgtaaaggttttcccaatcttgggcagtgacatgtacaggacagtatagctttacatctgccttgttttaattaaacactagttctttgaggtaacccctactattatcccagttttatggatgaggcactgaggcaggggtcacacagctagtgtgggtcagaacctaatgggtcagaatggacatttgagtccagagtttggcctggattgacacacatagctattacgtaagattcctctcaaattcagtcctcagctccctgaagtgtgggttctcttttcatgcctccatggaaactgcgtatcatgtggttaccagtttttcctttggtcgtatctgctgacctttttgaacctaattttttctggaccttattgccatttgacttatttattgcctcccacttgacactgattctggcttttgcttttcttcctactttggtcctttttgcagttttctaaagctaaccagccatgactctcagatgatggactttttcgtctctcccattacttcttgggaaattatattttaatctcatggtttaaattttcatccttaaatataacttttaatgtagtatttttagcccagaagggcccatggttggtttgttttctcctttgcatatctcttctactcagatacctggtagcatataaatcaaatgaattatccttcataccatttcattatcatcagtaggactgctttgctggggtttttttgtgtgtgtgtttttgtttttgtttttgtttttgttttgagataaagtcttgctttgtcacctaggcaagagtgctaggattacaggcgtgagccgctatgccaggacagccgttttcttctagtattatttgccctctgtctgaacatcttcctttagtaatgcttttagagcaaggcagctggcctcaatttgttttaatttttcttccccttaggatgttttaattttacctttattactgaaggatattgttactgggcagaaaattgtcttgatattccccttttcagcatttaaaaaatgctcttctgctttctttcagcctccatggtttctcataaaaatcagtcattcgaatcactgttcttctaaaagtaatacattgttttgttctggtcactttcaaaattttctttttcttttcagcagtttaattatgggactgtgtgaggatttctttgttcattctgtttggagttcactgagctttttgaatctctaggtttatgtcttttaccaaatttggaaaatttttcaaccattatttcttcaaaatttttctgtaccacattctttactctttttttttttgaaacagagtggcgcactgcaacctctgccttcccggttcaagtgattctcctgcctcagcctcccaaagtgctgggattacgggtgcctgccaccatgcctggctgattttgttaatttttagtagagacggggttttaccacattgaccaggctggtcttgaactcctggccttaagtattccgcctgcctgggcctcccaaagtgctgggttacaggtgtgagccaccacacccggcccttttttttttttttttttgagaccgagtctcgctttgtcacccaggctggagtgcagtgatgtgattttggctcactgcagcctcagcctcccaagtacctgggattacagagatgtgccaccatgcccagctaatttttgtatttttattagagatggggtttcaccatgttggccaggctggtcttaaacccctggcctcaagtgatccgtctgcctcagcctcccaaagtgctgggattacagacgtgagccaccatgcctggctctttaccctcttctgggagtgacaacacaaataactttttattccacaggtttctgaggctctgtttattttccaatttttttcactattgttctggttagataatttctattgatctgtcttcaagtttcctgaaatttgcattttgttggtaaacctattcagtaaaatgtttttggttattttatttttagttctaaaattcctatatagcccgtctttacatttttttattctgaaacttaaaactttcctttcattttaagagtgtttgcccttacttcttggagcatttttatgctccaaggattttgatatttttgttttattggccaattgatctgattgggctaggtccagccagccttgtcaaagcctttgcagtgttgctcagatctgccccatgtatatgccacccagtcaccagtctgggactggtatagtggtgttctatttgtaattcggttgtcagggtcggtgtgtactgttgaggatcatatccatactcactcaccttgggaatggacccacaagtttataaacagctttaagagattgctttcatgagtttctttctttctgtgatctccatgtggtttcttgggcttcccttttccattcctgcagccaaaagtggactttatcttcctaaagtcagggccaaaatgtgggaggagagagagaaataaagcaagggctatttgccccactctctcgggactgacattcttccagtcagagtaaggattccctccctctgaattttaggcttctgccacccacattaccatcaccacaggattgtgtgaggactgggcatacgagaatggagaaaagcggaaaagaatgccgggtgtggtggctcacgcctgtaatcctaacactttgggaggccaaggcgggcagattgcctgagctcatgagtttatgaccagcctgggcaacacagtgaaaacctgtctctactaaaatacaaaaaattagccaggcatggtggtgggcacctgtagttccagttactcaggaggctgaggcaggagtattgcttgaacccgggaggcagaggttgcagtgagccaagatcgtgccactgcactccagcctgagctacagtgcgagactctgtctccaaaaaaaaggaagaaaaactggatttttacactgtctgggtgttaggagacctctttcctgatcctcaagccagaactagaggtcttctggagctcccattgtcttgctaatgcccactcatgttgtaatgagcacaggtggaggaaaaaaagtggtcagctcactgctagtacttctaattccccagcccacctacctctcattacttttcatcttttgcaaccagctgctgcctgctttctgcccaggttttgtaactgtattcagtgggatagagagagtggaaggtacttactccatcttatctggaacctttcttaatatattttttgtcgcatttgtacatcttttatccatccttcattttattttatttttttttttgagacggagtctcagtctctcgcccaggctggagtgtagtggcatgatcttggctcactgcaacctccgcctcctgggttcaagtgattctcctgcctcagcctcccaagtagttgggattactgggacacgccaccatgcctgggtaatttttgcatttttagtagagatgagggttccccatgttgcccaggctggtctcgaacttctgacctcaggtgatccactggtttcggcctcccaaagtgctgggactacaggcctgagccaccacgcccagccttatccttcattttagacagtttaagaggtttgtattcagccagatctccacatttacttgttcatttgtgttgtgatgttttttaatgttcaagtcttagcacacacaaacaattatatagaaacaagttgtttactttgacacccagtataactaaaaggatcttttgagtcagagattgagtaacttgccagagcctgtttggaaataaaccctgaggatttttcatatcagtggttggttatgcaatgtctgtggcaagccctagaaactaaaagaccaaaccttaaaatgttaaaaacaggaaaggcagttaattattatacataatttgttataaaaggaactataacttattaaagtcagatgatttctggccttgatagtttagggtttagagaagatactgttgtgtactataaaacagcagggctgttttctttcataccctttagcacaggaaagctgaactagggatttttgcaagatgagaaaggcctgttgaaatgtgtgtgtataacatagtaataaaagaaatgcatatgaaaataacaaattaacatatttgacatattgactttgtcaagattagtcttttttgtcaagtaactaagccagtgtgtattaattaaatcagtaattagaaaaagtttgtacactttgatttagtaattttgcttttatgatatattctaaagaaggaattagaaatgcagaaaaatatttgtgaagtaggatgttcattttaatgtaaattaaaattggggaaagaaagggaaaacaatacagattccatgcataaggcaaaggttcaattgtgggtttatccgtatgagtagactattattttgtcatttaaaaatcatagtttcagctgggcgtggtggctcacgcatgtaatcccagcactttaggaggctgaggtgggcggatcacctgaggtcagaagatcgagaccagcctgaccaacatggagaaatcctgtctctactaaaaatacaaaaaaattagctgggcgtggtggcgagtgcctgtaatcccagctactcaggaggctgaggcaggagaatcgcttgaatctggggagtggaggttgcggtgagattgcgccattgccctccagcctgggcaacaagagcaaaactccatctcaaaatcaatcaatcaatcagtcaatcaatcatagtttcacgccaggtgcagtggcacggacctgtagacccagttacttgggaccctgagacgagatgattgcttgagcccaggttttccagtctagcctgggaaacatagtgagaccccagtctcttaaaaaaaaatcatattttcaaataatatttggtggcatgagaatatgtttgtaataaaagattacatttgtgaaagcagaatgtaaacagtacactagttgattctcactgttaaggtctttacacacgcctatacgtgcagatagaaaacatgtctgaaagggaaacggttttattttgtttcgtatttttttttgagacaatgtctcactttgtcagtcaggctggaatgtagtggcactgtctcggctcactgcaccctatacctcctgggttcaagcaatcctcccacctcaacctccatggtagctgggactacaggcacctgccaccacgcctagctaatgttcgtatttttagtagagacggggttttggcatgttggtcaggctggtcttgaactcctgacctcaggcaatccacctgtctcagcctcccaaactgctgggataacaggcgtgagccactgtgcctggcctgaaagggaaatgttggtattaattttggttgtcactggcctttagaatagttttcttcttttagtgtttctgtgtttcttaagtgttacaagcatatgttacttttgattcagaaaaatgctatttttaaaataagcaagactgggcacggtgactctcaccagtatggctgagaccagaggatcacttgaagccaggagttcaaaaccagcttgggcaacagagtgagacccccacctctacaaaaagaaaaaaaaaaaattaaaaaattagccaggcatggtggtgtacccacgcctatagtcctaggtactagggaggctgaggtgggagtatggcttgagcccagtggttcgagattgcagtgagctacgatcatgccactgtaccccagcctgggcaacacagtgaggccctatctcaaaaaataattaaaaaaaaaatatttgggggctcctagaaggtacagttaaaaaaattaaaattaggccgggcatggtggctcacgcctataatcccagcactgtgggaggctaaggagggtggatcacttgagatcaggagttcaagaccagcttggccaacatggtgaaacttcatctctaatacaaaaatcacctgggcgttggtggtgggtgcctgtaatcccagctactcgggaggctaaggcaggagaattgcttgaatctgggaggtggaggttgcagtgagccaagaccatgctactgcactccagcctgggcgacaaagtgaggcttcatctcccaaaaataaataaataaaattaaaaaaagaaataaataagaacatctccttcttcctttgccaaaaaaccgaggtgaaaagcatctctcaagaatgatgagaatttcaattatttaatatttactctggtccttaatttaaagcttaatatggaatcccagtgtacatctcccactggtattgtttgtcttggccaagacagacaagttttaaagagtgagataaaatttaggctaaagttgaagtatttggagggaaatgtacagatgttctcagcttaccttttttgtttttttgagatggagtctcgctctgttgctcaggctggagtgcaatggtgcgatctcagctctccacaacctccgcctctcaggttgaagtgattctcctgcctcagcctcccaaatagctgggactgcaggtgtgtgccactatgtctggctaatttttgtatttttttttttaatttattttttattgataattcttgggtgtttctcacagagggggatttggcagggtcataggacaatagtggagggaaggtcagtagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaaacacatcttgcaccgcccttaatccattcaaccctgagtggacacagcacatgtttcagagagcacagggttgggggtaaggtcacagatcaacaggatcccaaggcagaagaagttttcttagtacagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggtgcccctcacctcccgggcggggcggctggccgggcggggggctgacccccccacctccctcccggacggggcggctggccgggcagaggggctcctcacttcccagtaggggcggccgggcagaggcgcccctcacctcccggacggggcggctggccaggcggggggctgatccccccacctccctcccagacggggcggctggccgggcggggggctgacccccccccacctccctcccggacggggcggctggccggccggggggctgaccccccccacctccctcccggacggggcggctggccgggcggggggctgacccccccacctccctcccggacggggcggctggccgggcggggggctgacccccccacctcccgtcccggacggggcggctggccgggcagaggcgcccctcacctcccggacggggcggctggccgggcggggggctgacccccccacctccctctccgacggggcggctggcctggcagaggggctcctcacttcccagtaggggcggccgggcagaggcgcccctcacctcccggacggggcggctggccgggcggggggctgacccccccacctccctctcggagagggcggctggcctggcagaggggctcctcacttcccagtaggggcggccgggcagaggcgcccctcacctcccggacggggcggctggccgggcggggggctgacccccccacctccctcccggacggagcggctggcggggcggggggctgacccccccacctccctcccggatggggcggctggcctggcggggggctgaccccccccacctccctcccggacggggtggctgccgggcggagacgctcctcacttcccagacggggcggctgccgggcggaggggctcctcacttcccagacggggcggctgccgggcggaggggctcctcacttctcagacggggcggccgggcagagatgctcctcacctcccagacggggtcgcggccgggcagaggtgctcctcacatcccagacggggcggcggggcagaggcgctccccacatctcagacgatgggcggccgggcagagacgctcctcacttcctagatgtgatggcagccgggcagaggtgctcctcacttcctaggtgggatggcggccgggcggagacgctcctcactttccagactgggcagccaggcagaggggctcctcacatcccagatgatgggcggccaggcagagacgctcctcacttcccagacggggtggcggccgggcagaggctacaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggtggatcacttgcggttaggggctggagaccggcctggccaacacagcgaaaccccgtctccaccaaaaccagtcaggcgtggcggcgtgagtctgcaatcgcaggcactcggcaggctgagtcaggagaatcaggcagggaggttgcagtgagccgagatggcagcagtacagtccagcttcggctcagcatgagagggagaccgtggaaagagagggagagggagaccgtggggagagagagggagagggagagggagagcgcttaaaacaatttttaagatgtatttcttttctcatagttccagaggccagaagtcccaagtcaagggttggaagcaatttttgtatttttagtagagatggggttcaccatattggccaggctggtcttgaactcctggcctcatgatccgcctgccgtggcctcccaaagtgctgggattacaggcatgagtcactgcgcccgatctctcagtttactttgatatgtattaataataacaaagactaatggatgaggagctagacagaaattttataaaccaagtactgcaaaatatgaatggtagactctaggtgatatatgggtgttcactgtaaaattaattaaattttgctgtgtgttcgaacatttttgtaacaaaatgttggaaaatttttgtggaagaacaccagaaacaactttgttgtatctggatataatttagaatattcaaatgttggctaggtgcggtggcaacctgtaatcctagcactttgggaggccaaggcaggtggatcacctcaggtcgggagttcgagaccagcctgaccaacatggagaaactgtgtctctactaaaaatacagaattagccaggtgtggtggcacatgtctgtaatcccagctacttggggggctgaggcaggagaattgcttgaaccctggaggcggaggttgcggtgagccgagattgcgccattgcactccattctgggcaacaagagcgaaactccgtctcagaaaaaaaaaaagaatattcaaatgtccaaggagtaccaatatctaggtaaagccattctgttggcctttgccaaattgtactattttataaagttgttttaaagagagatgtgggccgggcatagtggtgcacatctgtaatctcagcactttgggagtctgaggcgggcggatcacttgaggtcaggaatttgagaccagcctgggcaacatggcgaaaccctgtctctactaaaaatacaaaaattagcctagcgtggtggcgcgcacgcgtggttccacctactcaggaggcttaagcacgagaattgcttgaacccaggaggcagaggttgtggtgagctgagatcgtgccactgcactccagtctgggcgacaaagtgagaccctgtctcaaaaaagaaaaaaaaaatctgtactttttaagggttgtgggacctgttaattatattgaaatgctttcttttctaggtcatccatgcctggcttattatatcatctctattgttgctgttctttttttcattcatttacttggggtaagttgtgaaatttttggtctgtctttcagaattaactacctttgtgctgtgtagctatcatttaaagccatgtactttgttgatgaattactctgaagttttaattgtttccacatataggtcatacttggtatataaaagactagtcagtattactaattgagacattcttctgttgctccttgcttataataagtagaactgaaagaacttaagactacagttaattctaagcctttttgaagattatatagtcttctagtagaagtctgtgcatcagaatgttttaagaaagggttttaagaatgtataaaaaccaaaataattgattttcatacttctatattgttttttatcagtgactcttttttctttcaaatgaaatcttatatgaaattttcatatataatatagaaaaaagtggatctagtctgtcaaagagaatagtgaagctcagagatgtgccagcctggcctttttctcagctcaagtggcagaatacagtttgtaaacaattgcactagctcttaaattcgaagaggcagtcaaactaataaataaattggagagttatttctttggtagaggattaagggaaataaccacagacagaagaagcaaatatgagaatctatgtgaaatggatgatattctagaaaaaaaattatcaaaactgacccctaaagagagaatatctaaacagagtaaagaagaggtacagaaagttactgaagaagtttccaccccacctgcacaaataacaatagtaccaggccccagtggattaatggggaaattctgttaaacctttaaggaatggtaactctaatactaagtgttccgaacatataaaaagaaaaaaagcttccagattaattttatgaagccagcataacattaataactaaagccctgcaagttatcaagtaaaagaaaactattggtcggttatatttattgatttcaaaagcataacagaatattaagagaattcagcaatagatgaaaagaataatactttttttttttgagtctcacgctgttgcccaggctggagtgcagtggcatgatctcggctcactgcaacccccacctcctggattcaagcgattctcctgcctcagccccctgagtaaccgggactacaggtgcgcaccaccatgcccagctaatttttgcatttttagtagagacagagtttcaccatgttggccaggatggtctcgatctcctgacctcgtgatccgcccgccttggcctcccaaagtgctggaattaacaggcctgagccaccgcaccctgccataataatacatttgaccaagtggagtttgtttgcagaatcgttcattataagttgccatattactagatcatcatctctgtatgtgctaaaaggcatttgataagattcctgttcttgatcagattccttaataaatagacggggtcgggtgtggtggctcatgtttataatctcaatactctgggaggctaaggtaggaggatagcttgaggttgaaagttggataccaacctgcgcaacataacaagactttgcctctacaaaaaataaattagccagttgtggtgtgtgcatgtagttctagctgcatgggagactaaggcgggaggatggcttcagcccaggaattcaaggctgcagtgagctatgattgcaccactgcaccccaggctgggtgactcagtctctaaaaataaataaataactaaatctctaacattataaaatgtatgcatctcattctaaaggccaatgtcatcctcatagggaagctagaagcttgcctattaaggtcaggaatgagatggaggttttcttttctttcttttgtttgtttgttttttgttttgttttttctgagatagagtctcactctgtcatccaggctggagtgcaatggtgtgatctcggctcacaggaacttctgcctcctgggttcaagcgattctcctgcatcaaggcctcccaagtagctgggattacaggcacctgccactatgcccggctaatttttgcatttttagtagagcaggggtttcaccatgttggccaggctgttctcaaactcttgacctcaggtgatccacctgcctccgcctcccaaaatgctgggattacaggcgtgagccactgtgcctggctgagatgaaggttttctttatcaccaattatctagcattgctctggagggactagcaaacacaattaaacaggagaaagaaatacgaactatataatttggaaaagaaggttaaattaccaatatttggagataaaatgattgtttactttgttttagaactaactgaaaaccaattcaaattactaagtaagtttggtaaggcaattaattgattacaaaattaaacaaaagtcccctgtctgggtgccgtggctcatgcctgtaatcccagcactttgggaggccgaggcgggtggttcacctgaggttaggagtttgagaccagcctggccaacgtggtgaaaacccacctctactaaaaatacaaaaaattagccgggcgtggtggtgggtgcctgtaattccagctactctggaggctgaggcaggagagtggcgtgaacctgggagatggaggttgctgtgagccgagatcgcaccattgcactcccacctgggcaacaagagtgaaactccatttcaaaaaaataaagtgaaaacacaaatcaataaccttcacataaacaactagttagaaaacataataaaaggataagtcccatttatgatagcagcaaaaaagattaaatatctacgagtaaacaagaattgtgcaagccctggacactggtgaagcagagatgccagctgaggtcctgcccccagctccccttaagctgagcagtgtggagaacatcttgcacaggctgctgactgccttccaagaagcccttgacctttaccatgtgttggtctcccttgaccgggtgggcactgagcagtagcaggtgtagactgagctggcctctaacttcctttggatccacagccagttgtaggccaacaacggggtggaggggtctgatgtggctccaggccctctccagctcaggttacccctccttatgtacattgtactcagagctgctagtgcaggctgtgcagaggaaggcaggggacactgaggtccagcagtccctgctcctgcttctgaagaaatagatattttaagtgaataaactgacagcttagaggggtaaaaaagataatatgcaagatctattgagaattttaaggctgggtgtggtggctcacacttgtaatctcacctatttgggaggccgaggtgggaggatcctttgagcccaggggttctagaccatcctgggcaacatggttgaaactccatctctacaaaaaatacaaaacttagccaggcgtggtggtgcatgcctgtagccccagctgcttgggaggctgagtcaggaggatcacttgagccaaggactttggggctgcagtgaactgtggttgtgccctctatccagggtgacagtcagaccttgtctctatttaaaaaaaaaaaaaaaaaaaattaaaatatgctatcatttgtgtcaagtagaaaagtatatatatgacatgtatagactttctggaaggatgtacatgaaattaatagtagtgctttccaatcaggcacggtggctcacacctgtaatctcaacatttttggaggtggagacaggaggactgcttgagcctaggagttcatagccagcctgggcaacatagcaagaccccatctcaagaaaaagtagtgctttcctctaaagaggggaaccatggggcacagtggggagaaaacctacttttcacagtatctgttgtgaattttatatcttattcatgtgttacctggccaaagattaataaatagattgtttttgtttttgttttttagtttgaggatactggaaatgcttaatataaatatctacatcgtccagaaatttcaatgtttactctattttggaatttcaaagtgggagaggaatcatctttttggatggtacctgaaactgaaagtttatgcctaaaggcgtgcttgctttctcctcagttacctcaggcatcttctacagttgcaatctctttgttgttagatggtggattttgcctccccagaattaaaatagcattttcttcattataaaaatacttaacattcattgtttttttaaaaaagacattatataagattataaagaagaaaaatgaccagattcccaccacctaaagataagtcctgtcatcctttcaggaattaatatatcaatttctcatctactcttctctcacactactttgcataaatgggatcataaatgggatcctatattttttcaagcaacagtgtgttatgcctatactccatgtttatatgtgtgtattaaaaaatgtatttgtatatatgtgtatgtataagtgtgtgtgtgtgtatgatgattcttctcccgctttgaaggtgaaagaaagcacacctttatttaagcataaactttgggtttcagatactgtctggaaaaatgatttatctcccactttgaaattccaaaatacgtacatatattttttttttcttttcttttttagttttagggtcttgctgtgttgcccaggctggagtgcagtagtgtgatcatagctcacacagcctctaactcccaggctcaagctatcttcctgccccagcctcctgagtagctgggactgcaggcatgtgccatcaactttagctaattttaaaatttttttgtagtgatagagtctcactgtgttgcccaggctcgtctggaattcctggcctcaagtgatcctctcacctcagcctcccaaattgctgggattagagtgtgagccactgtgcctagcctgcatatatctatttttaatgactgctaaatctcattgtatgaaaatttatgtcctagctataaaatttgttagcacatgtttaattttttctaatttcagatgttttaaactaatatttcccaaagtatagtatggcattttaggtatgatatgatcttttttcctcttcgtactcatttttatagttatggcctgtgcaactggtttcccatttatatgaatgatacagagcttcctattaagaaaaagttcagcttgggaaaaaaaaagtgaattgttcaacttgagggaaaaaagtgaattaattggccaggcaccgtggctcatgcttgtaatcccagcactttgggaggctgagacgggtggattgcttgaacccaggagttttagaccaacctgggcaacatgttgaaaccctatctgtacaaaaaaaattagaaaaattagctgggcatagtggcacacacctgttgtcccagctacttaggaggctgagctgggaagaccacctgatctccggaggtaaagactgcagtgagccgtgattgcaccactttactccagcctgggcaacaaaatgagaccctggctcaaaaacaaaaacaaaaacaaaaaaagagtaaattaatttaaagggaagtattaaataaataatagcacagttgatataggttatggtaaaattataaaggtgggatattaatatctaatgtttgggagccatcacattattctaaataatgttttggtgaaaattattgtacatcttttaaaatctgtgtaattttttttcagggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatggtaaaacccaagactgataatttgtttgtcacaggaatgccccactggagtgttttctttcctcatctctttatcttgatttagagaaaatggtaacgtgtacatcccataactcttcagtaaatcattaattagctatagtaactttttcatttgaagatttcggctgggcatggtagctcatgcctgtaatcttagcactttgggaggctgaggcgggcagatcacctaagcccagagttcaagaccagcctgggcaacatggcaaaacctcgtatctacagaaaatacaaaaattagccgggcatggtggtgcacacctgtagttccagctacttaggaggctgaggtgggaggatcgattgagcccaggaggtcaaggctgcagtgagccatgattgcatcactgtattccagcctgggtgatagaacaagaccttgtctcaaaaaaaatttggtttttcaagctttttgaggttttgacaagctggccaatatggtgaaaccccgtctctactaaaaatacaaaaattagctgggtgtggtggcgtacccttgtattcccagctacttgagaggctgaggcaggagaattatttgaacccaggaagtgaagtggaggttgcagtgagccgagatggtgccactgcactctagcctgggtgacagagcgagactctgtctcaaaaaaaaaaaaaaagcaaaaaaaaaaaagcacaagcagagtggtagacacacaaaatgctcaattcattttttaaacgatttttttcctttatatcttactgcagaagcttttttcttttttttgagacaaagtcttgctgtgtcacccaggctggggtgcagtggcacagtcatagctcactgcaaccttgaactccctggctcatgcgatcctcccacttcagcctctcaagtagctagaactacaggtgtgcaccaccatgcctgactaacttgtttattttttgtagagagaacgtcttgctatattgcctaggctggtcttgaactcttgggctcaagcaatcctcctaccttggcctctcaaggtattgggattataggtgtgagccactgcatctggcctcaattcacttttaaaatcaaaattaggttacctactttttataaggtaatgtatagaattattcttttaaaaataaaaccgatttggacagtgtgagattcacattctgtaaccaccagtgtgacatgggtcctgaacagttagaacatactccagccattaacccaggcagctttcaggtacgtactctgtggctgttgccttgtatgaaagccaaaaagagatccattttcagagattaatatgtgaccccttctatattataaggccatggccatactcttttttttttctttttgtttttttcttccaaagacaggatctctctctgtcatccacgctagagtacagtggcatgaacgtggcttactgcagcctcaaacccttgtcctgggctcaaacaatcctcccacctcagccttcaaagtagatagaactacaggcatgcactaccatgcctaattttttaaaaaaaaattttttttcagagatgagatctcactgtgtttcccaggcttgtccggaactcctggcctcaagcgatcctcccaccttggcctgccaaagtgttgggattacaggcatgagccaccatgcctggccatacacttttttttttttttttttcaagacggagtctggctctgtcgcccagactggagtgcagtggcgtgatcttggctcactgcaagcttcgcctcccaggttcatgccgttctcctgcctcagcctcccaagtagctgggactacaggcatctgccaccacgcccggctatttttttgtatttgtagtagagacggggtttcaccatgttagccaggatgatctcgatctcctgacctcatgattcacctgcctcggcctcccaaagtgttgggattacaggcatgagccaccgtgcccggcctggccatacacttttgtcattatttacatacttactaaaatgtttggtggcctgtaataggaaacatcatcctcatttgattgacgaagaagtctgtggaaataggattgaactggttctgttcttgtatttgagtaatcagttgtggaactatagaagtcatatactctctctgactttcataattaccttatgttgtatagtacttgatggtttgcaaagtaaccatctattcttgcttagctgtgagtaagaatgccaggtctggagacagaatgtctgggttcaaattctactcatcactttttatttttattttttttgagatagagtctcgctttgttgcccaggctggagtgcagtggcgtgatctcagctcactacaacctctccctcccgggatcaagcgattctcctgcctcagccttccgagtagctgggactacaagtgcgcaccaccacgcccagctaatttttgtatttttagtagagacgaggttttgccatgttggccaggctggtctcaaactcctgacctcaagtgatctgcctgcctcagcctcccagagtgctgggattacaggcttgagccactgcgcccagcctactcatcacttactagctatttgaccacacaagttactcaactcctatgtcagttatgaagattaaattaaatgatccatttaatacaataatacacttagaacaatgtctatcagtaaatttttttctgttttaagaaacaggatctcactctgtctcccaggctggagtgaagtggcacgattatagctcactgtagcttcaaaagcctgggctcaagcagtcctcctgtctcagcctcccgagtagataagactacaggcacaggttggtgttgacctcctagcctcaagcagcctcccaaagtgctgagattacaggtgtgagccactatacccagcccagtgttatatttttgtataatcctatgaagtatcaaggcagttattatccctgttttactgctaagaaacttgaagtttacagaggtaaattatttgcctaagcctaaactctgatctcgaatctgaatcccaagtccaatattcttttcaccgtattacaatatttttaccatcaaccctccattctgtctgcacatcatacaaatgagtatctctacagagctttgagttgcttttaaacaaaagagatttttgtacccaatgtttagagtagtgattctcggctccatttttacaagatttcaagatttaatttgtcaaaaaagttctgaaattttcaaagcaaaagcaattttaatttaattgctctaaaaaataagcagatttatcatttagcaattctttaagggagagtgtatcataaaactgaaatagtactgaatgtggcagaatcaaacaagttgaaaatctcatcacttcagagcagggcagacttctcattcaaacaaattgaggtagaagtggtgagagtagagatttctttgtgtatgtgtgttttattactgtactatattatattatagttctatatatactatattatattgtacatatatattattatatgaagagacatgaccactttgaggcatgaaatttttttttttttttttttttttttgaggcacggtcttactttgtcacctaggcagtggcgccatcttggctcactgcagcctccacctccagggctcaagcaatcctcccacctcagcttcctgagtagctgggactataggcacctgccaccatgagctgctaattttttgtatttttggtagagacggggttttgccatcttggccaggctggtctcaaactcctgagcacaagtgatctgctgcctcagcctccccaaagtgctggaattacaagcataagccactgtgcctggcaagacatgaaatttttaaatgtaaatgcatttaagtgacaataatgtgaatacaagttatcaattcttcctttacaagtttagctatacctgttttatatttttcagtgtttaaaattatttttatatttttatattctgaattttctttctttctttcttttttttttttttttttgagacggagtctcgctgtattgcccaggctggagtgcagtggcgcaatctcggcgcactgcaagctccgcttcccgggttcacgccgttctcctgcctcagcctcccgagtagctgggactacaggcacgcgccaccacacccagctaattttttgtattttttagtagagacagggtttcaccgtgttagccaggatggtcttgatctcctgaccttgtgatccgcccacctcggcctcccaaagtgctgggattgcaggcgtgagccactgcgcccggcctatatgctgaattttcatgacagagaatgaaagaaaaagtgcagttgatcgaaagaaatggtggtataaacaggaataacaggcatgttgtttcctctctgatttattatttttgtaaaataagctacttttcagcaccacatacatatgttctgagacctgaatatttgtgaccaaagagtaaagaagtaataaactttatctcgcaaagagttattattgtgttttatttaaatttactgccctcttacttcaagtacttctcagtagtacgtaatactgcttttaaaaaggagaagggatgaatttcttctactctgctcttcatattttgaaaagttcagtcaaatcccctttattaaattcatctcagagtaatctttttaatttgtagttcatatccgtgattagtttagaagtgacttctccctgtttctgctcactgtaggttgacaactgcttaaaatagtctatctcatcattatctctgcagctttcctttaaactaggaagacttgttcctataccccagtaacgatacactgtacactaagcaaatagcagtcaaacccaaatgaaatttttacagatgttctgtgtcattttattttgtttatgttgtctcccccacccccaccagttcacctgccatttatttcatattcattcaacgtctttttgtgtaaaaagagacaaaaaacattaaacttttttccttcgttaattcctccctaccacccatttacaagtttagcccatacattttattagatgtcttttatgtttttctttttctagatttagtggctgttttgtgtccgaaaggtccacttcgtatgctggttgaaacagctcaggagagaaatgaaacgctttttccagctctcatttactcctgtaagtatttgagaaggatattgaattagtaatcagtgtagaatttatcggaactgaagcacatgtaactatggtcattttcatggtacttgttctcatcttaaatgcacagcattcctggaactcctgcagatctctttgtttccttgcaagcaattgtcttctacctgatgttgattcaagagagttttcaatatgaatagaaagaaagaaaatgtttagatattggggaaccagcattcccattttaaaacctgttaggagttgttgattagggcaagctcaaggattcctttgagtgactggtttagatgtctttctgctattcggtgaccactggggaactgagattgttgagcagaagggtaatgtgagcagagccgtgcctttgtaagctggcagcactgtgtgagatgaattggtgggttggatactgagatcatgagaggcatactaagcataattaagatgatattgccatgatctaggtggaaagtaatgggggtttgaattatggtagtggcagtagcaatcaagggaaagagttgatcagaggattcagaggtagaatcaatagttctagcaactgaggagagaagttgtaagcttgaaggaaaggtgatgaagaaaaaatgctttcctgtgttttcttgttgttgttgttgagatagggtctcactcccatccaggatggagtacagtagtgtgatcatggctcactgcagcctcgacctcccaggctcaggtgatccacccacctcagcctcccgagtagctgtgactacaggcacgcactaccaggcctggctaatttttttgtgttgtgtgtagagactgggttttgccatgtgcccaggctggtcttgaactcctcggcttaagcgatcctcctgccttgacttcacaaagtgcttgagttacaggtgtgagctaccacgcctggccatgttttcttgtgtgaaggatctgtttagttttatatctttctgtggctcatatctaatttagttgacagtacctgtgggtcactaggtagacattgctagcagacgtttagaaatgaaatactagagcttgggaaaaagttgatatttgagatagagacttgaagaacattagcagagagttggtagttaaggtctgtgagctggtgagcaattcaaataaaagcagaagagaagaggaagacaagggtcaaactttgtcaactactgtgtttagagaatgagacaagagaggatactacaggaagtagaggaaaatagtggaaaattgggcaagccagtatttttcacttaagaatatcattactgttttttgatgtcagcacatgaaatggctgcatagtgttctcttacgtagatattcagtggtgggtatcctcattgatagacatttagatcatttccatttattttctatcacagacagcacttacagagtgcatccatgaacttatgaatattattataaaatgtattcttacagtagaattgctaagtcaaaggatgtatttaaattttgatagtttgccatattgcctcctaaaaaagctgtgcctgtttacattcccttcagtaatatgaaagtatcaatttccttacccctttggtgttttggtttgttttgttttggagactgagtctcgctctgtcatgcaggctggagtgcagtggtgcgatctcggctcactgcaacctccgcctcctgggttcaagcagttctcctgcctcagcctccggagtggctgggattacaggcgtgtgccaccacacccagctaattttttgtatttttagtggagacacggtttcaccatgttgaccaggctggtctcgaactcctgacttcaggtgatccgcctgcctaggcctcccaaaatgccaggattatagctgtgagccaccatgcccggccactgctttgttaatgcttgcctgtgtctgtgcatacatgcatgtgtgtgtgtctgagagagaaagagatctaataggcaaaaaaataacatcttgttttattttttattgtttgtctaatgctttgggtgattatttgaactttttttcatgtgtttcttagttacagatctgaatttattttgtaactggcttggtataatctttttcatatttgtgaaattaatcttttttgtgtgtgtgtgagacagtctctctctgtcacccaagctggagtacagtggcgcaatctcaactcactgcaacctccatctcccaggttcaagcaattctcctctctcagcctcccaagtagctggaattacaggcgcatgccaccacgcctggctgatttttgtatttttagtagagacgggatttcaccacgttggccaggctggtctcaagtgatccaactgcctcagactcccaaagcattagtattacaggtgtgagccactgctcccagccctgtaaaattaatcttaattatacaagtaattcattatccttgaaaaaggataaacattacagataaaaataaatttcacggtaactatcatctctaatcttaatgccttatcaagtacttacccctgttgtcagtttgttgtatatccttgtagattttttttgccaatttttctgttgagttactggaaaagcagtttcaagaaggagagaggctgggcgtggtggctaacacctgtaatcccagcactttgggaggcctaggtgggcggatcacttgaggtcaggagtttgaaaccagcctggccaacatggtgaaactctgtctttactaaaaatataaaaatcagctgggtgtggtggtgcacacttgtaatcccagttacttgggaggctgaggtgggaggatcacttgaacccaggaggcggaggttacagtgagccatgatcgtgccactgcactccagcctgagtgacagcaaggcttcatccccaccctcccaaaaaaagagaatatctttttgtttgtttgtttgtttgtttgtttgtttgtggcagagtcttgctgtgtcgcccaggctggagttcagtggggcgatctcggctcactgcaagctccgcctcctgggttcagccattctcctgcctcagcctccccagcagctgggactacaggcacacgccgccacgcccggctaatttttgtatttttagtagcaacggggtttcaccatgttagccaggatggtctcgatctcctgaccttgtgatccgcccgcctcggcctcccaaagtgctgggattacaggcgtgagccaccgcgcctggccgagaatatcattttttataaagaagtcaaaggtaatgaggactaagtaaaaccatacagtatttgctgtctaagatgtcattagtgacattgaagagagcagtttcagtagagtgatagaaccagaagcagtactccaaagggaaggtgcgtatgtgtgcatgcatgtctctgtgttttgccagtgctggcagtggaagtgatggtgtaggcagagaatgggtggtgaagaaggagaggtatagtaaatgtcatgtactacatcaaagattcctgtctcacaggcagagcaggtggtgacctgacaggagaacaggtttcaggaaaggtgtttcaaggagagggaaggttccattttattttatttatttattttttttgaaacagagtcttgctctgttgctcgggctagagtgcagtggtgtgatcttggctcactgcaacccccgcctcccaagttcaagcaatggtcctgtctcagcctccggagtagctgggattataggcacccaccaccacatccggctaatgtttgtatttttagtagagttggggtttcgccacattggccaggctggccttgaactccccacctcaagtgatccacctgcctcggcctcccaaagtgctgggattacagacgtgagccactgcacccgacctgttttattttatttttgaggtaagtcttgctctgttgcccaggctggagtgcagtggcgcaatctcagctcactgcaacctccatctcctgggttcaggcaattctcctgcctcagcctcccgagtagttgagattacaagcatgcgccactatacctggctaatttttttttttccatatttttagttgagccacaggttgggagaagggaaaatacattctactcaaagtgagtccgtggcaaaagtgtgagtacagagatgggtgaggaattaggaccagactttcagtctgcagcaacattaaacatgtatgttaatttaatactcagaaagaagcatttactctgttttaaaatatctatcacatactatatatatatatatatatatatatatatatattttttttttttttttttttttttttttttttgagacagtcttgctctgtcacccaggctggagtgcagtagcgtgatctcgactcactgcaagctccacctccccgggttcacgccattctcctgcctcagcctcccgagtagctgggactctaggcgcccgccaccatgcctggctaattttttgtatttttagtagagacggggtttcaccgtgttagccaggattgtctcgatctcttgacctcgtaatctgccctcctcggcctcccaaagtgctgggattacaggcgtgagccaccgtgcccagcctatcatatataatatttttaaaactcaacgtctgtgctcgctttagcagcacataatagtaaaattggaatgatacagatgatttgcatgtatttttttaaaagttctcaagtctatttaataaccacagaatatgagacattctgagatgttttagaaacagttcaacatatgtgggaaaataggagtataaacccttacctcctgtgtagatcaggtaggttcaagattgcatctgttcttttgtaatactaaatgtctggtgaagatttgaggattttatataaatcattgagtttgagaggtttttttgtttttgtttttgagatggagtttcactcttgttgcccaggctgaagtgcaatggcacaatctcggctcactgcaacctccgcctcccaggttcaagcgattctcctgcctcggcctcctgagtagctgggattacagacgcctgccaccacgcccagctaattttttgtatttttgtatttttagtagagagagggtttcaccatgttggccaggctggtctcaaacttgtgacctcaggtgatctacccgcctcaccctcccaaagtgctgggattacaggcatgagccaccgcacctggccttcgttttgttttttcaacagaatgtaagaattttttcttacatttttcttacatttttaacagaatgtaagaaaaccacaacgcaatgccgatgagtactttttccctgaagtggatataagcatgaatataaaaagttttaaatcagtcatcctggctatttgttctctaaaaatcaataaataattctttcatgcattttaatactgtctcccagttaagggtattcagtttgcaaaatgctcttactgacaggaaatgtatgagcatttttgttttttacttctgtcgtttgacagaaaaaatatacacctactctttgagctaatttattcttacctagtggtcattagtagaagtggttcactctgggagcttaactagaagggaaactaacaattccttgaggtagatcattttatctaaagctttttgatttcatatcagttgggggcgggtatattatgttaatttttaaatctgcatattttccagccaggcatgactataatcccaggactttgggaggtagaagcaggaggattgcttgagcccaggaattcaagaccaccctagactacattaaaaaacatatttttttgtatttattttttattttatttttttgagacagagtttcgctctcattgcccaggctggagtgcaatggcacgatctcggctcaccacagcctccgcctcctggattcaagcaattctcctgcctcagcctcccgagtcgccgggattatagacatgcaccaccacaccgggctaattttgtatttttagtagagacagggtttctccatgttggtcaggctggtcttgaactcctgacctcaggtgatccacccacctccgactcccaaagtgctgggattacaggtgtgagccaccatgcctggcctttttttttttttttaatttaaacgaaatctgcttattttcctgttgatgtaaggtgtttgtgttaaggtgaaatgaaaagtgatttttaaaaaaatattattttaggactatttaacaaatatactatttatgataattaacatggggttagcaaactactgcttgaagccaaatatggcccatggcttgtttttgtacagcttataagctaaaaatgctttttacatttaaaaaaaaaaaaaaagaacaaggaagaatatgtgacacacaaaacctgaaatgtttactccctggccatttacagaaaaagttagctggacattgattttcatgttactattaactgctaaaacaaaggagcttgtagctatattttttcatacttgcataaagaaagaaaacctaataaatcgctggtggcttcatttccaaaaggctatggaaatccataaacaggctgggtgcagtggctcatgcctgtaatcctagcactttgggaggctgaggcgggaggattgcttgagcccaggagtttgagtctggcctgggcaacgtagtgagaccctgtttttagaaaaaatgaagataaaaaactaatccataaacctcatacttggtggttgcccttcagtttttcttctttagatctggatttagttaaacagtgtattgcctgcctggtttctgttaacttttgatcatttggttgggttatcctataatgaaacttggttgacctcagaaataacaaggtggtcgttcagcttctttgattgtgtgtttctttcataagttcttcaagaagcctgagtattagaaacatggataaaattattgtgataaaaagccagagagacataaatgtcaagtatcttgtttaaaattactgtgaccaggccgggcgtggtggctcacgcctgtaatcccagcactttgggaggctgaggcgggcggatcacgaggtcaggagatcgagaccatcctggctaacacagtgaaaccccacctctactaaaaaaaatacaaaaaattagccaggcatggtggcgggcgcctgtagtcccagctactcgggaggctgaggcaggagaatggcgtgaacccaggagacagagcttgcagtgagccgagatcatgccactgtactccagcctgggtgacagagcaagactctgtctcaaaaaaaaaaaaaaaaaaaaaaattactgtgaccagattggactcagcttgctgctggcatttggttcccaccataacctcatatgtcatgtgtttgcttatatgtacttttgtgttattgttggtgtatcttcaggataagttccaaaatgtaatattgctgggttaaaggattaatgcacatgtagttttattagatgttaccaaatttccctccagtggggattataccatttttcattcctgcctgaaatatatgagagaagcaccattttaaagttttcacaatgtctctgaactaaaatgtggtagagatgcacatgtgtatatctagatctagattgatatattgatatacatgtatttttgtagaaggggcacagaggaggcctcttgactatccctattatgtttattgcttttaacgttttttctcacgccgggtttaaaacatggtttagcattattgaacattctaaaaatgagacataatatgaaggaaatttactctgtgcatcttttgaattataatcaccatctgaggcttttgtgagctccagtttgtcctggaatttagaacattcaactagtccagctattgtttcagtggaatcttgctggcctgaacagttttccttctggttacttttcagggactaaaaatgatgaagagttttgtgatagcaggtgcagtttgagtactacagtaaacattcagtttcagaacttcttctcttacctgctaaaaccaaagagaaccttttttttatttttacttctgattgttgaacagtcttaaggcagcattaggaagactggcgatttgtgtggagaaatgatggcttgttgttgtctatgcatactttgtgtgtccagtgcttacctggaattttgtctttcccaacagcaacaatggtgtggttggtgaatatggcagaaggagacccggaagctcaaaggagagtatccaaaaattccaagtataatgcagaaagtaggtaacttttattagataatatcttgatttttcagggtcactgttataagctaacagtatagcaatgtttttatcgtctttctttggtcatagactcctttgagaatctcttgagaactatgataatgcccagtaaatacacagataagtatttaaggagttcagatactcaaaacccaacaatacagtcaaagcatcctaggttaagacacctcccattaaatacagaataccagcatggaaaggttcaggctgaggttatgattttgtttttgttttttgtttgttttttataagtcatgattttaaaaagaaaaaataaactctctccaaacatgtaaaagtaagaatctcctaaaagaaacaaaaaagaaacagacaataaaggaaaaataagtaaacaaaaaaagcaaaatataaacaacataaaaatgagaacctcttgtctaacatggccagaataactgaaatatgatttgagatgtgctgatgtgtatactgagaagatcaaatattctaggtggatatgactttttagaagaggataagaatgacttaggatgagctgggtgcagtgatgtgtgcctgtagtcccagctacatggccaaggcaagaggatcacttgagctaaggagttccggattaccctgggcaacttataccttacctcaaaaataataataataatgaataataataatgacttaggataagagagtgaaaggccctctaaggatactacagaacatattaaggagaacacaagttagaagttgttattagatggagttgagggggagctttcattcagttttctggaatggaggctaccttcccacacacactaaaaaaaaaaagaaagggttgaggaataacagcacaatataaatagtctaaaaaaagggctaacttttatgaggaatctgaaaaacaacaggcacagtaaatattggtgaggaaaaaaaggccttaattgagttgctgtttgtcaggaaagggagagtttatgttttataaagccaggaaatctacagagttagcatttaggcaactgcaaggaagatactttcaaccaggaattcctatttggaactcagagatgtgagtctttattatacagtaagcaaggcagcagaacaaggtcatgttagactctcacgggatccttagggtgtgactttgctagccagaaacctctgtggctggtggcaccttttcctgagatttgctcaggcccactgggctcattccacctactcagcctagctggctatgcttggctttctctaccagctggaccccatgcctgccaaaggcaagccaggcatggagcagcgaggagtgcatgagcaagtgagtgcagggtccagccactgcacacagccaggcatgctggctgcagcagggcaggcagcctcaggtactagctccctgctgcagctagaccaggcattacctaagcagctttgactacaggccactaccactagtaaacctgatagaaaagtaagaaatatactggaaagaattgccacaagcctggctcttgtgttaaccttgtgttaacctggggaacacaggggcacccagaagcttggagatgccaggaactgcagaaccccaaagaggggggtcatagccctggcttagggaactcctgagtctggactccccgaagggccacatctcttcactcctctcttctctccttctcgccacctgcaacgtggcaagtggggggcacgtttcagccctgtttgtcttacggttctttcaatcctgccattcaatgggtcccaagttcttgtcctgcatccaggaagaatgaagtacgtggacagctggagggagagcaagatgaaaaggtgctttattgagcaacagtacagctctcaggagaccctatctgcaggcaggtcgtcccattgtctctgcagctctcagtggagaggagacctggagtgggtagctcctgtctgcaggcaggtcatcctgatgtctgtaatcctcagtggagaggagacccggaatgggtatctcctatccacaagcaggtcatcccatcatctctgcagccctcagtggagaggagacccggagtgggtagcttctttctgcaggcaggttgtcccttcatctgcccaagtctgactgagtctggggtttttatgggcttcagaggggaggaagtacatgctgatgggtccatgggtggccatgagcaggcccagaaaatgcaccataagttctcactgtggtctgtggaactgggagcttggcctccaggcttcaggctttccctgacttgaggtggtgcttcaccagggaacttcccctttccgcctaggagcctgtctgcctcctgctgccatcaacctgctgtctatagctcccatggcacccaggctgttcatgccaaagggtgcctgcaggcccacggtaagctgccttcagcccctcctcagtctccctcccatgcttgtcagcacccaaagtccagagggggccaaggtggcagggggctggcatgtcagtgctgccccaagcgcccgcacacccggccaggtcatgacagcacccagcctcagccacaactttgctctgaaatcggagcctgcagacgcaaggggcttcctggacccctgagagcacagggatgcccaggtctacagccacagctgggaagctgcagctgtgggagtgcgggacttctgccccaccaactcagaagggggcaggactcccgcctgttcctggctcctgccagctcacagagcatgctgccccagctgcacctcccctgctgcagctgccatctttgcagcagccactccagatgggccgctgctgccatcaagaccactagtaaacctgatagaaaagtaagaaatatactggaaagaattgccacaagcctggctcttgtgttaacctgtgttaagctaaagaaaatcaaatgattgtctgtgagcatgtaggtatatatgtatgtgagtgagtgatacaacagaatttcattcattttacagatgttgactgagcacctgactatgtgctaggccctggggatatagcactgaacaagatttcccctgcccttgtggagcttatagtctatttggagagatagatggtcaacaaattattacataaataattcatacagttgtgataggtactacaaagaagacgtataagttgctatgaaagtttataataggggaattttacgtatcctggaaagtcaaggggtgcttccctgaggaagtggtaataggggacggcccgctgaaggatggaggaagagctttccaagagagggacaacatgagcaagggctttgaaatgagaaggctggatgaactgcaggcttcctcagtgagaatgctgctggtattttggggggcacagttctttgtgggactttccctcatattgcaagatatttaacatccctggcccctcacccactaaatgccaataatggctttaaggctttgcaataatcaaaaactcctccatcctagttatttccaaacactccccggaagggaggtgctatccctagttgaaaaatcactgtgttaacggaactagaagttacattggaacaaaagggcatagggctccaagagggatatctgtgtaaggaaaaaacaaacaaaagaactgagagattacctgatgtggttgagctctgtcagagcatttcaggataaattagtcatagataataatataaaattcatcagtggaaaaaaatgaggcagttttccaaagaaaacaaaaacttgctcaaaaaagcaaatgtaattatagtatattctggctatagcaaagtagtttagttgtgaatattatttgcatagtgagaatataaagctgaatttaatataaggttatggcactgggaagacaggaagagttacatttgcgtgcactaaaggatgagacctaatgctttatcttctctataggaggtgaataagtacctcaaattaaaacatcaagttatggcacaatgagcatgctacttataattaattatggaggtaaataccaaaagggatggctaaaagagtttaaggtaggaatgagtatcagaagtgaggagggagggggtagaaaagggactgctgttttcatttataaatcttattcttatattatttcataaactccaaaccagagaagattcaggtttttggagatctggataataaaaagaatacaaaactatcaatacaaaattgtgagggctctcccagaggaagccatgcaaggaagggccctgaagcttacaagctttacttattcatggcaaatctacttctgctctgaacatgtattacttttataaaaaatgaaggaagaataaaagtactttgaacttcacttatatattttaattatttttaatgtatggaagttttttaagactatcatgctcaccattttcaatgagattgatagtcattataatgaaatgactggcccataaagacattcactccccgctcctttcccaatccaccctccagaatgaagccacttttataattttgtcaccaaatccagggatgagtgccaacagttaggaagctttcagttgcaaaagataaaaagcccaactcagttgccttaaacaaagaagaaatttattctttcacgtgacaggaaggcctgaggtgtaggcatttgaaatttgtagggttggttaatttggtggctcagggatgttttcaagtagcccaacttcctactctaccatcactagtttataggcttggtcttcagcccactgctcttcgtggtcatgacagctgtagttctaggcatcatgtctagataaggcaacattcaggggtagaaggggactgtttattttttcctttagtctctcttaaagagtgagaaaaattttcccaggaatcccggtggactttgcttcaccactcataggttcataccaagttacaaccccacaaccttagagcttttgttaggaagaggcttggtgggattaccgtgcttggcttggcttggtcaggattcaccaccagagtcatgtgggagggggtgggaacccaaacaattcaggattctgccctcaggaaataaaggagaaaatagctgttggataaactaccagcaggcactgctacagcccatgctttgtggtttaagggccagctagttacaatgacagctagttactgtttccatgtaattttcttaaaggtattaaatttttctaaatattagagctgtaacttccactttctcttgaaggcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaagtatgtgcatttctctatgttgcaaagtcatggattcctttaggtagctacattatcaacctttttgagaataaaatgaattgagagtgttacagtctaattctatatcacatgtaacttttatttggatatatcagtaatagtgctttttttttttttttttttttttttttttttttttttttttgagacagagtctcgctctgtcgccaggttggagtgcaatggtgcgatcttggctcactgcaagctccacctcccgggttcaagtgattctcctgcctcagcctcccaagtagctgggactacaggcgtgcgccaccacgcctggataatttttgtatttttagtagagatggggtttcaccatcttgggcaggctggtcttgaactcctgacatcatgatctgcctgccttagcctcccaaagtgctgggattacaggcgtgagccactgtacctggcctcccttcagactttttaagttggcattttacagcctgaccttttggcatttattttataaagtaaaagatttgtttttttaattgttccagtaagccttcatggccgtaatacatttgtctacaaaaattttattaatatgtctcactctgctgtagagagatctgtggatttgcatgatacaaccttgtacattattattccttttgttgacaagtgctatattttattttaaagaaaatcaaagggatttaggatattggcagaaatgcaagtatttcttcagtgtctaagatgtgttgccacttgatggatttaagttaacacttagggcttcttaggaacattatcagccactaaagccctttggttagggctcagtcatctcttcagttagtcttagagatgtggttcattgaataagactttagcatattttccaaccaagttatttttggttgtcttgtttttgcaagagtgaaacttgattaaaacattacaacaagaatattaagtagttttaaggaaacaaacacctaggttccttagcatctttaatcattagtcactaattattatgaccttgacatatccatcagtttgaggagaacactttttacaccttgtcctcagttttttaactgagtcagaactttcactgggcatgttcatgactttactgcttggctgagttttccagatatcaaagcccagctgcagcctgtgactttcacactcctggaaaagtagacgtatctgcctgctcttacagcaggctttagcttgcctttgctgggactttgttctgccctcagttaccacagtaattaggttgcctcttctactttcctcttttctcacaggcaccaggagccagaggaaataacataatagttgttgaccagagcagcagcataattctttcatgactgccttttctaatttgacgattccctctcctgagagggctctttgtgtcctcctcctcttcgtctccaacttttaaaaaaaaaaaagtgaaactatcaagtattgctcctgctaacttcagatcagtattttctttctctgaagccaatgcaaagtaataacggacgtgcttcatcatcttagcattcagcacacgtgtcaccatctctgatggtgtgagcatgttaaaccagacttgtgggtacttaccaaaaggttcagttgacactataggtcagttgctaaaaggcacaaatgtcttctaaagcaatctgttaaaagtcaacatttaacatttaattagaaaactgatcaaaggatctgaatgtttagttctcccaagaaaatgtaaaaatgatctgtaaacacataaaaagatactcagcatcattagccatcaaggaaatgcaaatcaaaaccacttcatactcactagattggctataataaaaaagatagacaataacaggtgttggtgaggatgcgaagaaactggaatcctcatacactgctggtgggaatgtaaaatagtatagtgattttggaaaacagttcggtagttctttgaaagattaaatatgacccggtaattctactcctaggtatatactcaagagaattttaaaacatatgtcaacacaaagacacatatacaatggtcatagtaatattgttcataacaggtaaaaacagaaacaacccacatgtctattaactgataagtggataataaatgtggtatattcatacaatggaatattacttggttataaaaagaaacaatctatcattagtacacttaggatgagcttgttactggcatgttggctgtgggaagtatatcttgaaattcactaaaagaccaactattgctgggcgcagtggctcaagcacctgtaatcccagcactttggaaggccaaggcaggcggaccacctgagatcaggagttcgagaccagcccaaccaacatggagaaaccccacctctactaaaaatacaaaattagcccattgtggtggcacatgcctgtagtcccagctactcaggaggctgaggcaggagaatcacttgaacctgggaggtggaggttgcagtgagctgagatcataccattgcactccagcctgggcaacaagagcgaaactccatctcaaaaaaaaaaaaaaaaagaccaactaccttcacaataaataaaaatgtcttacatttctaattaaaatttttgttcagttttattattcagctttaaaaaggaagggaattctgacatgttacaacatgaataaatcttgagtactttgtgctaagtgaaataagctagttacaaaaagaaaaatactgtatgattccacttacatcagagtagtcagaaagtagactggtggttgccaggggttaaggggaggggaaatgaagggtcgtttaatgggtgtagagtttcagttttacaagatgaaaagagttctgtggatggacgatggtaatggtagcacaatgatacgattatacctagtgtctttgaacggtgaacttaaaaagggttaagatgttaaacttgatgggtatcttaccacagttaaatttttattatttttttattttttgagacaatttcgctcgttgcctagggtggagtgcagtgctgggatctcagctcactgcaactctgcctcccaggttcaagcgatactcctgcctcagcctcccgagtagctgggactacaggcacacatcaccatacccggctaatttttatatttttagtagagacaaggtttcaccatgttggccaggctggtcttgaactcctgacctcaagtgatctgcccacctcagcctcccagagtgctgggattacaggtgtgagccactgtgcccggccaaaaaaattttttttaaataccgttaagaagtggaaaataaggccaggtgtggtggctcacacctgtaatcccagcactttgggagaccaaggttggtggatcacctgaggtttggagtttgagaccagcctggccaacatggtaaaacctcatatctactaaaaatacaaaattagccgggcgtggtggcgcatgtctgtaatcccagctattcgagaggctgcggcaggataattgcttgaaatcgggaggtggaggtttcagtgagccgagatcacttaaaaaaaaaaaggaaaataagctaccagctgagagaaaatatatgcaaatcatattgaagtcctgttaaaggacttgtatttaggatatataaaggatgcttacaacttaatacgaagacgatagcccaaatttaagatagggaaatgctttgactagacattctaccaaaagagatatataatggctaaaaagcacatgaaaagatgctcaacatcattaatcagagtggctagaatgaaaaaggctaacaataccaagagctggtgaggatgtgaaaaaactggaactctcaattgttgctggtggaaattcagactggtacagccagtgtggaatgtgatttggcagtttattaaaaagctaaaaacctaaacttacatagcccagcaattgcacccccaggagtctacccaatggaaatgaaaacagtccgtccccacagagacatggacataaatgttcatagcagcattattcagaatagccccaaattgaaaacaatccagatgtccatcaactggtaaatggataagcaaaccatataatggaaaaccattcagcttccaataacttccaagaaactgtagacacatgcagtatcatggttaaacctcaaaaacattatattaagtaaaataggcgaggcatgtattgtatgagtcatatgaaatgtctagaaaaggcaaatttattgagatagaaagcagatcactggttgcttaaggcctagggtaggagtggggattaactgtaaacgggtacaaggtacctgactggggcaatggacatgtggattgtgatgatagttaaattgtacagctctctctatatatagttgtacagctctattaattttccacaatcattgaatcatgtcttccagttttatgaggtaaatcatagtccaatgaagcttttttaaaaataagatgataggccatgcgtggtggctcacgtctgtaatcccagcactttgggaggccaaggtgggtggatcatgaggtcaggagttcgagaccagcctgaccaacatggtgaaaccctgtctccatcaaaaataaaaaaattagccaggcatggtggcatgcgcctgtaatcccacctactcaggaggctgagacaggaaagtcgcttgaacctgggcggcagagtctgcagtgagccgagatcatgctgctgtactccagcctgggccacagagcaaaactccatctcaaaaaaaaaaaaaatattaattaatatgataaaatgatgcctatctcagaattcttgtaaggatttcttagtacaagtgctgggtataaactatatattcaatagatgacgattattacttattattgttattgataaataacagcagcatctacagttaagactccagagtcagtcacatagaatctggaactcctattgtagaaaaccaaaaaagaaagaaaacacagctgaagcctaattttgtatatcatttactgacttctctcattcattgtggggttgagtagggcagtgatatttttgaattgtgaaatcatagcaaagagtgaccaactttttaatatttgtaacctttcctttttagggggagtaaaacttggattgggagatttcattttctacagtgttctggttggtaaagcctcagcaacagccagtggagactggaacacaaccatagcctgtttcgtagccatattaattgtaagtatacactaataagaatgtgtcagagctcttaatgtcaaaactttgattacacagtccctttaaggcagttctgttttaaccccaggtgggttaaatattccagctatctgaggagctttttgataattggacctcaccttagtagttctctaccctggccacacattagaatcacttgggagcttttaaaactgtaagctctgccctgagatattcttactcaatttaattgtgtagtttttaaaattccccaggaaattctggtatttctgtttaggaaccgctgcctcaagcctagcagcacagatatgtaggaaattagctctgtaaggttggtcttacagggataaacagatccttccttagtccctggacttaatcactgagagtttggtggtggttttgcatttaatgacacaacctgtagcatgcagtgttacttaagacagcaagcatctagtgagaggagctggtgccatgcatgaccccacatagatcttgctgatagtgctacagcatgaaccctgaagctttcaaaactatgatttttttttttttttttttttgagacggagtctctgtcacccaggctggagtggtgcaatctcggctcattgcaacctctgcctcccagatttaagtgattctctgcctcagcctcccgagtagctgggattacaggtgcctgccaccacgcccggctaatttttgtatttttagtagaaacagggtttcaccatgttggccaggctcctcttgaactcctgacctcaagtgatgtgcctgcctcggcctcccaaagtgctgggattacaggcgtgagccaccgcacctggcttttttttttttttttttttttggagacagagtcttgctctgtcgcccaaactagagtgcagtgacattagctcactgcaacttctgcctcctaggttcaagcgatcctcctgtctcagcctcccaagtagctggaattacatgtgtgcaccaccatgcctggctaatttttgtatttttagtggagatgaggttttgccacattgcccaggctggtctcaaacttctgacctcaactgatctgcctgcctcagccgcataaagtgctgggattacaggcatgagccactgtgcccaacctgaaaactatgatttaagtaaacaacccataaaatatttcttgctatttttactaaagatgtgttatcttggccgggtgaagactttctagtgtttccgtaactagggtaaaaaatgaactctattatatggcttgtacatgtgtttacaagaaagcagtgtactcctcataaataaacttttagtttattttattttttaaacactgcagcctcatcatgcttcacggaggagcctgtgcgggaagaatgctcccacacagcataaagaatgctcccgcacagcatagagaatgcccccgcacagcatagagaagcccccgcacagcatagagaatgcccccgcacagcatagagaagcccccgcacagcatagagaatgctcttcacctctgggtttttaaccagccaaactaaaatcacagaggccaacacatcatttaagatagaaatttctgtatcttttaatttttttcaaagtagttttacttattttcagattctatttctttactagaattaagggataaaataacaatgtgtgcataatgaaccctatgaaacaaacaaaagctaggtttttttcatagctcttcttccagattgaatgaacgtctgttctaaaatttaaccccaaaaggaaaatattcagttaactatgttaaaaaccaagacttgtgattgagttttgcctgaaaatgctttcataattatgtgtgaatgtgtgtctttcccatcttctccacagggtttgtgccttacattattactccttgccattttcaagaaagcattgccagctcttccaatctccatcacctttgggcttgttttctactttgccacagattatcttgtacagccttttatggaccaattagcattccatcaattttatatctagcatatttgcggttagaatcccatggatgtttcttctttgactataacaaaatctggggaggacaaaggtgattttcctgtgtccacatctaacaaagtcaagattcccggctggacttttgcagcttccttccaagtcttcctgaccaccttgcactattggactttggaaggaggtgcctatagaaaacgattttgaacatacttcatcgcagtggactgtgtccctcggtgcagaaactaccagatttgagggacgaggtcaaggagatatgataggcccggaagttgctgtgccccatcagcagcttgacgcgtggtcacaggacgatttcactgacactgcgaactctcaggactaccgttaccaagaggttaggtgaagtggtttaaaccaaacggaactcttcatcttaaactacacgttgaaaatcaacccaataattctgtattaactgaattctgaacttttcaggaggtactgtgaggaagagcaggcaccagcagcagaatggggaatggagaggtgggcaggggttccagcttccctttgattttttgctgcagactcatcctttttaaatgagacttgttttcccctctctttgagtcaagtcaaatatgtagattgcctttggcaattcttcttctcaagcactgacactcattaccgtctgtgattgccatttcttcccaaggccagtctgaacctgaggttgctttatcctaaaagttttaacctcaggttccaaattcagtaaattttggaaacagtacagctatttctcatcaattctctatcatgttgaagtcaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgaagcactttctgtcctggtattttgtttttgcttttgctacacagtagctcagaatttgaacaaatagccaaaagctggtggttgatgaattatgaactagttgtatcaacacaaagcaagagttggggaaagccatatttaacttggtgagctgtgggagaacctggtggcagaaggagaaccaactgccaaggggaaagagaaggggcctccagcagcgaaggggatacagtgagctaatgatgtcaaggaggagtttcaggttattctcgtcagctccacaaatgggtgctttgtggtctctgcccgcgttacctttcctctcaatgtacctttgtgtgaactgggcagtggaggtgcctgctgcagttaccatggagttcaggctctgggcagctcagtcaggcaaaacacacaaacagccatcagcctgtgtgggctcagggcacctctggacaaaggcttgtggggcataaccttctttaccacagagagcccttagctatgctgatcagaccgtaagcgtttatgagaaacttagtttcctcctgtggctgaggaggggccagctttttcttcttttgcctgctgttttctctcccaatctatgatatgatatgacctggtttggggctgtctttggtgtttagaatatttgttttctgtcccaggatatttcttataagaacctaacttcaagagtagtgtgcgagtactgatctgaatttaaattaaaattggcttatattaggcagtcacagacaggaaaaataagagctatgcaaagaaagggggatttaaagtagtaggttctatcatctcaattcatttttttccatgaaatcccttcttccaagattcattccctctctcagacatgtgctagcatgggtattatcattgagaaagcacagctacagcaaagccacctgaatagcaatttgtgattggaagcattcttgagggatccctaatctagagtaatttatttgtgtaaggatcccaaatgtgttgcacctttcatgatacatttcttctctgaagagggtacgtggggtgtgtgtatttaaatccatcctatgtattactgattgtcctgtgtagaaagatggcaattattctgtctctttctccaagtttgagccacatctcagccacattgttagacagtgtacagagaacctatctttcctttttttttttttaaaggacaggattttgctgtgttgcccaggctagacttgaactcctgggctcaagtaatccacctcagcctgagtagctgagactacagcccatcttatttctttaaatcattcatctcaggcagagaacttttccctcaaacattctttttagaattagttcagtcattcctaaaacatccaaatgctagtcttccaccatgaaaaatagattgtcactggaaagaacagtagcaatttccataaggatgtgccttcactcacacgggacaggcggtggttatagagtcgggcaaaaccagcagtagagtatgaccagccaagccaatctgcttaataaaaagatggaagacagtaaggaaggaaagtagccactaagagtctgagtctgactgggctacagaataaagggtatttatggacagaatgtcattacatgcctatgggaataccaatcatatttggaagatttgcagattttttttcagagaggaaagactcaccttcctgtttttggttctcagtaggttcgtgtgtgttcctagaatcacagctctgactccaaatgactcaatttctcaattagaaaaagtagaagctttctaagcaacttggaagaaaacagtcataagtaagcaatttgttgattttactacagaagcaacaactgaagaggcagtgtttttactttcagactccgggattcccattctgtagtctctctgcttttaaaaaccctccttttgcaatagatgcccaaacagatgatgtttattacttgttatttacgtggcctca

SEQ ID NO: 12671 - DNA, 51698 bp, Human
  misc_feature (1)...(51698): n = A,T,C or G
gttgcagtgagccaagattgcaccattacattccagcctgggtgattgagtgagactccatctcaaaaataatgaaataaaataaaataaaatagtaaagttgagactagccactagtggtcttgtgtgattttccaccagccagatttcagctacttaggggaatgtatgtagtaggtggatggttggatttagctagagttgaggctttgccagctgagactggaatataattccaatagaaaaacctgtaatattatttgtattagggttctgtaaagaaacagaaccaatagtatatggaggggtgtgtgtgtgtgtgtttaaatttattataaggaattggctcacacatttatagaggctgagaagtttcccaatctgctgtctgcaagctggagacccaggaaagctggtggtgtcattctgagactagagggccaatgatgtaagtcccattctgagggcagaggattgatgtcccagctcaaccaatcagagagaattccctcttcctcaagccttattttattcacgtcctcaatggattggatcatgtctggtcacactggggagggcaatctgttttattcagtacactgattcaaatgagattagctcatccagaaacaccctcacagacatacccagaaatagtatttaatttgagtaccccatgtctcagtcaagttgatatataaaattatctattattggacttgcctcacatattgaaaaactatatatatgatttgaccttgaatctatagagttaattttgtttaagaaaatctttaatcagctaggtattagaggagtggttactttactttcattctcattttgaccttggtttgtatttttattctttcatacttctgatatgacttagtcctttatttaatagatataaatctgtttcttagtgtcagtagctcttctcatttagagtatatcatagcatgtgcatatttttctagttctcaagacagggaaatcttttaccagtgattttcattctttattcttcattgggtcttggaaacttgaattttaggccttttacttattctcttattttttattaagcatatcattttcacatctgataatagaatatttgtaatgtcaggaaatttttcttgctgcctcagtttatctttaaaattaagtagtgttcattaaattatctccaagatacttacgtgttctgaaaatactatgattatgtgttagatattttatactgataatataatattcatagtcttagttttattctgattagcttcaactactaatcttgttcaaggctaaattaggcccttaaagaattttacattgtctctaagcagttatagttgggctaccataacttaatggatattgtcgtattttcacaagaaggaagcaatatttgaagagcctttgtcttttgcatgcatgcctgatagtgaaggttaatactgggttaatagatccattgcttctaagcagttggaggaggactggaatcaagagactccatttggagaaaaaaaacagtttggcaataaaaatcacaactggaaacttgtgaaactcaagaattctacatgtatagaaaaaaaatcacactagaaggacattcttgtgaagcagcagttttcttagctttggattcttggagggcctattataaggcaaattatatacttatgaattaacacaattaaagtcattgggtagaaagtgcctgctgttgatgtttctcactttgcattatccattgaaaataaacgtgcaaaaactcttcttcattgaaacatttaacttttggcctttcagacaataaaatgtctctgttgctaccttgtatgcaagccaggtctttgaatccaaaggtataattttatctactgtttcagccctattgctttcatttgtctggctatggtagatttatatgaagaaaatgagggcttattgtttcagcaagtgtaatgagcaatgtgtttttcctttaggatcaaacagagcatactgaatcagcaggactggctggtggtgcagcagacatcatgagtaagcaccgagaagtctgttccttatcacgtgtgtaaggggaaaaaggtaagaaaatgtttttatttctcttagagattgaacttgagaaaccaatgagatctatagaagataatgctgatgcatatatgttacttgcatcatttataacattgtgtcttattaaatcaggagtatgctttttttcaaaaagatttgacttaaattcagaggaaaagggtatttaaaaatcactgttattttgtgtcacaatggtcacaatgttaatttccctcccagtgctggctccttcgttttagagtttgttgaccatagaaaggtaatttcagaaaaaatatggatttgagcaatatttaagctcatgcaagagctaaacaagtaaagctaatttggtgatggggaatcagaaatgtaaatttaattatgttattttattttgtatttttaggtaagttattatgtagagcaataatttccagcagaaaactggaagtattcttgtagaacaggaatccttgtctttttcctaactaggagtcatgttgttttttttcaagtcttaagattatttaagggtgtgaacccccaatatctgtgttggaaacaagtgcttgatgtagccaaaagaaacccgcacttagacagaaattttctcagcaaggcacttttacttctgcagaagggtgctgcttgcacctattacaaatgcaagagcacaccgaacaaaggaaggaaggggtttttaaccctaacacagttcctgtttctgtatcttttccctattggctagggttggattgcacaatctaagctgatcccaactagccaaggcttaaacttttccaaacagggtaaatgtgagatttgtgaaggggcggggtgggtaaagaagaaatggttagacttaacagaagcgggggtaggattgtttacaacttatgaccaggaagttgagtctttgaagaggaactcaagtcgtcccaacaatttcccctcttctgtcttacagttcttcatcttcagatttctttaacaggatctggctttgttgttcttcttgattatcaaggtgcgagagcttatctgagtacggagggggagaggttggggaggtttttgtgagagctgcttctatgagcctttgggttaacccacgaatacaaggtatgatacagcaaccgacaaggatgagtacatctttaacaattgcaagggaagtaaagattgaggtcatgagtcccttccattttccaaaccacctttccattaggcctgtaaaggggtcgtctattccagagtttttggctaattgatttgctagggtggtaaggccttgtaaggcttttatgattgtcccatcaggggctgtattattaggaataaaagtacaacactggaccgtgatcatgacatagactctgccttttttggccaacaccatgtcaagggttattctgttttcccagaccatctggctgatggggcctagtttcagcgattccttttatggcatctctggtataattgatgaattgctgctgattgtagtatatgtgatttatccagtctacgtttttgtttatagtggaccaccagaataagatagactcgaacctggcggctatttggttttgagctttgaattcatttggtaccctccgcaggaccctgatgctgtctatgtaaacttgagggtcaaaggacccatttattggggcttctttttttcttctggttacctgcttcctgatgaaatgccatggtgaaagccatggccagttgaatcagagcacaagtgccactccagttgcttggcagtgtaccaaatattggtcccccacaataccaccatacatcctctcggggatggactagggctgactgattggttatctcttgaaaaggtttaggcccactacatcccatcaggtttccaaggaatgtcaaattttccccttgttgtgaaagacacaaggtaaaattggcatcgagagctggaagttgaatggcccttgggggctgtcccataggggtcctgacctttggggaaaatagtgagtgagtggcacatgacatgtttccccaggctgtggggtgctggaagagagctaccatacagtctttgcctgatggattggcccatccgagtgggaggggaacagtttgggtttctggcctgcctgttgcacaagcgtaacaatctgttttatttagggtgcgaatggaatatttaatcaattccagctaggcatttacatcttgataactggtttctatggctagggtttgctgtaaatccttaacttctactatagctactttggttttgtcagtaggcatgaagcgagaaatggtttgatttttgtggttttgggaagcgggtaatggggggagatggaggaggaggagcaaacctcatttcaaagatgcctgtagggtcttttgcagtgacatctgctcctaggccataaaggtgctctaaagtggggatagggtcagtggaggtggggataggaatagagagaagtactgggttacactggtggttttggcaatttgagggggtggttcctttggtgaagtggaggtagggttttagggcggtgcgaccctctgaggaggtccagccctgatatttcgtggtccagataatatctccccaactataacataacccctggaaggcttgtggtcgttgattgcaagggtcgggggtggtgctggtttttctggggatggggggcagaggtacttttctgaagaagctagctgtctttgactatggaggtttccacagggtatgacaagacaggcatcgaatgtaattgtggggagggtgatcgggttacattgataataaggtgtccttgggtagctaaaggaagaataaaaagacagattaaacctttttgaatgttagtttggagggtattgatcctggaatgatggtccatgactttgcaatggttgcggccccttttagcccagtgtggtgggtccatgcttttttggccgttcagattgctgtctcagtggttaggagtattagataaggagtattagataaggtccttcccaggttggttcaagctttccttctttccaacatatgataaggacgtgatctctgggctggtgtcggtgaattgggaattcgaggggtggagtttgcgctaggaggccttgagtcctgagggaggaaagggtggaagacagaccaaatatatatatttttagaaactgatcttttgtttcaaatgtgggaaggtcagtagtggaatttagataaggcagcccatagagcatttcaggccaagatcttttgtgtgtgtgtgtgtgtgtgtgtgtgtgtgtgtgtgtgtgtgtgtgtgtgtgtgtgtggcagagtcttactctgtcgcccgggctggagtgcagtgatcttggctcactgcaacctgcacctcccaggttcaagcaattctcctgccttggcctcctgagtagctgggactacaggcaccagccaccacgcccggctaatttttgtatttttagtagagacggggtttcaccatattggccaggctggtctcgaactcctgaccttgtgatccaccctccttggcctcccaaagtgctgggattacaggtgtgagccaccacaccctgccaggccaagatctttttgaggggcagtttggattcttagtaaggcaatgggaaggcattttgtccatggtaactggatttccaagattaatttggttaggtgattttttagagtttgattaattctttctaccctccctgatgaaggtggatgccagggagtatgatattcccattttattcctagtgcttgggttagccccttaatgatgtgtgcagtgaagtgagtctcattgtctgaatcagtgttctctattagtccaaacctggatatgatatgttccaacagtgctttgactacattactggcagttgtgcttgggaagggtatggcttctacccagtgggtgagatggtctactatgactagtaaatacttgaggcagccgattgggggcatttcagtttaatcaacttggatgctttggaatggccttaaccctgggtttcttcccgtgggaggctgcttctttagggtttccttactagtttttctgcacatgatgcaaccatcttccacttgcctagtactctatacacccatagactctgagggctacattgcacatagcttgaggaccccagtgagttcctggatgaagctgtgacaatatttccctcatgaggggcttagacagcatttcccttccatctggtaatgcctgctttccctctgggctctcctgagctcctattttctttagagaaaggtctacgtgggagaagatggggatcgcagctggagggggaaacaaagggatagatggaaaatgggtgccttttcggaagaggcagcttgcttagctgtttgatctgcaaggttatttccctggctttcaaaagatggattcttttggtgtcctgggacatggacaactgcaatttcttctggcagctgaagattttctaatacttgcaaaattaattttttgtggaccaaatcttggcccttactattgatgaagcctcgttcagtccagatttttccaaaggtatggactactctgaaggcatacttggagtcagtgtaaatagttccttcttgattctgcagggattttaaggcttggtttaatgcaaagaattcacagtttgggcagaccagttatttggcagtcttcctgactctacctctgtgaggatttccccatcaactgtggagtacctgttgtacctttttccttcaatgatccggggggaaccatctgtaaagaggtgatgccctgtttggaaaggggttttgcttagatccagtctgactctagtttgagaactgattagatctaagcatttatgcgtagattcttctgggtttggatttcctgttaggaaagcagcggggttgagtgaattgtcagtggttagtgttaggtcatccctctctaataagataacttcatattttaaaattcttgagtcagtaagccatctctctgccttctgattaagaatagttctgacttgatgaggggtacttatgatgaggtttcccccaaaggttattttcctgctttcttctgttagcaaggcagttgctgctatggattggacacattcgggccatccacgggttacggggtcaaggatttttgacaggaaggctacgggccattggtggcctccgtgtttgtgggtgagtactcctaaggccactcctttgcttatattaacaaaaaggtggaatggctgttctaaggagggcaaggccagaatgggggctgttacaagtaggtgttttatttcttctacctgttggatctctgatggggtccagaggagggtttacagggtctggtctttcttgagtgagtttttgatataggggctttgtttttaaggcataagagttaatccacagatgacaatatccaaccaatcctgagaatttcctaagttcctgctttgtttcaggtaaaggcaaagataccataccttcaatttgtttgggtcctatctttcgtttgcctttactgattaggtgtcctaggtatttcacctcaggttctacgaattggagtttattctttgagacctgtaacccttgttcccttaggaaatttaggaagttaactgaaattgctgttacttgatccttgttatctcctgagatgagcaggtcatccacatattggagaaggcatatggatgaaggcagggagaaattttctagaacttgttctaatatttgaccaaatagatctggggactctgtgaacccttggggcaagactgtccatcagtactgttgttttctatcagagtcagggtcctcctactcaaaggcaaacatgtcccgactatcttctgctgaagggcaagcccaaaaggcatcttttaaatctatcaccatgaaccattggtggttgtatgggattctactgacaatggtgtaaggattgggaacaacagggtgggcggtttgaactatttgattaatagcctggaggtcttgcactagccgggatgacctgtctggcttccttacaggcaatattggagtgttataagggggcatacagggttcaaggagtccatcgtggacaaggctttcaattatatgttttaaacctatcctggcttccaagggaatagggtattgttttgtttttactgcttccctggtagtttttaatttggcatggattggaggaacctgtagctttcctcgatttccttcctttgaccatatgtcgggatggatttggctttcttccgaagtggtgaccaggtttaaggaagtaagttttccctgattaacgtataggcctatgcctaaccttaacattaagtcccttcctaataaattagttcctgctttgggaattaataagaacttagtagtggccgacttattcttatatttgactttggtttcctctagaatttttgccctgaatccttcccctataaaccctgagacagtatggttttctgctgaaaatgctaagcctgatgggagaaaacatagggaaagcgagctgctcctgaatcgactaagaaagtgactatctctgatttgggtcccaccattaaatttatcaggggctcttggtgggactcaagatggaagatgtagagtacctgaccccgctattcttcttcaaatgtcatgagtggaaggactttcttttccctctcccattcaggacattccctcttaaaatgtcctggctttccacactagaaacatctgttttcccttctccccctccctgttccctgactctcaggtttcatccctttgcttcctgtataggggtcagacagccaggtgcttagaaggtctacaagttctattctcctgggctccctgttgaagagttccctgttgtagggtggacaggcataatctttgccttttgcttctgcctttcctcatccctctctacatacaccttttgggcctcttaaaagttcctctatgggatggtctttccaattttctatcttttgtattttttttgtaatgtctggccaactattggtgacaaagtggagctttaacattccttgtcccagtgggtcctctatgtctaaacctgcatattttcttatctgttccttaagtctaagaattctatgggcctttcatctttcccttgttgtacattaaatgctcaggaaacattagggttcaaggagctgattcccaaatccctttaattatcatgtccctgagatctctcatgttttctcagtgggcttcattattgttatcccactgagggtcctgggccaggaatttatgctctgctgcaaggacattttgaacaggagggtgtttgcgctcccagactatcatggcagccctgaagatcatggttctttcctttcctgagaagagaataactaggatagacattaattcagcccaagtgtacagttgtggctccagagactgtccagtttgatctgcgattccaaaagggtcgtctaacagtggtttgagttccttttttagatttctaacctctgaactagttaagggggcatttacaaagccaatatcccctcctcctagtggtacttcccttaagggaaaaagggttggggtagacttctttgaggaagggaggaaaggaaagttttggatatccctttggcattgtctatttcccattggagctttcctgaggaaggggcatgttcaggtggctgtccagcggggatgtggggtggcatggcccatggggcagggttatatgggagaggaactgagtgttcagcttggggtggaggggtagggaggggaaggactgagtgttccacttagggtggaggggtaggcaggggaaggtggtctagaggatcccatgcatctttagatacagaatttgacttaggtaggtcgtctttgggaggtattgaatttggctttgctttctcatcctttaggggatagagaaggacaggtctttttctccaacatagagcatcatctgtctcctcttgagaaactggacttttatcattgacttactggatcaggagttgacatatccagtcctcattttacccaaactctggccaaaagactgaaggtctgagggtgggttccttagtccaaataaaaacagcaatactttatcatacgctgtcttttcttgtgttttgtcctttcattatccttccagtattttaacataaggcataggggactgtcagggggaattttattgtctgcttggccttttatagtccctgtcttacttggggtatttcccatcctggcggttggtgaggctaaatgtctcgtattagagatttcttgcactcccgtgtcctagaggctgaacctccccttttcccactggaggtttcttgcactcttgtgagcacccactttgtccttattggctgcttccctcgtgagaattttaggttcctcttagtattggtgggttggtgtaatcccctgactggaaaactgccctaagacctacaaggtgaccacagaaccgagtccggactccacactcgcttcgcacccaatggcgtgtctcactcacacactttcaacctacagagatcccaaccaccaaggaatactttgttgccccaatagtgacgtttcttaccttggtctatgcacagagttatctggtcactgaggaattcttagggatcctccctatagcccatgttgctgagagtccggatttattcgtcactttgggcgagattcgatcctccactcctggggccaccacaacgaggcagtgggatgcgtctccccatgaaagataatcactagcccctcccaaaggagaatgggatcctggacaagcccccagatttgttggaaacaagtgctcagtgtagtgaaaagaaacccgcatttagaagttttctcagcaaggaactttacttctgccgaagggtgctgcttatgcctgttacaaatacaagagcacaccaaacgaaggaaggggtttttaaccctaacacagttcctgtttctgtgtctttcccatgttggatgggtcggactgcacaatctaagctgatcccgattggccaaggcttaaacttttccaaatagggtaaaagtgtgatttgtgaaggggtggcggtaaagaagaaacagttaggcttaacagaagaaggggtaggattgtttacaacttatgaccaggaagttgagtctttgaagaggaactaaattgtcccaacatctgggacaggtctcagtttatttagaaagtttattttgccaaggttgaggacacccaagaggtcctgatgaagcaactgtgttgtctgaggtatacacccaaggttcatcgtcttgtgccaggaaaatttaggacaccgacacacacgaggagtttaggagcagaggtttaataaacagaagaaaggagaaagaaaaacagctctctctattgagagagacgggtcttccgagggaaaagactggcaggtggtggatgcgccggattttatagtccagcttgaggaggcggtgtctgatttatgtagagctcacagattggttcgatcaggtatgaagtttacatagcatgcagggaaggctggttgccccaccctaatcttattatgcaaacgaactttctccttggcaggtgccatcttatctgctccttactgtacatgtggctggcagagaagggaagatggagcctccatcttgagcatgtctagtccctagttcctgctggcattcacccgtgcaagctcccagcttccttgtctgtgtctgcagctcgacttcacagactgctctttgttagaaaatgatttccagcctggccaacgtggtgaaaccccatctctactaaaaatacaaaaattagccgggcatggtggcacaagcctgtaatcccagctactcgggaggctgaggcaggagaatcgcttgaacccaggaggcagaggttgcagtgagccgagatcatgccactgcactccagcctgggtagcagagtgagactctgtctcaaaaagaaaaaagaaaatgatttggggctacttttcattaaaaagaaaagccttactgaggactctcgtacccttactatctgcctaagtgatttcttcttaactcctgtatcactgacaacacgtgcccagggttctcagagcacaacttggttttatacattttagggagacatgagacatcaatcaacatatgtaagatgaacattggttctgtccggaaaggcgggacaattcaaagcaaaggcaggactactggaagcagggagtgggcttccagatcataggtagataaaagacaaatgattgcattcttttgaatttctgattagcctctccaaaggaggcaacagatgtgcatttatctcattgagcagaagggtaactttgaatagaatgggagggatgtttgccctaagcagttcccagcttgacttttccctttagcttagtgattttggggccccaagattttcctttcagaaggggtagaaaatggtggagggtatataggtgagaaaggttacaaaaactgattacactactcactaatggaatgttgcatactctggttgagttatctgacttttccatgtaagctgtaaggaaaggcatggtgggaccagcagtgtttaataggaaactgagccacttttctcttcagttgagggtggagcagaggtacttggcagcaatgccttcttcaccaaaactctgagtctgcagttggcaagctatttctcctcctttagccttttcacatgggagtgtgagaagatagtgccctcttttctgccttcacttgccaaaatctcatccttcaggcgttgcctctttaggaagtttccacccattgtagcaaaaactatcagttatccaccaaagtcaccaaaatccatttttcccttctgtagtagccacagctgtgatgtcacagtccaatcagcctttgcagctgtgtattcaccatcacagttaagatacagcataattctatcaccacagagatccttattgctactcctttgtagttgcatgtaccctctcccctgactatccaatatttaatgactttttaaagttaaaaacactgttaaaactcataggaagagctgggttagcataaaggcaaaccctagtatgttcctggatgagaagacttaatatcattctttctcctgagtgaggactaggttaggaattctaatttctcatggtttattttattggcactctattccatcctgctccattgctgagtcttgggaccatggaggggactttttctgtagctcctggcttcatgtagaaagctcagtttagcccctctggtgcataaatttctatgtttgcagccagtaattcttattcttcctgctacctttcaaaacccaggcttaaaggttgctgtctagttttgatactcctatggactgccactcttcagttcctgctttccttctaggtttatggcatctgtgtatttccctttcttgcttttgaatttgactgtttaaactcttttaaaatattttatttagaatttttttatttatttatttttgagacagggtctcactctgttgctgaggctagagtgcagtgccaccatcatggcccactgcaacctccgtctcctgagctgaagcaatcttcctgcctcagcctcatgagtagctgggattacaggcatgtgtcaccacacccagcgaatttttaaaattttctgtagatacggagtctcactatgttgtccaggctgatctcaaactcttggcctcaagcgatctcacaccttggcctcccaaagtgctaaactctttaaaataattagttttgtctagaatttttttatttagagtaggaaggaatgtttaccacccatcagctcagtgtgcccttttttcttttaagaaatcttaagcctgcagaaaaatggaaagactagaacaattaagacccatatatccttcagctagagttatcagtttttaccattttgtcccttttgcacacctttcttcccttcccacacatatactctcacatcatttaaaagttagttgcagacaacacaacacttcttccctaaacacttcagcaggcatctcctaagagaacaagtaagggcattcccctacaaaatcagaatgccattatcacatctaagaaaatgataattaattcaatgtgtcacccaatgtatcgtccatatccaaatttcttctgagattgttctcaaaatgttaatttatgctgtgtgtgtgtatatgtgtgttttcttgatccagaatcaagtcagtgcctgacacttggttatttaatattttgtctgttctagttgagaataatcttttttcctttttttttttttaaagacgaggtcttgctctgtcacctaggctagaatgcagtggtgcagtcatagctcactgtaacctcgaactcctgggcttaagcgattctcctacctcaacctcttgagtagctgcaccaccacacctggctaatttttatttttatttttgttgatgttgcccaggctgctcttgaacttctgggctcaagcgatccaatcctccacctcagcctaccaaagtactgggattacagatgtgagccactgcgcctagccacatataatattttggaaagttcagatcagatacagaatgtctcacattctagatttgtcttattgtctcctcatgattaaatcggctaaatgttttggcaagaatactgtataggtgatgttttatatttttcattgcatcatattggaaagtgcataatgtcagcttgttaaactgttgtggtggtactgagttaaatcatttggctaaggtgatgatttctatatctcttcattgtaaacatacatttccttctttgaaattagtgatttacctgtggaatgataatgtgaggtactgtgaatagtttcttccccaataataatttacttaatagtttagcatccatttttgatgcttgtttgaatcagttatcgtaactggaattcagtacaacttattgaccagctgcttatacactgttcatttattcattctgcagttattaattgaaatagataccacattagcacatcaggctctatgtgaatcaccaggaatacatggtgaacacagtctggtgggtgcccttgtggtgcctacagtctggtgggagagattgacaaataatcacactgatgtgtatttatagatggtgataaatattttaaggaccaagaatggggtgccatgagggattgttgttgtagaaaaagcgggttcttgtcaaacaaccaggaaagattaggctcacagacacttttttttttttttttggagacggagtctcgctctgtcgcccaggctggagtgcagtggtgtgatctcggctcactgcaagctccgcctcccaggttcacgccattctcctgcctcagcttcctgagtagctgggactacaggcgcttgccaccacgtccagctaatttttttgtatttttagtagagacggggtttcaccgtgttagccaggatggtctccatctcctgacctcgtgatctgcctgccttggcctcccaaagtgctgggattacaggcgtgagcctccgcgccctgcctaggctcacagacactttgaagggtgagggggaaggcaaaaaggaaaaaactcagcaaagcgagaggggttcctgttaacaggctcccatctcacagattgaatcccatgttaccacacaggaacaggagaggcaaacggagtgaacttcccaaggccccaccccgtcctcccagtgtgcagtgcgcaggtgggcatccagaaagaatcagtcaaacagggaggtgaacaacacacaccagggcctgttgcgggggtggggatcgtacttagaggatgagtcagtaggtgcagcagaccaccacagcacacatatacctatgtaatctgcatgttctgcacatgtatcctggaacttaaaaaaaaaaaaaaaaagaatcagttggaaaagggcaggcttcatccaggatgggcaatttggtttttcagccctcatgctgttttaaacttgaaggtggggttttgctggggtacccttggctgcctcctgtctctatctgtccccttataaggggagccatcaccttttctgggggttcacataacacttgcctttgaaagtgatatttgagcaaagagatcaaatgaagaatgatgaacttaaataacctcttgaacttctgtactagttattctgtagcacttatctgttaattttatctgacaggttaatcacttgctgtctcctgtgctgttattaaaatcatttattatttaaattttcttacttagccttgtttactgttgactaaattataagctttataatgttagggatgatatctgagacttgattacagtatagatgcatatagtagatgcagtaggtaaatatgttaatctgattatttgtttactaatatttttataatgaccataaaatgctgttaaatattgtaggtgtatattgaatgtgtcagattgtgtgttgtgagaaatttcatttgctcttagcattagtagacattaaatgtgcaacctatctgaaatggcatgcatataaaaatgattttgacctataaataattagacaacaaagatagatatttaaaaaaattcatagattatgggctgggtgtggtggctcatgcgtgtaatcccagcactttggaaggctgaggtgggcagatcacttgaggtcaggagtttgagaccagcctggccaacatggtgaaaccctgtctctactaaaaatacaaaaattagccaggcatggtggcacacacctgtagccccagctactctggagggtgaggcaggagaatcgcttgaatccaggagggggaggttgcagtgagctgagattgagccactgcactccagcctgggtgacagagtgagannnnnnnnnnnnnnnnnnnnnnnnnnnnnnnnnnnnnnnnnnnnnnnnnnnnnnnnnnnnnnnnnnnnnnnnnnnnnnnnntaggagccaatctataaatgttaaccaagttaataatcatgggaaaatactctttctttttttgagatggagcttcacacttgttgcccaggctggagtgcagtggtgcaatctcggctcactgcaacctccacctcccgggttcaagtgattctccctcctcagcctcctgagtagctgggactacaggcacacgctaccactcctgcctaattttttgtgtatttttactagagacgaggtttcaccacgttggccaggctggtctcaaactcctgacctcaggtgatctacccacgttggccttgcaaagtgctggaattacaggcatgagccacgacgcctggccgggaaatacttgaataagtcagttaaattccctgagcttgttttcttatttgtaaaatgagggaaatatcattgacacttatatacctcagagaagaagaaacactaccttagtaagtcaaagaaatttcatcacttattatatttgacttaaagtttacaaagacagcctattacatttctgattttctctgtttttcatgttttccttactcagactttttggggaatttgtaatttgacctcccctgcctgtattatatcaataagaagccaagcagaattttcagtttggaaagaaaaatttgaaacactaaggaaataggtgtggagatcatggtaatggatggaaaaaaggagataataggtagcatttacttaacacctattatgtgcccttagcatctgttaagtcattgacatacctagtgtatatgcccaaggatgcttttggatcgattaacattaaagaaatggtttagaaatggtactcgaagagggttacaagaataaccaggtcagggccaagtgcatggctcatgcctgtaatcccagcactttgggagactgaggtgggcggatcacttgaggtcaggagtttgagaccagcctggccaacatggtgaaaccctgtctctactaaaaatacaaaattagctggacatggtggtgcttgcctgtaatcccagctacttgggaggctaaagcaggagaatcgcttgaactcgggaggcagaggttgcagtgagccaagatggagccattgcactccagcctaggcaacaagagtgagactctgtctcaaaaaaaaaaaaaaaaaaaaaaaaaaggaataaccaggtcagagtcatcattagcattttggaactagtatccgttactcctgtacttaaacttccctgtcatttcccatttgaaaaaaattctgtaagcttcgttctttaatagaaacacaattttataccaaacaatgattcctttcccagcatctgaaatgtgtctgttgaagcatgaaatgatcaccaagtcagccttttatatttagttatattttgttgattgtcagcttacaggtttttagaatttattagcttaaagatcttataatatatccagtgggatgccaggttttgtagtttaccattatctggaaagatttataagagattttatccttgtgtatatacttaagatttataaattatattttaataattcaaaatgtaatacgcatttactttttaggtttaaacaagtctcttaagtggtgtttcctcaccgatggagaattacttccaagcagaagcttacaacctggacaaggtgttagatgaatttgaacaaaacgaaggtgagaatttatattggtgaatctgtttgcctatgtggtatagagaatgtggggatataagaggatgtagtatttaaaaaaataaaatcaggtctgatgacttaatgatagtaatattatttaataatatacaggggaagaaataacattttttagcactaaatgccagatacttaaaatcccacagatcttattgccattttatagatgagaatagaggcacagagaggttaagcacttttctcagagttatcttgtgaacaagtggcaggattagaatccaggcagtgtgacactagagcctgagctttactgaactaccctatacaatgaatgtatggtcaagaaatgtgcttgcatttcctaaactaagaaaaatagctcgttctatattgattgcccaataaagtaaagatacatttaaaactatttacatcacaactgcctaagtggttaattatatattctcaagcatcagtagaaatgtccacttaagattcacttcttttgtttgtttgttggttggttggttttttgagaaagtcttgctctgtctcccaagctggagtgcagtgctcactggaacctctgcctccctggctgaagtgattcccatgcctcagcttccagagtagctgggattccatacacccgccaccatgcctggctaatttttgtatttttagtacagaaggggtttcgccttgttggccaggctggtcttaaactcctggtgtcaagcagtcctccctcctcagccgcccaaagtgctgggattataggcatgagccaccacgcctggccaagattcacttctatttagggaagacttttctctaaatttccatcttggtttaacttgagtgggtaagccataattaaatttcttcctcctcaccgttcttcccctgtgttctctatttctaacaggaaatggcattaacaagtttacaaagtggtatatttccatccaaagtccatgattccagtccaggcaacatgatgaaaccccgtctctacagaaaatacaaaaaaaattagccaggcctggtggcacacctgtggtcccagctatttgggaggcaaaggagggagaatcacttgagccctagagatagaggctgcagtgagctgtgatcatgccactgtattccagcccagatgacagagtgagaccctgtcttaaaaaataataaagcccatgatttccatattggtttacaaacctttgctatattcagtgaatcgggctattctttgatagcagttgggaagacagattagttttgactttgttactttagatatttaatgctctccagccttaaattgaatatggaatcatgacaggaaggaagagagagaggaaggctaccagagtggcctgcttttctcatattttaccattgatgacctaacactaacctatattcctaggctcattcctggttcatgtaaatgtgaaatctaatcattggggttttacatcatccaggtgggctttgtacataccaggctggaaggtatattattttctgagtttcaactgtttgtataagtattttcttaatcttttatttgatttagccctctgtgtatcacagttctttgagtcataaggtacttagacatgtattacacctaatcatgtgaatactatgcttctagaataccactgactctaataaaactcttagttcattacatttgtctctttgtgacttctgtagattctattagggtgctttgtgtatagttgttttcaatacatttttgttgaatcagtaaaaatattttagttaaaaaatagagcaattgcttacagaataataactcctttagaaggagaaggatttctgaaaccagcttcttggttgtaactttgtggttcatttgtttgaactatttttttgaatctcactaccagttgcattaaaaactatcacttcaagcctcgtgttatcttagagaatatacttaaaatgatttctcattttgtgttaatttattttctcatttaaatgaaaaaatataccacagactgtgatgacactgggcaatcaacattatgcccaggtaggaggcagttgaataatgaaaattttaatacccgatcatttctgtttgaacattgctaaatattcttgtaagaagctgtaactatttttttgtttccaggaaccatattggaaatatgacttatttgcttttttttcttttaaggaatcctgtgttactaaatttcaaatctctactggttcaaatttggtaaattcaggatttgacatttcagaggatactaagcccattcttcacacaatctgagttttgtgccctttttaacaacttttcactacttctttacactaattcttttctcaacccaaactgatttacttattgcttccttaaattcttatatttggggatatgcttttctttattcctctatttattaatgctttcttttccaaacttacataaaactgtctttgaagcatagcccagttcttcttgccttcatgaattcaagctcgcttacctcatcctggaaaatatctgtctcctctgaatttatttttctactcctacataatagttttcagacactgagtcctcacttgatgtctttgataagttcttggaaactgtgactttaagcaaattgatacactgtatgccggagaaccttaactgttgtttatatcaattagcttatagtaaaattggcttctttatacagtgagttgttttgcttataattgcagtttccaagaacctatcaacaatgttaagtgaggacttactgtacctatgctactccatactgctaattagatgtttgtacgtgtctcttattctcccaatgagattatatacttcttagaggcaagagctatcatttaatcttcatgttcctcaatcctgctgcttttactatggtagatattcacttatatatttactgtgtatgttctacctatcaggcactatgcaaagtgaggacttatattgatagaaatgatttctgccttcagaaatcattcagtggttgaaagagaagggtagataaactattgcatttcagtgtagtaaatgccttaataaagttttgattaaggtgctgtggacacattgaagattaatgttacagatgaggattgagcttacaaatatatctgcataatttcaggaccatgattatcagagatactggaggaagaaagcaagaaaggcactgagtgcattgttccttatttctctaatttacttagacatatgcagtagccctataacttgagagaataacttagccattgtagttatgatctgttaaaaagtaaacagaaacattatatgaaattatgcttattggtagactataagaatgttgatttaatatgataaatgaacactttttgcccagtgtcctcagataataatataaatatgaacctgattaataatgtattgtgacatggttacaagcagaatttcacgtactgtggcaaactttttttaacatgtgttgggcaaatttaaaatatttttaagtaagaagtataataaaccccagtgtacccatcatccagctttcacagcatttcatatgctgccattttgtttcatttatacctttatcaccttctcactccctgcttcattcttattttttttaacagctttttaaaaggtaaactttatatacattagaatgcatagatcttaactgtccagttttggcaaatgggtatctctctcaaacccacatcctaattatgatacagagtgtagagcattcagtctctacagaaaacttcattttccttcctgcttaattagttatcctagccactgttctaaattttttccatctaatccattagattagcacctgtcctggctttgctcaatccaagggtgctttcccctcttctgggtcccattcacctgtgggtcagtttaattatgttactagattgaggtagaattcttttgttgtttggaatagtctgagatattaccatttggtgacatataattgcagagaattgtctgaaatatattttcttattttttagccccgaattagaaatctaatatccttggaatatttaattttcaaacgatagttagaaatgttattaacttagtcataagcttttccagtgttacaagcaaacttattgtaattacttatttttttccagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggtaagttgcatgtatacactcagaaatcgggcatgcacattttgtaatgctgaattaaatagtaataaaggcaatgtaaggtgaatatatgtctggttgagttgacctaaatagcatttttgaaaacccagttctagtaaatttctatataaaaaatgatgtcactgattcttagatagtatttgtaattttttttgttgccacgatttatgctgaatcagtttttatgaagagatgagaattgaggaagtgtaaactttgtggtttctgtattgatagctacttggttaatgtaatagtttgaaataaggaagttattctttcagtttaggaaatatttgtcattaacttattgcattatttattgaaaaatgcatttaaatacaaaaaataaaaataaaaattacatttaattgttgaaaaatattacacatagaatccatcctacttttttctgtgagatttttgccattatacaaaacattctggaactctttatacacatgcacacatatttttgtcttttctcccatataactttgatacaaagtagagttgaagtctgtagatttttatgacaaggttgtaagaatgatattccttagctctccccaaattttgttagctaaaaacacatcttttttgtttgtttgtttagagttgtaaataaggaaggaaggagattttatatttttgagatatggtgtcaggtctagaataaaatttcagctttgttactattaattatataactttactaagccttagttttataatctgtaaaaacaaaccaaaaaagattaataacttttattgggctgttgtcaagattaaatgagatctcagaagtcatagtgctcaatgattaatctctacctcccttcttgcctgattttttggtccatctgtattaattagggtgctttcaacttcaaggaacagagtgtttgaccccccagtgacttaggtgaaaataacatttatttcatgtaaacagaagctatgagactcagtgatttatgtctgggtgcagagacaggatcgtggaagttctctcggtcttcccctcatgtcagaagatagtatctcagttctaattatcgggtctcaacctgacaacttcctaagcacaaagaaactggctggggggcaaaagagcctactctactcttggcaccctcttatcagggaggaagggacctccagcaacttcctttaatttattggccaattttagaccataaccaattacaggcaaaggggactgggattatctaatcaatcatgatttatctcctggggctgagcacagtgttgcctgaaaaaaagtgggattctgttaacaaaggagaaggggaagtagtgatatgtaggatgagtaagtctagacgtctaatgtactacatgaggactatgcataataaaatcatactatatttgggattcttgcaaaatgagtagattttggttcctcttgccacaaaaatgggtaactgtgtgagacaatagataggttaatttgcttcactatagtaacctttttactgtctggatgtatctcataacatcatgttgtataccttaaatgtatacaataaaatttattttaaaaaaaggagaggaggaaaatggttcctaggtgagcagtcactaaggtttactagaagatcctagcacaaaagaaccaaattacagggagcagaaagaagctaaagctgacactgggcttgttggtctctgattgctaaagtttgaagaaaataatatgtctaattcctaaatattttccagtcttcttcttgttagctgaagtactatttgtagattaggttcatcatttttatgttgttctgtattttgcttactgtaacactttctgaagtgtttgctttcttaagtaaataatgaaaacatttttggtataggccagcacatccagctataatgagtaaataggtaccttagatggattcagaaagaaaatgatgcacaaaatgcatcataaattgcaaaatggttggaatttttgctgagtagaatttgtggaatttatgaattcatggattcatgtggcttatggattcataatttcatctttttccctcgtttaccttagagatgttataagtattaatgagataatatctgtaaaaatccttgagcttctcagaagaaaagggcttataaacatagatactaattggattatgctgagaatgcagctagaaaaataccccaaataatgttatatattgaaaaaaagaaagtttgttccatttcagtagaaattaagcatacgtagtaattacttaatatttatagctatattccctttactgcaacaagcatatattgtgtctaatatataaaaggttctaggctaggtaatggggattcagaggtatataaattggaatttatgatgtcatggcaatctttttttttttttttttttttttgagacagagtctctgttgcccaggctggagtgtatggcgtgatctcagttcactgcaacctctgcctcctgggctcaggcaattctcctgcctcagcctcctgagtagctgggaccacaggcatgcgccaacgggcctggctagtttttgtatttttagtagaggcggggtttcaccatgttggccaggctggcctggaactcctgaccttaagtgatccacttgccttggcctcccaaagtgctgggattacagacatgagccactgcgcctggccaatctactgactttctaattatgatttcatttatgtcttatctaagtttattatttgtttttgtaattcagttccaagcttgatgagggtaaggattttttctgccttgattgctgctgtatcctcagccctagaacatacgggtgctcagtagatatttgttagatgaattaaacaataagtgaatactgtttcttaatgcagcagtactttttttttttttaaatccagtgccttcaatctttagatgatggtatcaaatttagatataacgggtgtaagaactttggaaaatattttaaattagtcatgtgtattgttcctacttaagaacagattcaaaccaaaatgtttctttccctagtttcttatgtactgatgggaatgaatagatatgagagtagtaagtagctgctttagaatattacatggcaattcacagtttccctcatactttgcatgaaaatctgtcttgccttgtaattgatattgtgattttagccatctggcatgaaaaaaacagaaccaacatttagattaatcttggtttctagtgaagctgaacccagggaaatattttccattacacaccctctgaaaggctgtattggttaaaagtggtctcatccatgtcatagcacttatcatgcagtattgtctttgtctttgttccccattaggctgtaaagatcttgagattgcctctgatttgtctttgtatccagcatccagcacaaatacctggcacctatgaagtactcaataaatgtttgttaatgagtgagtaaatgagtctcagatcattgattaattcaacaaacactgagtgcctgttatttgtctgtcactgtgctgggtgccgagcttacaccaatgatgttgtgctccccaccctcatggtatgtaaagattaggccagtgacaaaaacaaaacaaaacaaaaaaacatgatttgtggcaagggcgatgaaggagataaggagggataatataaaaaatgggggtgggagaagaaggtatgagaagacatctgagaagtgacatagttcaaggttgacacatcaaggttgacacataaaggtggaggagtcagttcttcaaagaacagagaaaaatgctgcaggaagtagaacagcatggacaaagtcattgaggttaagaaggcacctattcaacaaactgaaggaactcctgcaggaagtagaacagcatggacaaagtcattgaggttaagaaggcacctattcaacaaactgaaggaactccagtatagtgaacgagggaagagtcacataaaaagagatgggaaagcaggtggggtggcacaggcctgttgtcccagctactccataggctgagcatgttatgatcatgtctatgaatagccactgtactccagccagagtgacagagctgagaccccatctccactaaaaaaaaaaaaatgctgatgaggaagttaaggaatagatgatgcagagctttgcaggtcatgtaaggagcacagtgggaagccatgggagtggatgagattaccaagggaagagaatagactcagggctgagcccatgtggtcaagcagaggaggacccagtaccagttgccaaggagtgagcggagaggtaaatagaaaaccaggaaaatatggtctcttggaagtcaaaagaggaatgtagtttgtgaaagggtttatcacctatataaaatactgtcagtaagatatggacaggaaagggaccattggacttggctataacagggtcattgaaaaaagctgattgagtggagcaatgtttacagaagccagatgggaatgggttgaaagtggaatatgaagggaggaagtggtgatggctttttcaagaacttttgccatgaaaacagaaaaaaattgtagcaattattagatggagatggtggttatggatgcctttttggaggatgggaaatactgttgtatttttatagtggtatgggtgattctctagaaaagaagttttaggagaaagggaggattaaacaaaggaagagaaaaatccttgagaaggccaaagggatgggatctacaacatgttgaggatttgctcttcagtgggtggggctagacagaggttggtttatgaagttagtggtgagagcatgaagaaatttacacctgattggcttatacttcatatagaaaatataaacattgtgaagggtgaaatagggatagatgatgaaggtttgaggagagtgagatagttacattggagaggaaaagtaaagcctaatagtgaattgaaatttcaagagccctttgtgcttggcatcaaactttcagtcagttagatgaattaaaaaataatctagtccagtcctgacttaatgggttagaatcagtatttatccttggagatatgatgaaattgttatattatctttgcgatacaagcattttagtttggagaagcaagaagagttctgtaggacccgtctgtgctactacctgtctacctatttccatgtatttgttcttttttaaaacaatttaaaaaaacttttagctggatgcagtggctcatgcctgtaatctcagcactttgggaggctgaggcaagtggatagcttgagatcatgagttcgagaccagcctggccaatatggtgaaacctcatctctgctaaaaatacaaaaattagctgggcgtggtggcaggggcctgtaatgccagctactcaggaggctgaggcacgagaattatttgaacccaggaggcagaggttgcagtgagccgagatcgagatcacgccactgcactccagcctgggtgacagagagagactctgtctcaaaaaaaaaaaaaattatgacatattatttgttctttcattcagtgagcatttacttattgcttggtattctgttttttactaaagagaagcaaaaagaaaaaaaaaaaggaaaagaatgggcctcctggtaaaacataccactcatgttactgtagatgacttaaagatataaaatgagaaatgaacagttacaaagctgcagatgctctgcagtgggaagcagatagattgtggtggtggtggtggttgtgaggagaatgagatactaatatttattgagtgtttaccatgtgccaggcgcttttctaaatccagacttacagactttatttaatacacataacaaccctatgaagtagctagctactgttaaaatccacatttacaagtgacaaaataggcctagaaagattaagtaacttgttcaaaatcacacagccagtaagtgaagttacgattcaaactcagggactttgacttctagaaccaaaagggagctagcatttgtttagtgcctattctgtgctttatttattatctaacttaatcttcctggtaaacctgtgtgatagttgatggtatccctaattaacattgaagaaactgatacggtaggaccctgacacagtcttgctagctgtataactcatgctctttcccataaataaagttgagagaataaaacaaataggtttctttatggtgatctttatgttattttctttgcatttctgagagaaatgtctgcatttatgccataatttttatttttaatttttggagacagggtctcactctgtcgcccaggctggagtgcagtgatgcaatctcaactgactgcagcctctacttcctgggcccaggcaattatcccacctcagcctcctgagcagctgggactacaggcacacaccaccacacccagctaatttttgtattttttggtagagacaggatttcaccgtgttgcctgggctagtctcaaaactcctgggctctactgatacatcagccttggcctcccaaagtgctgggattacaggtgtgagccaccatgcctggcctttatgccgtaatttttaaaacaaatgccttaaatactatttcaaaaagaaagatgaaaaatatctaacattttattagatataaatttttattttgaatagttatgtgttaaattagttgcagtttatttttgggtaacttgagttgaagtcatttttgtttaacatttgagaatttagatgtgaatagagaataaccttcataaaatctgaattagtaacacattaagacaaataatgttttggcttataccttcagagatcagttttcttaaggattttttttatcctgttttttttcctgggttttttttttttttgagacaaactcttggtctgttgcccaggctggagtgcagtggcatgatggtggctcactgcaaccttgaccttccaaggtcaagcgatcctcccacctcagcctcctgggtagctggggctacgagcatgtgccaccacgtgtaactaattttttttttttttttttttttgagatggagtttcactcttgttgcttgcccaggctggagtgcagtagcaagatcttggctcactgcaacctctacctcctgggttcaagcgattctcctgcctcagcctcctaagtagcagggattacaggcacctgccaccacacccgactaatttttttatttttagtagagacggggtttcatcatgttggccaggctggtctcgagctcctgacctcaggtgatccacccacctttgccttccaaagtgttgggattacaggcgtgagccgctgtgcccggccactaattttttaaaaaatttaatgttgcccaggctggtctcgaaatcctgggctcaagggatcctcttcacctcggcctccccaagtgttgggattatatgtgtgagccactgctcctggctgcctttgattttaaaacatggccactggttgggctccttgggaagcagaaaggtagtagtaggccctcactcagtaccaaatgttattaacagataacttaggtgcaaagtgggataaaacacatgtagctagaaaatgtttgcactaagttcatgctattttttgtttttttgcatctcttctcctgaaagccatctccctttcaatatctagtctgctgatacattctaaatactagtcacaattttttattgtaaaatatgcataacataaaatttaccagtgtatatgggtttgagggtatatggttcagtggcgttacatgcattcacattgttgttgtacaaccataacaactatctccagagctttttgtttttttttgagacggagtctcgcttcgttgcccaggctggagtgcagtggcgcaatctcggctcactgcaacctctgcctcctgggttcaagtgattctcctgcctcagcctcccgagtagttgggattacaagcacccaccaccatgcctggctaatttttgtatttttagtagagacggggtttcgccatgttagtcaggctggtctcaaactcctgacctcaggtgatctgcccgtcttggcctcctaaagtgctgggattacaggtgtgagccactgtgcctggccatttttatcatctcaaacttaataacttcccatctttccttgcccctaatgcctggtgactgctattctaccatctgtttgtatgaatttcactattctaggtacctcatataagagtggttacacaatgtttgtacctttgtgtctacacatttcatccatgtcgtagcatgtattagtcagaaggacagaaccaataggatgtggagatatatagatatatatatatgactttaataggtaggatatatgtatatatacgagagtttattagggagaatcaactcacatggttagaaggtgaattcccacaataatctattggcaacctcgggaaagagaagctagtggtagggctcagcccaagtttgaaagcctcaaaagcaggaaaaccaacagtgcagccctcaatctgaggcctaaggcctgagagacccccagaaggctgctagtgcaagtcttagaatccagagcccaaagaacctggagtctgatgtacatgggcaggaggagaggatataagcatctggcaaggaaaaagagaaagcaagcaggaagactcagcaagcaggcttatctttgcttcttctgcctgctttgttttagtgcactggcagctgattgtatggtgcccacccccattgagagtgggtcttcttctcccagtccactgactcaaatgtcagtctcctctggcagtaccctcacagagacacccagaaacaataccagccatctaggcattcctcaatccagtcaagttaacacttaatactaatcatcacatagtgtgtatcagagtttcattcctttttaagtctgaatatttcattgtatgtatgtaccacattttgttaattcatttatccatcaatggacacttcagttgtttccacctcttgggtattaccaataatgctactatgaacatgggtgtacaagcatctgtttgagtccctgctttcagttctttgtgtatatacccagaagtagaattgctggattatatggtagtcctgtgtttgattttttgattaagcaccatattctttttccactgcagttgcacaattttccattcccgtcaacaattcacaagagctccagtttctccacatcttctttggctctgtgtccccacccaaatctcatctcgaattgtaatccccatgtgttgggggaggggcctggtaggaggtgattgaatagtgggggcagatttcccccttgctgttctcataatagtgagttctcatgagatctggttgtttgaaagtatgtggcactttcccctttgcatgctctgtctctcctgttccaccacggtaagatgtgcttgcttccccctttgccttttgtcatgattgtaagtttcctggggccttccagtcatgttccctgttaagtctgtggaactgtgagtcagtgaaatcccttttcttcataaattatccagtctccagtagttcttcataacaatgtgaaaacagactaatacacttgtcaacacttgttttctattgttttgatatagccatattaataggtgtgaagtggtatctcattgtggttttggtttgtatttctctgatggttagtgatgttgagcctcttttcatgtacttactggtctctatattaaaaatctttggagaaatgtctattcaggtcttttgcccatttttaaattgggttgtgttttctgttgttgagttttagagctctttatatataattcagtctcctatcacataaatgatttgcagatattttctcttattcttgggtttttcattctgttgtcctttgatgcaccaaagtttttaattttgatgaactccaacttacattttcttttgttgcctgtgcttttggtgtcatatcaaagaaatcatctccaaatttgatgtcatgaagtctttcccttatgttgtcttctaagtgttttgcagttttagtgcttgcgtttaggtcttttatccattttgagttaattttttgtgtatagtattagcttagttttattcttttgaatgtggatatctggttttctcagtatcatttgttggaaagactgttctgttcctatggaatggttttggcactcttgtcaaaactaactggaccatataagtgagagtttatttctgggcttttttctattccattggtctttatgtctgtctttaatgtcagtaccacatggttttgattaccatagcttcatagtaagttttgaaaacatggaatgtgagtcctctggggttgtagtttgtcaggattattttggctattctggatcccttgagattcaatttgaatttgagaatggatttttctgtttctgcagaaaacatggttagggttttgatagagattgcgttgaatctgtagatcactatgggcattgttgacatcttaataataagccttctagtccatgaacatggaatgtttttccatttatttgtatgttctttaatttcttttagcaatcttttgtcttttgtagttttcactgtacagtattttacctccttggttaagttaatttctaggtattttattctttttgatgctattgtaaatggaattgtttccttgatttcatttttggataattcattattagtatgtagaaatgcaatggacttttttgttgatttttgtatcctgaaactttgccgcatttattagctctaacagtttttgtgtgtttgcggggaatctttaaggttttctaaatgtagcatatgttgtcagtatacagagataattttaccttttcctttccaacttgggtgccttttatttatttttaattgctctggctaaatttccaatactatgttaaatagatatggcaaaagtatgtatccttgtcttgtttctatcttaaagcaaaagttctttcagtctttttttttttttgagacagggtgtcattctgtcacccaggcttgagtgcactgccatgatctcagctcaccgcatcctcaacctcctgggctcaaggtatcctcccacctcagcctcccaagtagctgggactaacaggcgtgcactaccacacctggctaatttttttttatttttagtagacatgaggtctactgtgttgcccaggctggttctgaatgtctaggcacaagcgatctgcctgtcttggcctcccaaagtgctaggattacaagtgtgagtcaccatgcttggccagttttcagtcgtttttgttgttgttgttgttgttgttgttgtttgtttgtttgttttttgtttttcttttttgagatggagtctcgctctgtcacccaggctggagtgcagtggcgcgatcttggctcactgcaacctctgcctctcgggttcaagcaattcttcttcttcagcctcctgagtagttgggattacaggcacatgccaccatgcctggctaatttttgtatttttagtagagacagggtttcaccatgttggccaggctagctttcggtcttttaccagtgcatatgatgttggctctgggtttttaatatatggcctttattatgctgagataatttacttctgttactagggttttttaaagttttttttaaatcatgaaagagtgttgaattttgttaaatgctttttctgtatgaattgagatgatcatttggggttttttgtttcattttgttcaggtaatgtgattacattaattgattttcataagttgaattatccttgcattccagtaataaatatcacttggtcatggtgtataattctatcaatatgttcaattcaatttgctattattttcttgagttttgtatcagtatacattcatacagaatattggtctatagttttcttataatatgtttgccttgttttggtatcaagatagtgctggcttcacagaaggagttaggaagtatttcctcctcttcaattttttggaagagtttgagaaggattggtgttctttaaatgtttggtagaatttgccaccaaaatcatctgatctagggctttactttgttgggaagtttttgattactgattcagtctccccactagttataggtttattcagattttctgtttattactgattcagtcttggtaggttttgtgtttttagaagtttatccatttaatctaggtaagtcacatttttgttgtagcgttgaggcattttttttttttttacaaaaaattggtactcatatacataaagtaatatgaacttaaaattcatacatttacttcattttttagcttgacattctagtaaatcttttgctccatttatttttggttatgatagcagaagatctacctggatgatttaagagcatcatttgtcaatgagcacctcttattttctctttattggcagtagtgcttacagctactattaatgctgctttccattttgtcgtttcgggttcaaacatacctctgtaatagccaccactgaaggcagattttggtagactttgaaaaatttgttttgttgttgttgttgttgttgttgtttgttttggggtttttttgttttgttttgttttgttttgttttgttagagacggagtcttgctctgttgcccaggctggagtgcgatagcgcaatctcggctcaccgcaacctctgcctcctgggttcaagtgtttctcctgcctcagactcccaagtagctgggactacaggcgtatgccaccacacccagctaattttttgtatttttagtacagacgagttttactgtgttagccagggtggtctcgatctcctgacctcatgatacgcccaccttggcctcccaaagtgctggaattacaggcatgagccaccacgcctggccgaaaaatttgttttacttgaggttccacatgccttatataagggttgcaaaacataacagcctgcaaatcctgcagcagcaatggtcagtccgactgctaccactgtactggccatggctgggctcccctactgcaccaggagcatggctcatcccagcccagaggttgcggccaacaatgacacacctttaccagagagtgacacaggcaccgatggcaagcacaatacactggattataatttttttaaacaagaggattatttgaaaaacagtctaggtgcggtggctcacgcctgtaatcccagcactttgggaggccaaggcaggcagatcacttgagcccaggaattctagaccagcctgggcatggtggcatgtgcctgtagtcccagctactcaagaggatcacctgagcccagggtaatcgaggctgcagtgagctgtgctcacaccactgcactccagcctgggtgacagagtgagaccctgtctcaaaaaagaaagaaaaacacagtttatgttgttgttgtatatcgagtcttaaatcaatgcttcctctggcagaacaaatcagaagttggttatacagtatcaactggccaagtgtctttattatttacagcatctacattagtttttaaaaccatcacattttcaatatataaatgggcaaaaagatgtttagatgggttagtaaacaatggagaaatattttaatttactagatactaagaggtagaaattaaaatttttaaaattttatgcctatataacaaaaaatagaaaatgttgatagtatgatagatagtgaaattgacactggcatatttacacatttaaaaagccacacgtgggtcgctggggaacccaggctgtcctaggaagccgagtgggagtggcacagagctgctggagatcctgagaacctgagttttggcaagcagccagaatacttaaaaaatgaccacaccaaacaaggcacctcctggtactgaccctgagcagttggaaaagactggaacagtacgggaaattgggtcacaagctgtttggtcactctcatcttgcaaaccaggatttggagtggatcagttacgagatgacaatctagaaacttattggcaatcagatggctcccagcctcatttagtgaacatccaattcagaagaaaaacaacagttaagacattatatatttatgcagactacaaatctgatgaaagctatactccaagcaagatttcagccaaagtaggaaataattttcacaaccttcaagaaattcggcaacttgaattggtggaaccaagtggctggattcatattcccttaactgataatcataggaagccaacttggacgttaatgatacagattgctgttctagccagtcatcaaaatggaaaagacacccacccatatgagacaaattaaaatatacacactggtagaagagagcgccattggtaaatttcctagatgtacaactatagatttcatgatgtattgttcaataaggtgactttaaaatgatatggaagtcattaaacgtatctttgttttatcctgtctttaaatagtatatcagttacctttattgaaaaaaacatcagttatttgcaactttatatatatttaaaaatattttattgtaattttgataaatttgggtcatattatctttaacatgtaataaagctcacatattttacattactaaaaaaaaaaaaaaaaagccatatgtgtggctgggcgtggtggctcacacctgtaaatcctagcactctgggaggccgaggcaggcagatcgcttgagcccaggagttcaagagcagtgtgggcaacatggcaagacctcatctctgccaaacaaaaggggacgtatgttccaattttttgagctaatgattccttttttgagtaaataattcttaaaacaagtgcagtaaacaaaaagatgtgtattttagtgttactaaatagcaaatacatttaaagtaatttgtgtccaaaattggataatgggccaggtgtggtggctcattcctgtaatcccagccctttgggaggccaaggtgagaggatcacttgagctcaggagttcgagaccagcccaggtaacgcagtgagacctcatctctactaaaaattaaaaaatggcgggatgtggtggtacatgcctgtagtcctagctacttgggaggctgaggtggaaggattccttgagcttaggagttcgagaccagcctgggcaacataatatctctgctaaaaattaaaaaatagctggatatggtagggcatgtctgtagtcccagctacttgggaggctgagttgggaggatcacttgaacccaggaggtcgaggctgcagtgagccatgattgtgccagtacacttcagcctgggtgataaacgagaccatgtctcaaaaaaaaaaaaaaaaggttaatggtaagttaagtacaatacatatatttgcttcagccattaaaaattattacaaggcagtgtagaaaatgcttatgatgacatatgaatagaacagaatgcaagcttatgctttgtttacaattaaattattcttgggcataaaaacagatatgtctgaaggaaacatatttttaaaaagtaattttagagccaggcacggtgggtcatgcctgtaatcccagcactatgggaggctgaggcgggcggatcaccagaggtcgggagttcaagaccagcctgaccgacctatggagaaaccctgactctactaaaaatacaaaattagccgggcatggtggcacatgcctgtagtcccggctactcagggggctgaggcaggagaatcgcttgaacctgggaggcggcggttgcggtgagccgagatcgcaccattgcactccagcctgggcaacaagagcaaaaccatctcaaaaaaaaaaaaaaaaaagtaattttaggctggatgcagtggctcatgcctgtaatcccagcactttgggaggccgaggcaggtgaatcacctgaggtcaggagttcaagactagcttgggcaacgtggcaaaactccatctttattaaaaatactaaaattagctgggtattgcggcgcgtacctgtagtctcagttacttgggaggtcgcagtgagccgagattgcatcactgcactctagtctgggtaacagagagagactctgactcaaaaaaaattttttttaattcattgagtctgagctattatgcttatttcttttcttttcttttatttgctgtactttacttttcttttcttttcttttcttttcttttcttttctctctttctttctttccttccttccttccttcctggcttccttctttcctttctttctttctgtctttctttctttctctctctctctctctctctttctttcttttctttctttcagatggagtctcgctctgtcttccaggctggagtgcaacggcgcgatctcagctcactgcagtctccacctcctgggttcaagtgattctcctgcctcagcctcccaagtagctgagataacaggcgtgtgccaccaccacgcctagctaatttttgtatttttagtagagacggggtttcaccatgttggtcaggctggtcttgaactcctgaccttgtgatctgtccacatcagcctcccaaagcgctgggattacaggcatgagccaccatgcccggctcttttttttttctttttcttttttgagacagttttgctcttgtcgctcaggctggagtgcagtggcacaacctcagctcactgcaacctctgcttcccttcccaggtttaagcaattttccttgcctcagcctctcaagtagctgggattacaggcatgtgccaccacgctcagcagatttgtatatttttagtagagatggggtttcaccatgttggctgggctggtacagcctcagttggatataatattgaaagtctgaattagagatctcttttaaccctttctgtaatggacacttaaaatgactctgataattattattgttttctattaataacagtgaagtttaaacaggtgtttagacagaggcaagggtctggatttgtttgaactgctttagatcttatgatactgatttttgctatgtgctaataagtggagggataaagtactcctgcatttgacaatttttataagttgttactttcactggtctttgtgaacagctggacactggtcagttctatgcactctcctctcctgtttttattattctcacatcacagttatttttgtcataattatagggctttttgaagacctgggacatcattttttgcattttctaatttggaaagaaataagtgagcatttgatgatttgaattttcaagaattgcaaaggaataagtgttattcacactgtaagagggtataaataggcacaaagtggtactttgaatataaagcatgttcacagatttagcaataggatttgttatgtggaaagcctgtagtgggaaattttaaaaggaaaggaaagggaaataagaaaggtaccaacatacatttagaacctattatatgctacattttatacatataatttcatttaatcttcataaaagccatatgaaggaaatactgtattagcatttctattttacatgtgagaaaaactaagacctagagagtttaaattattcccataaggtcatctgactagagaataatcaagttgaaataggaacacagaagtgccacatttaaaaaaattacatataaacacacaaatggaaccttttaaccagtacttagctggaacatcgtatagaatatatattataaattaccttactttgtctctttatgcttaggcaggtcatacggatcctgccatatgatgtcagctgtaaccattaggcataaaaatcttgaggtcattcttataaacagattaaaatgtgttgttgcaaaagttgaatggctctagattattttctgaatttggatatgaatcatatagtccttccccaaaaagtttacattaatgtttgtttctccattcatacatttatgtatttatgtatttatttattttttgagacggggtttcgctcttgtctcccaggctggaatgcggtggcgcgatctctgctcactgcaacctccacctcttgggttctcctgcctcagcctcctgagtagctgggattataggcgcctgccaccactcctggctaatttttgtatttttagtagagatagggtttcaccatatttcaccaggctggtctcaaactcctgacctcaggtgatccacctgccttggcctcccaaagtgctgggattacacacatgagccactgcacctagtcccagtcatacatttatttatgcaataactttacttttcaaggaagcaataagcaaatatttactgagtactatgtttcagacacaatattgaagataccagtattaaaaataatttagctcattattccatggagtttacattctagtgtggggaaatggagaataagttcaatcagtgcagtagattgtgttgtgataaagatatatggcatatggtaagatatttcagcagtataatttaagttcaggtgtgcaaatatgtaattttcttaatttttagaactgactttacttttttactctaagcctgtagcttagagaactggggaaggtacttagatggtatatggaatatagtggggtatttttagttgtcagaatgactgaggttgctactggcatttagcaacctgtgcataccaagactgctaaacatcttgctatgcccaggacagtactgtcctatgaagaactggcccacctaaaatgccaagagtgcccctgttgagaagcactgactaacctggctcatggtagacaatttcatcttgatctttttaggcaaaattgactattatccagtaatttcaaattcaggattatttaaactatcccaaacctggctcaaatctcttagattctgcccatctcctctgtgatactaattcttatgacctatgaatctcactacgtcatagtctggcgttgaagagtcatctacttttctagctaactcctgtgctttcctctaatctcattggaaacgtaaaggatctctctatactgttcttcggcctgtgggatattgagaaagatgggtattcttgggttcttctgtgtttactccatttgctgctcccttgcttgcttttttttttttaagatactttgttttttattcaaaaatcattatttgagattattgtcccaaagcctaactcactacttctgaatgttcccaactatattagtttgctacagttagcaaaataccacaaattgggcagcttaagcagaaatttattatctcacagttattagaagtctgaaattaaggtgatagcagggttggttcctcctgggggctgtacggaaaagatctcttccatgtctctctccttggtttgtagatcgacatcttcatgttcatatggtggtgttcttgtatgtatacctgtgtccatatttgcctcttttataagggtatcagtcatgttggattaggagactaccctaatcacttcattttgattacctctgtagagaccctatcttcaaataaggtcacattctaaggtgttaggagttaagacttcagcttaagtatttgtgggggatacagttcaacccataaaagcaactaatttttttaaatttttttctaatttaaaaagtacagaaaaaactaatcaaaataaaataaaaatatcccaatacaacatttaaaaaattatataaagtaaaaggagagaaaagatagccagctgtggtggctcatgcctgtaatcccagcactttgggaggcccaggcgggcagatcacttgaggtcagaagttcgagaccagcctggccaacatggcgaaaccctgtctctactaaaaaaaaaaaaaaaaaaaaaaatcgctgggcatggtggtgcacacctgtaatcccagctgttcaggaggctgaagcaccagaatcgcttgaacctgggaggaagaggttgcagtgagctgaaatggtgccactgcactccagcctgggcgacacagcaagactgtgtctaaaaataaaaaagaaaaaggccctacttccattccaatctcatcctccaacttgactatatttttcttttccatgtcaatcggtacatacagaactatttcattctttttatgggaacgggattccattttatgggtatactgcagtttaattagctgttacactactgatgaacacttgggttgtttacaacttttattataaacaatatggagataattcttgtgtagatctctttgcacatgtggatgttttcagtagtgtaaaattttaaaactgtgtgctgagtcatactgaataaacacttccaattttaaaagatattgtcaaattaacctaccagcgtatattactaccagcagaatctaagagctataccctcaccaccgttagatattatcagtgtttaaaaaaaaaatctttgctagtctcatagtaaaaacatactataaaactcattgttttattttgtcatgtgtggtatttactatatctgttggccattttatttattttttctgtgtatttaccaatgtgagttctttgccttatttccttggaggtatttgttggttattgaagctcatgtttttatcataaattaatttttttgtaataattgtagtagctcattaaggtttcccaaatccattcttattctcttccttttttttctccctacactgtgcccatacagatctgatcatgtctttctctttgattaaaatgcttaagtgggggctgggcacggtagttcacatctgtaatcccagcactttgggaggctgagccgggcagatcacctgaggtcaggagttcaagaccagcctgaccaacctggtgaaaccccatctctactaaaaatacaaaaattagctgggcatggtggcacacacctgtaatcccagctacttgggaggctgaggcaggagaatggcttgaaccctagaggcggaggttgcaatgagctgagatcacaccattgcactccagcctgggcgacagagcaagactctagctcaaagaaaaaaaaatgcttaagggctttcccattgctctattaaaaaggtcaaaacagatcctacagagcctttgcttggtctggcctcagcatattccatgcatcccttaactcttggggcctcaagccatattaactttttttagttatttggtgggtccatgcttcttcccctaataggaactgtgtacatactatttcctctactattactgtctcttcttggcacctctttgttcacagaaaactcttacccatccttcagatttgatgtcttgtcatttcctaaatcttccctgaccttgccaatctaggctagagcctagattacatgatcttatttcaccatttaccacttttgaaacacgtgatttatattcacttgtatggtttttctttttctttctttcttttttttttttttttttgagacagggttttgctgtgttacccagacaggagtgcagtggccattcacaggtgcagtcatagtgtagtgtgtcttcaaactcctggcttcaagccatcttcctgcctcagcctcccatgtagctgggacaataggtgtactcctctatgcccagccttgtgttattatttgattttaggttataacctgaaacccttgcactaaattgcattgcatgaaggcaaggaccatgtccgttttgttttctgccacatccccattgggtagcttggtgcccagtacatagtaagagttcatatatttgtggaataaatgagtgaatgatggattcttggttttgtctctttattagaaaggttattgaaggattttaagaaatttaacattattagatttattttttagaaagttcagtctttgtttggaagattaattggaaaggcagatgtgaagattaggagaacagttaggttatcatcatgatcgtttagtcctcagataataacagcctgaacagaggcagcaatgttagagataggagaagatgtgattttggaagaacaatttcagaggaaaactaacaggacttaatgactgactggatgtggtcatggcgagggagaaggaaaagtcaagactcaaaatttaaatgaaatatgtaatttagtatgaagtagtattacagagtagttaactatagagccattgcagtcatacagattaatcatgtaatttactagctgtatgaccctggtaattttacttaatgtcttagtccattcgggctgctataacaaaataccatagactagatggcttataaataacagagatttgttacagtctggagcctggtaagtccaagatcaaggcaacggtagatttggtatctggcgagggcctgcttacttatagacagctgtgttctcactctaacttcacagggcagaagggtgaggagtctccctcaggcttcttttatagggcactaatcccatatgccccactacctaataccatctcttttggggttaagatttcaacataggagttttggaacattcatctgtttacctaactgctaattgtaaatgagtgtcttcatggaatttttgaggttaaatgtaacacatgtaaagtgcctagtagtcatatagtttgctgtgaacttgaggaagtcatttaaccatctaaactcagtttcttctgatagaaaataaggataatatgtataccctttgttctccctgtatcacagggatatctccctatatcacatttaagaatgtcaagccctataaaaattgtaaactgataacagtcatagtaactagatattaattatacatagaaggatgggagatatcgagcttaacttagactttaatatgacccctcatctcttggttcaactttgtaaagtataggatgcttcttggctgtaaaaactgaagaagtagaatttatcctactgggaacaggcttttgccactgtaaggctctatgtggtaaatgactgatgagttctcaagaaaataaatctggccgggtgtggtggctcacgcctgtaatcccagcactttgggaggccgaggtgggtggatcacttgagttcaggagtttgagactagcctggccaacatggtgaaaccccgtctcttctaataatacaaaaaaaaattagccaggcgtggtggcttacacctgaagtcccagctactcaggaggctcaggcagaagaatcacttgaacccaggaggtggaggttgcagcagtgaaccaagatcgcaccactgcactccagcctgggccacagagtcaaattgtgtctcaaaaaaaaaaaaaaaaaaagaaaagaaatcttaacaggaacaaaggagattgttgttgcctggtgtagaggggagaaggaagtgagattaccaggaaccaagcccagaaggtggaaattggcatggcagattttgattgcctgctgtgatttcctgtagctaaagcagtgcgtttgtttatgattgagttgtatatattgacccttggccttcatagcaaaaacagtgaaaacagctggtatagttattattccacatataaggatagtaacaaacagaagttaaaacacagaaattccaatctttgtttatttcatcctgctataattcctttccaaacggaaatagcacatgtaactatctttcaacacccatgttaggtgattgtgtgcatagaaatcttgcctaggggtaattcaggtggttttttccccactgctgtatatttgccacgtgatcttagttaagatttttattttcagccaatgtttcccatttctttattgttgacagacttgtaatctcactcttgcttttgaattacccaacttcctgaactacattttctttgaaactttagtattgtagtttaataaggttcactgacaatcagtgtttgtcaatattggttcactctctttgcatggcaatcccaagtaaattttgtgtgttcttccccccccccccccacaggttttctgtgcttcctgctgtagcctgaaatgtaaactgttatacatggacagaaaggaagctagagtgtgtgtaatctgccattcagtgctaatgaatggtaagtattaaaacaggttgatttcatagttattgagacaaaacaagggaattacgatgagaagacttttttccccctgcctttctttacaagttgctcaccttctcaaatgtcataactttaactgaaaatatttagctaaatttccatgttttgaaagtatcttagcatttcagaattcctgtgcctaatttaatgaataaatgctaaagccaggtaagttttgcaggaataatggaagttctttggaaatctggtgcgaggtagttatttgtgttcctataaaataaccagagtgaggtgggaatggggagcttttgatcaccagatgataagatgttaaaactgggctgagattttccttttaagagaagccatctctttctaaggaacaacttaataacttagcatgtgttcttatcaacaccttgtttcattcatcttgttgaagataactattttagcatctaggaccaagtagaaaattgcatttttaaagcccatttatctctttaatgctacttagatttgctatgagaataatggtttagaatctagttgttacgtggtaaaaagaatatggccggggaaagtaaataaaacttacccagtgttcatcttttgctggactggaaatgattttaagggcatattagttaaaaaccctgagtattcttgtaaaaagatacactaaaattgttcaggttatagtattttctctttgaatgcatctttgtacagttactggaacaattactaatagacataaaatgttgaacttgaacaccagtgctacctgtgccaggatagtgtgcctcctggaggctggaacttatctgctctgagacccctcctgctctgtccgtctgcattgctgatagtgatgttttcttgttgctggcttattaacctgttgcatgacagttaatctgatctgttctaatttcctatgatccacccagtttcctcccatttctgaattcttacaattttgaccaaatatgaatcattctctccactcttaagggttactttttaaatagtggttatttcacttggttgctcaattgatgatttttattctgctgctttcattttcgggcacatattcacagataagagcatgctgcttaattatagtacctaatacctcttttatttgatgagatcttccaacttgatagctaatttttttaacttggcatagctaaagatgaaggaaatggcagaggattcacatggaatacttactttttattaagccaaggaggcccttaacaggggatcctaaggtaatccacttttcctggtttttccagtgtctttcctctcgcatggcttagcccggtctttttcttaatatttaatttgatgcttttcggtgttccctatccctttttccctttctccttttctcttcctcccctctttctgccagtgctttcaaaggaacatagcttttgttactagccttgtcttgcagtttggaggcaataaatattcaaaatcctatggatcattctttgatgttgaaagagatttttgaaaggatgcttaaaaagagggtggcttctatttctgggcatgtggtattacctgaacctagaagataaaatttggtatctttcatttctgtagcacctttcatcctatttgctttaaaggcgataggtgatgtgtcagtatttagtgaaattatagggtacacagaatcttaatgtatttgtgatcatttatattggttgatcacacttacatgatattggcacattttcatgttcaaataggtcctgtgcttttgagacacaccaaagatgtgaaatggttgttactgatggatagttttatacagggtgatgattacataaaagcagaattcagaaaaagattgagatgtgtcctcctgagctttaggctttagaaatttttaatgagattttattttaactaacaagagccttaaaagtttagaaatgaaacttaaaattttacagtagagttattctattttagcccctgattttgctttttgatagaactttataaaatgcattaaatattaaatgaaaaaatgtctaaatgctatccaagtttcaaattcttaaagtttgatgttgtttgactccctcttaaggaaatgtttggtctcctataaagaaaccaggctccaacctt

SEQ ID NO: 12672 - DNA, 134140 bp, Human
  misc_feature (1)...(134140): n = A,T,C or G
gttgcagtgagccaagattgcaccattacattccagcctgggtgattgagtgagactccatctcaaaaataatgaaataaaataaaataaaatagtaaagttgagactagccactagtggtcttgtgtgattttccaccagccagatttcagctacttaggggaatgtatgtagtaggtggatggttggatttagctagagttgaggctttgccagctgagactggaatataattccaatagaaaaacctgtaatattatttgtattagggttctgtaaagaaacagaaccaatagtatatggaggggtgtgtgtgtgtgtgtttaaatttattataaggaattggctcacacatttatagaggctgagaagtttcccaatctgctgtctgcaagctggagacccaggaaagctggtggtgtcattctgagactagagggccaatgatgtaagtcccattctgagggcagaggattgatgtcccagctcaaccaatcagagagaattccctcttcctcaagccttattttattcacgtcctcaatggattggatcatgtctggtcacactggggagggcaatctgttttattcagtacactgattcaaatgagattagctcatccagaaacaccctcacagacatacccagaaatagtatttaatttgagtaccccatgtctcagtcaagttgatatataaaattatctattattggacttgcctcacatattgaaaaactatatatatgatttgaccttgaatctatagagttaattttgtttaagaaaatctttaatcagctaggtattagaggagtggttactttactttcattctcattttgaccttggtttgtatttttattctttcatacttctgatatgacttagtcctttatttaatagatataaatctgtttcttagtgtcagtagctcttctcatttagagtatatcatagcatgtgcatatttttctagttctcaagacagggaaatcttttaccagtgattttcattctttattcttcattgggtcttggaaacttgaattttaggccttttacttattctcttattttttattaagcatatcattttcacatctgataatagaatatttgtaatgtcaggaaatttttcttgctgcctcagtttatctttaaaattaagtagtgttcattaaattatctccaagatacttacgtgttctgaaaatactatgattatgtgttagatattttatactgataatataatattcatagtcttagttttattctgattagcttcaactactaatcttgttcaaggctaaattaggcccttaaagaattttacattgtctctaagcagttatagttgggctaccataacttaatggatattgtcgtattttcacaagaaggaagcaatatttgaagagcctttgtcttttgcatgcatgcctgatagtgaaggttaatactgggttaatagatccattgcttctaagcagttggaggaggactggaatcaagagactccatttggagaaaaaaaacagtttggcaataaaaatcacaactggaaacttgtgaaactcaagaattctacatgtatagaaaaaaaatcacactagaaggacattcttgtgaagcagcagttttcttagctttggattcttggagggcctattataaggcaaattatatacttatgaattaacacaattaaagtcattgggtagaaagtgcctgctgttgatgtttctcactttgcattatccattgaaaataaacgtgcaaaaactcttcttcattgaaacatttaacttttggcctttcagacaataaaatgtctctgttgctaccttgtatgcaagccaggtctttgaatccaaaggtataattttatctactgtttcagccctattgctttcatttgtctggctatggtagatttatatgaagaaaatgagggcttattgtttcagcaagtgtaatgagcaatgtgtttttcctttaggatcaaacagagcatactgaatcagcaggactggctggtggtgcagcagacatcatgagtaagcaccgagaagtctgttccttatcacgtgtgtaaggggaaaaaggtaagaaaatgtttttatttctcttagagattgaacttgagaaaccaatgagatctatagaagataatgctgatgcatatatgttacttgcatcatttataacattgtgtcttattaaatcaggagtatgctttttttcaaaaagatttgacttaaattcagaggaaaagggtatttaaaaatcactgttattttgtgtcacaatggtcacaatgttaatttccctcccagtgctggctccttcgttttagagtttgttgaccatagaaaggtaatttcagaaaaaatatggatttgagcaatatttaagctcatgcaagagctaaacaagtaaagctaatttggtgatggggaatcagaaatgtaaatttaattatgttattttattttgtatttttaggtaagttattatgtagagcaataatttccagcagaaaactggaagtattcttgtagaacaggaatccttgtctttttcctaactaggagtcatgttgttttttttcaagtcttaagattatttaagggtgtgaacccccaatatctgtgttggaaacaagtgcttgatgtagccaaaagaaacccgcacttagacagaaattttctcagcaaggcacttttacttctgcagaagggtgctgcttgcacctattacaaatgcaagagcacaccgaacaaaggaaggaaggggtttttaaccctaacacagttcctgtttctgtatcttttccctattggctagggttggattgcacaatctaagctgatcccaactagccaaggcttaaacttttccaaacagggtaaatgtgagatttgtgaaggggcggggtgggtaaagaagaaatggttagacttaacagaagcgggggtaggattgtttacaacttatgaccaggaagttgagtctttgaagaggaactcaagtcgtcccaacaatttcccctcttctgtcttacagttcttcatcttcagatttctttaacaggatctggctttgttgttcttcttgattatcaaggtgcgagagcttatctgagtacggagggggagaggttggggaggtttttgtgagagctgcttctatgagcctttgggttaacccacgaatacaaggtatgatacagcaaccgacaaggatgagtacatctttaacaattgcaagggaagtaaagattgaggtcatgagtcccttccattttccaaaccacctttccattaggcctgtaaaggggtcgtctattccagagtttttggctaattgatttgctagggtggtaaggccttgtaaggcttttatgattgtcccatcaggggctgtattattaggaataaaagtacaacactggaccgtgatcatgacatagactctgccttttttggccaacaccatgtcaagggttattctgttttcccagaccatctggctgatggggcctagtttcagcgattccttttatggcatctctggtataattgatgaattgctgctgattgtagtatatgtgatttatccagtctacgtttttgtttatagtggaccaccagaataagatagactcgaacctggcggctatttggttttgagctttgaattcatttggtaccctccgcaggaccctgatgctgtctatgtaaacttgagggtcaaaggacccatttattggggcttctttttttcttctggttacctgcttcctgatgaaatgccatggtgaaagccatggccagttgaatcagagcacaagtgccactccagttgcttggcagtgtaccaaatattggtcccccacaataccaccatacatcctctcggggatggactagggctgactgattggttatctcttgaaaaggtttaggcccactacatcccatcaggtttccaaggaatgtcaaattttccccttgttgtgaaagacacaaggtaaaattggcatcgagagctggaagttgaatggcccttgggggctgtcccataggggtcctgacctttggggaaaatagtgagtgagtggcacatgacatgtttccccaggctgtggggtgctggaagagagctaccatacagtctttgcctgatggattggcccatccgagtgggaggggaacagtttgggtttctggcctgcctgttgcacaagcgtaacaatctgttttatttagggtgcgaatggaatatttaatcaattccagctaggcatttacatcttgataactggtttctatggctagggtttgctgtaaatccttaacttctactatagctactttggttttgtcagtaggcatgaagcgagaaatggtttgatttttgtggttttgggaagcgggtaatggggggagatggaggaggaggagcaaacctcatttcaaagatgcctgtagggtcttttgcagtgacatctgctcctaggccataaaggtgctctaaagtggggatagggtcagtggaggtggggataggaatagagagaagtactgggttacactggtggttttggcaatttgagggggtggttcctttggtgaagtggaggtagggttttagggcggtgcgaccctctgaggaggtccagccctgatatttcgtggtccagataatatctccccaactataacataacccctggaaggcttgtggtcgttgattgcaagggtcgggggtggtgctggtttttctggggatggggggcagaggtacttttctgaagaagctagctgtctttgactatggaggtttccacagggtatgacaagacaggcatcgaatgtaattgtggggagggtgatcgggttacattgataataaggtgtccttgggtagctaaaggaagaataaaaagacagattaaacctttttgaatgttagtttggagggtattgatcctggaatgatggtccatgactttgcaatggttgcggccccttttagcccagtgtggtgggtccatgcttttttggccgttcagattgctgtctcagtggttaggagtattagataaggagtattagataaggtccttcccaggttggttcaagctttccttctttccaacatatgataaggacgtgatctctgggctggtgtcggtgaattgggaattcgaggggtggagtttgcgctaggaggccttgagtcctgagggaggaaagggtggaagacagaccaaatatatatatttttagaaactgatcttttgtttcaaatgtgggaaggtcagtagtggaatttagataaggcagcccatagagcatttcaggccaagatcttttgtgtgtgtgtgtgtgtgtgtgtgtgtgtgtgtgtgtgtgtgtgtgtgtgtgtgtgtggcagagtcttactctgtcgcccgggctggagtgcagtgatcttggctcactgcaacctgcacctcccaggttcaagcaattctcctgccttggcctcctgagtagctgggactacaggcaccagccaccacgcccggctaatttttgtatttttagtagagacggggtttcaccatattggccaggctggtctcgaactcctgaccttgtgatccaccctccttggcctcccaaagtgctgggattacaggtgtgagccaccacaccctgccaggccaagatctttttgaggggcagtttggattcttagtaaggcaatgggaaggcattttgtccatggtaactggatttccaagattaatttggttaggtgattttttagagtttgattaattctttctaccctccctgatgaaggtggatgccagggagtatgatattcccattttattcctagtgcttgggttagccccttaatgatgtgtgcagtgaagtgagtctcattgtctgaatcagtgttctctattagtccaaacctggatatgatatgttccaacagtgctttgactacattactggcagttgtgcttgggaagggtatggcttctacccagtgggtgagatggtctactatgactagtaaatacttgaggcagccgattgggggcatttcagtttaatcaacttggatgctttggaatggccttaaccctgggtttcttcccgtgggaggctgcttctttagggtttccttactagtttttctgcacatgatgcaaccatcttccacttgcctagtactctatacacccatagactctgagggctacattgcacatagcttgaggaccccagtgagttcctggatgaagctgtgacaatatttccctcatgaggggcttagacagcatttcccttccatctggtaatgcctgctttccctctgggctctcctgagctcctattttctttagagaaaggtctacgtgggagaagatggggatcgcagctggagggggaaacaaagggatagatggaaaatgggtgccttttcggaagaggcagcttgcttagctgtttgatctgcaaggttatttccctggctttcaaaagatggattcttttggtgtcctgggacatggacaactgcaatttcttctggcagctgaagattttctaatacttgcaaaattaattttttgtggaccaaatcttggcccttactattgatgaagcctcgttcagtccagatttttccaaaggtatggactactctgaaggcatacttggagtcagtgtaaatagttccttcttgattctgcagggattttaaggcttggtttaatgcaaagaattcacagtttgggcagaccagttatttggcagtcttcctgactctacctctgtgaggatttccccatcaactgtggagtacctgttgtacctttttccttcaatgatccggggggaaccatctgtaaagaggtgatgccctgtttggaaaggggttttgcttagatccagtctgactctagtttgagaactgattagatctaagcatttatgcgtagattcttctgggtttggatttcctgttaggaaagcagcggggttgagtgaattgtcagtggttagtgttaggtcatccctctctaataagataacttcatattttaaaattcttgagtcagtaagccatctctctgccttctgattaagaatagttctgacttgatgaggggtacttatgatgaggtttcccccaaaggttattttcctgctttcttctgttagcaaggcagttgctgctatggattggacacattcgggccatccacgggttacggggtcaaggatttttgacaggaaggctacgggccattggtggcctccgtgtttgtgggtgagtactcctaaggccactcctttgcttatattaacaaaaaggtggaatggctgttctaaggagggcaaggccagaatgggggctgttacaagtaggtgttttatttcttctacctgttggatctctgatggggtccagaggagggtttacagggtctggtctttcttgagtgagtttttgatataggggctttgtttttaaggcataagagttaatccacagatgacaatatccaaccaatcctgagaatttcctaagttcctgctttgtttcaggtaaaggcaaagataccataccttcaatttgtttgggtcctatctttcgtttgcctttactgattaggtgtcctaggtatttcacctcaggttctacgaattggagtttattctttgagacctgtaacccttgttcccttaggaaatttaggaagttaactgaaattgctgttacttgatccttgttatctcctgagatgagcaggtcatccacatattggagaaggcatatggatgaaggcagggagaaattttctagaacttgttctaatatttgaccaaatagatctggggactctgtgaacccttggggcaagactgtccatcagtactgttgttttctatcagagtcagggtcctcctactcaaaggcaaacatgtcccgactatcttctgctgaagggcaagcccaaaaggcatcttttaaatctatcaccatgaaccattggtggttgtatgggattctactgacaatggtgtaaggattgggaacaacagggtgggcggtttgaactatttgattaatagcctggaggtcttgcactagccgggatgacctgtctggcttccttacaggcaatattggagtgttataagggggcatacagggttcaaggagtccatcgtggacaaggctttcaattatatgttttaaacctatcctggcttccaagggaatagggtattgttttgtttttactgcttccctggtagtttttaatttggcatggattggaggaacctgtagctttcctcgatttccttcctttgaccatatgtcgggatggatttggctttcttccgaagtggtgaccaggtttaaggaagtaagttttccctgattaacgtataggcctatgcctaaccttaacattaagtcccttcctaataaattagttcctgctttgggaattaataagaacttagtagtggccgacttattcttatatttgactttggtttcctctagaatttttgccctgaatccttcccctataaaccctgagacagtatggttttctgctgaaaatgctaagcctgatgggagaaaacatagggaaagcgagctgctcctgaatcgactaagaaagtgactatctctgatttgggtcccaccattaaatttatcaggggctcttggtgggactcaagatggaagatgtagagtacctgaccccgctattcttcttcaaatgtcatgagtggaaggactttcttttccctctcccattcaggacattccctcttaaaatgtcctggctttccacactagaaacatctgttttcccttctccccctccctgttccctgactctcaggtttcatccctttgcttcctgtataggggtcagacagccaggtgcttagaaggtctacaagttctattctcctgggctccctgttgaagagttccctgttgtagggtggacaggcataatctttgccttttgcttctgcctttcctcatccctctctacatacaccttttgggcctcttaaaagttcctctatgggatggtctttccaattttctatcttttgtattttttttgtaatgtctggccaactattggtgacaaagtggagctttaacattccttgtcccagtgggtcctctatgtctaaacctgcatattttcttatctgttccttaagtctaagaattctatgggcctttcatctttcccttgttgtacattaaatgctcaggaaacattagggttcaaggagctgattcccaaatccctttaattatcatgtccctgagatctctcatgttttctcagtgggcttcattattgttatcccactgagggtcctgggccaggaatttatgctctgctgcaaggacattttgaacaggagggtgtttgcgctcccagactatcatggcagccctgaagatcatggttctttcctttcctgagaagagaataactaggatagacattaattcagcccaagtgtacagttgtggctccagagactgtccagtttgatctgcgattccaaaagggtcgtctaacagtggtttgagttccttttttagatttctaacctctgaactagttaagggggcatttacaaagccaatatcccctcctcctagtggtacttcccttaagggaaaaagggttggggtagacttctttgaggaagggaggaaaggaaagttttggatatccctttggcattgtctatttcccattggagctttcctgaggaaggggcatgttcaggtggctgtccagcggggatgtggggtggcatggcccatggggcagggttatatgggagaggaactgagtgttcagcttggggtggaggggtagggaggggaaggactgagtgttccacttagggtggaggggtaggcaggggaaggtggtctagaggatcccatgcatctttagatacagaatttgacttaggtaggtcgtctttgggaggtattgaatttggctttgctttctcatcctttaggggatagagaaggacaggtctttttctccaacatagagcatcatctgtctcctcttgagaaactggacttttatcattgacttactggatcaggagttgacatatccagtcctcattttacccaaactctggccaaaagactgaaggtctgagggtgggttccttagtccaaataaaaacagcaatactttatcatacgctgtcttttcttgtgttttgtcctttcattatccttccagtattttaacataaggcataggggactgtcagggggaattttattgtctgcttggccttttatagtccctgtcttacttggggtatttcccatcctggcggttggtgaggctaaatgtctcgtattagagatttcttgcactcccgtgtcctagaggctgaacctccccttttcccactggaggtttcttgcactcttgtgagcacccactttgtccttattggctgcttccctcgtgagaattttaggttcctcttagtattggtgggttggtgtaatcccctgactggaaaactgccctaagacctacaaggtgaccacagaaccgagtccggactccacactcgcttcgcacccaatggcgtgtctcactcacacactttcaacctacagagatcccaaccaccaaggaatactttgttgccccaatagtgacgtttcttaccttggtctatgcacagagttatctggtcactgaggaattcttagggatcctccctatagcccatgttgctgagagtccggatttattcgtcactttgggcgagattcgatcctccactcctggggccaccacaacgaggcagtgggatgcgtctccccatgaaagataatcactagcccctcccaaaggagaatgggatcctggacaagcccccagatttgttggaaacaagtgctcagtgtagtgaaaagaaacccgcatttagaagttttctcagcaaggaactttacttctgccgaagggtgctgcttatgcctgttacaaatacaagagcacaccaaacgaaggaaggggtttttaaccctaacacagttcctgtttctgtgtctttcccatgttggatgggtcggactgcacaatctaagctgatcccgattggccaaggcttaaacttttccaaatagggtaaaagtgtgatttgtgaaggggtggcggtaaagaagaaacagttaggcttaacagaagaaggggtaggattgtttacaacttatgaccaggaagttgagtctttgaagaggaactaaattgtcccaacatctgggacaggtctcagtttatttagaaagtttattttgccaaggttgaggacacccaagaggtcctgatgaagcaactgtgttgtctgaggtatacacccaaggttcatcgtcttgtgccaggaaaatttaggacaccgacacacacgaggagtttaggagcagaggtttaataaacagaagaaaggagaaagaaaaacagctctctctattgagagagacgggtcttccgagggaaaagactggcaggtggtggatgcgccggattttatagtccagcttgaggaggcggtgtctgatttatgtagagctcacagattggttcgatcaggtatgaagtttacatagcatgcagggaaggctggttgccccaccctaatcttattatgcaaacgaactttctccttggcaggtgccatcttatctgctccttactgtacatgtggctggcagagaagggaagatggagcctccatcttgagcatgtctagtccctagttcctgctggcattcacccgtgcaagctcccagcttccttgtctgtgtctgcagctcgacttcacagactgctctttgttagaaaatgatttccagcctggccaacgtggtgaaaccccatctctactaaaaatacaaaaattagccgggcatggtggcacaagcctgtaatcccagctactcgggaggctgaggcaggagaatcgcttgaacccaggaggcagaggttgcagtgagccgagatcatgccactgcactccagcctgggtagcagagtgagactctgtctcaaaaagaaaaaagaaaatgatttggggctacttttcattaaaaagaaaagccttactgaggactctcgtacccttactatctgcctaagtgatttcttcttaactcctgtatcactgacaacacgtgcccagggttctcagagcacaacttggttttatacattttagggagacatgagacatcaatcaacatatgtaagatgaacattggttctgtccggaaaggcgggacaattcaaagcaaaggcaggactactggaagcagggagtgggcttccagatcataggtagataaaagacaaatgattgcattcttttgaatttctgattagcctctccaaaggaggcaacagatgtgcatttatctcattgagcagaagggtaactttgaatagaatgggagggatgtttgccctaagcagttcccagcttgacttttccctttagcttagtgattttggggccccaagattttcctttcagaaggggtagaaaatggtggagggtatataggtgagaaaggttacaaaaactgattacactactcactaatggaatgttgcatactctggttgagttatctgacttttccatgtaagctgtaaggaaaggcatggtgggaccagcagtgtttaataggaaactgagccacttttctcttcagttgagggtggagcagaggtacttggcagcaatgccttcttcaccaaaactctgagtctgcagttggcaagctatttctcctcctttagccttttcacatgggagtgtgagaagatagtgccctcttttctgccttcacttgccaaaatctcatccttcaggcgttgcctctttaggaagtttccacccattgtagcaaaaactatcagttatccaccaaagtcaccaaaatccatttttcccttctgtagtagccacagctgtgatgtcacagtccaatcagcctttgcagctgtgtattcaccatcacagttaagatacagcataattctatcaccacagagatccttattgctactcctttgtagttgcatgtaccctctcccctgactatccaatatttaatgactttttaaagttaaaaacactgttaaaactcataggaagagctgggttagcataaaggcaaaccctagtatgttcctggatgagaagacttaatatcattctttctcctgagtgaggactaggttaggaattctaatttctcatggtttattttattggcactctattccatcctgctccattgctgagtcttgggaccatggaggggactttttctgtagctcctggcttcatgtagaaagctcagtttagcccctctggtgcataaatttctatgtttgcagccagtaattcttattcttcctgctacctttcaaaacccaggcttaaaggttgctgtctagttttgatactcctatggactgccactcttcagttcctgctttccttctaggtttatggcatctgtgtatttccctttcttgcttttgaatttgactgtttaaactcttttaaaatattttatttagaatttttttatttatttatttttgagacagggtctcactctgttgctgaggctagagtgcagtgccaccatcatggcccactgcaacctccgtctcctgagctgaagcaatcttcctgcctcagcctcatgagtagctgggattacaggcatgtgtcaccacacccagcgaatttttaaaattttctgtagatacggagtctcactatgttgtccaggctgatctcaaactcttggcctcaagcgatctcacaccttggcctcccaaagtgctaaactctttaaaataattagttttgtctagaatttttttatttagagtaggaaggaatgtttaccacccatcagctcagtgtgcccttttttcttttaagaaatcttaagcctgcagaaaaatggaaagactagaacaattaagacccatatatccttcagctagagttatcagtttttaccattttgtcccttttgcacacctttcttcccttcccacacatatactctcacatcatttaaaagttagttgcagacaacacaacacttcttccctaaacacttcagcaggcatctcctaagagaacaagtaagggcattcccctacaaaatcagaatgccattatcacatctaagaaaatgataattaattcaatgtgtcacccaatgtatcgtccatatccaaatttcttctgagattgttctcaaaatgttaatttatgctgtgtgtgtgtatatgtgtgttttcttgatccagaatcaagtcagtgcctgacacttggttatttaatattttgtctgttctagttgagaataatcttttttcctttttttttttttaaagacgaggtcttgctctgtcacctaggctagaatgcagtggtgcagtcatagctcactgtaacctcgaactcctgggcttaagcgattctcctacctcaacctcttgagtagctgcaccaccacacctggctaatttttatttttatttttgttgatgttgcccaggctgctcttgaacttctgggctcaagcgatccaatcctccacctcagcctaccaaagtactgggattacagatgtgagccactgcgcctagccacatataatattttggaaagttcagatcagatacagaatgtctcacattctagatttgtcttattgtctcctcatgattaaatcggctaaatgttttggcaagaatactgtataggtgatgttttatatttttcattgcatcatattggaaagtgcataatgtcagcttgttaaactgttgtggtggtactgagttaaatcatttggctaaggtgatgatttctatatctcttcattgtaaacatacatttccttctttgaaattagtgatttacctgtggaatgataatgtgaggtactgtgaatagtttcttccccaataataatttacttaatagtttagcatccatttttgatgcttgtttgaatcagttatcgtaactggaattcagtacaacttattgaccagctgcttatacactgttcatttattcattctgcagttattaattgaaatagataccacattagcacatcaggctctatgtgaatcaccaggaatacatggtgaacacagtctggtgggtgcccttgtggtgcctacagtctggtgggagagattgacaaataatcacactgatgtgtatttatagatggtgataaatattttaaggaccaagaatggggtgccatgagggattgttgttgtagaaaaagcgggttcttgtcaaacaaccaggaaagattaggctcacagacacttttttttttttttttggagacggagtctcgctctgtcgcccaggctggagtgcagtggtgtgatctcggctcactgcaagctccgcctcccaggttcacgccattctcctgcctcagcttcctgagtagctgggactacaggcgcttgccaccacgtccagctaatttttttgtatttttagtagagacggggtttcaccgtgttagccaggatggtctccatctcctgacctcgtgatctgcctgccttggcctcccaaagtgctgggattacaggcgtgagcctccgcgccctgcctaggctcacagacactttgaagggtgagggggaaggcaaaaaggaaaaaactcagcaaagcgagaggggttcctgttaacaggctcccatctcacagattgaatcccatgttaccacacaggaacaggagaggcaaacggagtgaacttcccaaggccccaccccgtcctcccagtgtgcagtgcgcaggtgggcatccagaaagaatcagtcaaacagggaggtgaacaacacacaccagggcctgttgcgggggtggggatcgtacttagaggatgagtcagtaggtgcagcagaccaccacagcacacatatacctatgtaatctgcatgttctgcacatgtatcctggaacttaaaaaaaaaaaaaaaaagaatcagttggaaaagggcaggcttcatccaggatgggcaatttggtttttcagccctcatgctgttttaaacttgaaggtggggttttgctggggtacccttggctgcctcctgtctctatctgtccccttataaggggagccatcaccttttctgggggttcacataacacttgcctttgaaagtgatatttgagcaaagagatcaaatgaagaatgatgaacttaaataacctcttgaacttctgtactagttattctgtagcacttatctgttaattttatctgacaggttaatcacttgctgtctcctgtgctgttattaaaatcatttattatttaaattttcttacttagccttgtttactgttgactaaattataagctttataatgttagggatgatatctgagacttgattacagtatagatgcatatagtagatgcagtaggtaaatatgttaatctgattatttgtttactaatatttttataatgaccataaaatgctgttaaatattgtaggtgtatattgaatgtgtcagattgtgtgttgtgagaaatttcatttgctcttagcattagtagacattaaatgtgcaacctatctgaaatggcatgcatataaaaatgattttgacctataaataattagacaacaaagatagatatttaaaaaaattcatagattatgggctgggtgtggtggctcatgcgtgtaatcccagcactttggaaggctgaggtgggcagatcacttgaggtcaggagtttgagaccagcctggccaacatggtgaaaccctgtctctactaaaaatacaaaaattagccaggcatggtggcacacacctgtagccccagctactctggagggtgaggcaggagaatcgcttgaatccaggagggggaggttgcagtgagctgagattgagccactgcactccagcctgggtgacagagtgagannnnnnnnnnnnnnnnnnnnnnnnnnnnnnnnnnnnnnnnnnnnnnnnnnnnnnnnnnnnnnnnnnnnnnnnnnnnnnnnntaggagccaatctataaatgttaaccaagttaataatcatgggaaaatactctttctttttttgagatggagcttcacacttgttgcccaggctggagtgcagtggtgcaatctcggctcactgcaacctccacctcccgggttcaagtgattctccctcctcagcctcctgagtagctgggactacaggcacacgctaccactcctgcctaattttttgtgtatttttactagagacgaggtttcaccacgttggccaggctggtctcaaactcctgacctcaggtgatctacccacgttggccttgcaaagtgctggaattacaggcatgagccacgacgcctggccgggaaatacttgaataagtcagttaaattccctgagcttgttttcttatttgtaaaatgagggaaatatcattgacacttatatacctcagagaagaagaaacactaccttagtaagtcaaagaaatttcatcacttattatatttgacttaaagtttacaaagacagcctattacatttctgattttctctgtttttcatgttttccttactcagactttttggggaatttgtaatttgacctcccctgcctgtattatatcaataagaagccaagcagaattttcagtttggaaagaaaaatttgaaacactaaggaaataggtgtggagatcatggtaatggatggaaaaaaggagataataggtagcatttacttaacacctattatgtgcccttagcatctgttaagtcattgacatacctagtgtatatgcccaaggatgcttttggatcgattaacattaaagaaatggtttagaaatggtactcgaagagggttacaagaataaccaggtcagggccaagtgcatggctcatgcctgtaatcccagcactttgggagactgaggtgggcggatcacttgaggtcaggagtttgagaccagcctggccaacatggtgaaaccctgtctctactaaaaatacaaaattagctggacatggtggtgcttgcctgtaatcccagctacttgggaggctaaagcaggagaatcgcttgaactcgggaggcagaggttgcagtgagccaagatggagccattgcactccagcctaggcaacaagagtgagactctgtctcaaaaaaaaaaaaaaaaaaaaaaaaaaggaataaccaggtcagagtcatcattagcattttggaactagtatccgttactcctgtacttaaacttccctgtcatttcccatttgaaaaaaattctgtaagcttcgttctttaatagaaacacaattttataccaaacaatgattcctttcccagcatctgaaatgtgtctgttgaagcatgaaatgatcaccaagtcagccttttatatttagttatattttgttgattgtcagcttacaggtttttagaatttattagcttaaagatcttataatatatccagtgggatgccaggttttgtagtttaccattatctggaaagatttataagagattttatccttgtgtatatacttaagatttataaattatattttaataattcaaaatgtaatacgcatttactttttaggtttaaacaagtctcttaagtggtgtttcctcaccgatggagaattacttccaagcagaagcttacaacctggacaaggtgttagatgaatttgaacaaaacgaaggtgagaatttatattggtgaatctgtttgcctatgtggtatagagaatgtggggatataagaggatgtagtatttaaaaaaataaaatcaggtctgatgacttaatgatagtaatattatttaataatatacaggggaagaaataacattttttagcactaaatgccagatacttaaaatcccacagatcttattgccattttatagatgagaatagaggcacagagaggttaagcacttttctcagagttatcttgtgaacaagtggcaggattagaatccaggcagtgtgacactagagcctgagctttactgaactaccctatacaatgaatgtatggtcaagaaatgtgcttgcatttcctaaactaagaaaaatagctcgttctatattgattgcccaataaagtaaagatacatttaaaactatttacatcacaactgcctaagtggttaattatatattctcaagcatcagtagaaatgtccacttaagattcacttcttttgtttgtttgttggttggttggttttttgagaaagtcttgctctgtctcccaagctggagtgcagtgctcactggaacctctgcctccctggctgaagtgattcccatgcctcagcttccagagtagctgggattccatacacccgccaccatgcctggctaatttttgtatttttagtacagaaggggtttcgccttgttggccaggctggtcttaaactcctggtgtcaagcagtcctccctcctcagccgcccaaagtgctgggattataggcatgagccaccacgcctggccaagattcacttctatttagggaagacttttctctaaatttccatcttggtttaacttgagtgggtaagccataattaaatttcttcctcctcaccgttcttcccctgtgttctctatttctaacaggaaatggcattaacaagtttacaaagtggtatatttccatccaaagtccatgattccagtccaggcaacatgatgaaaccccgtctctacagaaaatacaaaaaaaattagccaggcctggtggcacacctgtggtcccagctatttgggaggcaaaggagggagaatcacttgagccctagagatagaggctgcagtgagctgtgatcatgccactgtattccagcccagatgacagagtgagaccctgtcttaaaaaataataaagcccatgatttccatattggtttacaaacctttgctatattcagtgaatcgggctattctttgatagcagttgggaagacagattagttttgactttgttactttagatatttaatgctctccagccttaaattgaatatggaatcatgacaggaaggaagagagagaggaaggctaccagagtggcctgcttttctcatattttaccattgatgacctaacactaacctatattcctaggctcattcctggttcatgtaaatgtgaaatctaatcattggggttttacatcatccaggtgggctttgtacataccaggctggaaggtatattattttctgagtttcaactgtttgtataagtattttcttaatcttttatttgatttagccctctgtgtatcacagttctttgagtcataaggtacttagacatgtattacacctaatcatgtgaatactatgcttctagaataccactgactctaataaaactcttagttcattacatttgtctctttgtgacttctgtagattctattagggtgctttgtgtatagttgttttcaatacatttttgttgaatcagtaaaaatattttagttaaaaaatagagcaattgcttacagaataataactcctttagaaggagaaggatttctgaaaccagcttcttggttgtaactttgtggttcatttgtttgaactatttttttgaatctcactaccagttgcattaaaaactatcacttcaagcctcgtgttatcttagagaatatacttaaaatgatttctcattttgtgttaatttattttctcatttaaatgaaaaaatataccacagactgtgatgacactgggcaatcaacattatgcccaggtaggaggcagttgaataatgaaaattttaatacccgatcatttctgtttgaacattgctaaatattcttgtaagaagctgtaactatttttttgtttccaggaaccatattggaaatatgacttatttgcttttttttcttttaaggaatcctgtgttactaaatttcaaatctctactggttcaaatttggtaaattcaggatttgacatttcagaggatactaagcccattcttcacacaatctgagttttgtgccctttttaacaacttttcactacttctttacactaattcttttctcaacccaaactgatttacttattgcttccttaaattcttatatttggggatatgcttttctttattcctctatttattaatgctttcttttccaaacttacataaaactgtctttgaagcatagcccagttcttcttgccttcatgaattcaagctcgcttacctcatcctggaaaatatctgtctcctctgaatttatttttctactcctacataatagttttcagacactgagtcctcacttgatgtctttgataagttcttggaaactgtgactttaagcaaattgatacactgtatgccggagaaccttaactgttgtttatatcaattagcttatagtaaaattggcttctttatacagtgagttgttttgcttataattgcagtttccaagaacctatcaacaatgttaagtgaggacttactgtacctatgctactccatactgctaattagatgtttgtacgtgtctcttattctcccaatgagattatatacttcttagaggcaagagctatcatttaatcttcatgttcctcaatcctgctgcttttactatggtagatattcacttatatatttactgtgtatgttctacctatcaggcactatgcaaagtgaggacttatattgatagaaatgatttctgccttcagaaatcattcagtggttgaaagagaagggtagataaactattgcatttcagtgtagtaaatgccttaataaagttttgattaaggtgctgtggacacattgaagattaatgttacagatgaggattgagcttacaaatatatctgcataatttcaggaccatgattatcagagatactggaggaagaaagcaagaaaggcactgagtgcattgttccttatttctctaatttacttagacatatgcagtagccctataacttgagagaataacttagccattgtagttatgatctgttaaaaagtaaacagaaacattatatgaaattatgcttattggtagactataagaatgttgatttaatatgataaatgaacactttttgcccagtgtcctcagataataatataaatatgaacctgattaataatgtattgtgacatggttacaagcagaatttcacgtactgtggcaaactttttttaacatgtgttgggcaaatttaaaatatttttaagtaagaagtataataaaccccagtgtacccatcatccagctttcacagcatttcatatgctgccattttgtttcatttatacctttatcaccttctcactccctgcttcattcttattttttttaacagctttttaaaaggtaaactttatatacattagaatgcatagatcttaactgtccagttttggcaaatgggtatctctctcaaacccacatcctaattatgatacagagtgtagagcattcagtctctacagaaaacttcattttccttcctgcttaattagttatcctagccactgttctaaattttttccatctaatccattagattagcacctgtcctggctttgctcaatccaagggtgctttcccctcttctgggtcccattcacctgtgggtcagtttaattatgttactagattgaggtagaattcttttgttgtttggaatagtctgagatattaccatttggtgacatataattgcagagaattgtctgaaatatattttcttattttttagccccgaattagaaatctaatatccttggaatatttaattttcaaacgatagttagaaatgttattaacttagtcataagcttttccagtgttacaagcaaacttattgtaattacttatttttttccagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggtaagttgcatgtatacactcagaaatcgggcatgcacattttgtaatgctgaattaaatagtaataaaggcaatgtaaggtgaatatatgtctggttgagttgacctaaatagcatttttgaaaacccagttctagtaaatttctatataaaaaatgatgtcactgattcttagatagtatttgtaattttttttgttgccacgatttatgctgaatcagtttttatgaagagatgagaattgaggaagtgtaaactttgtggtttctgtattgatagctacttggttaatgtaatagtttgaaataaggaagttattctttcagtttaggaaatatttgtcattaacttattgcattatttattgaaaaatgcatttaaatacaaaaaataaaaataaaaattacatttaattgttgaaaaatattacacatagaatccatcctacttttttctgtgagatttttgccattatacaaaacattctggaactctttatacacatgcacacatatttttgtcttttctcccatataactttgatacaaagtagagttgaagtctgtagatttttatgacaaggttgtaagaatgatattccttagctctccccaaattttgttagctaaaaacacatcttttttgtttgtttgtttagagttgtaaataaggaaggaaggagattttatatttttgagatatggtgtcaggtctagaataaaatttcagctttgttactattaattatataactttactaagccttagttttataatctgtaaaaacaaaccaaaaaagattaataacttttattgggctgttgtcaagattaaatgagatctcagaagtcatagtgctcaatgattaatctctacctcccttcttgcctgattttttggtccatctgtattaattagggtgctttcaacttcaaggaacagagtgtttgaccccccagtgacttaggtgaaaataacatttatttcatgtaaacagaagctatgagactcagtgatttatgtctgggtgcagagacaggatcgtggaagttctctcggtcttcccctcatgtcagaagatagtatctcagttctaattatcgggtctcaacctgacaacttcctaagcacaaagaaactggctggggggcaaaagagcctactctactcttggcaccctcttatcagggaggaagggacctccagcaacttcctttaatttattggccaattttagaccataaccaattacaggcaaaggggactgggattatctaatcaatcatgatttatctcctggggctgagcacagtgttgcctgaaaaaaagtgggattctgttaacaaaggagaaggggaagtagtgatatgtaggatgagtaagtctagacgtctaatgtactacatgaggactatgcataataaaatcatactatatttgggattcttgcaaaatgagtagattttggttcctcttgccacaaaaatgggtaactgtgtgagacaatagataggttaatttgcttcactatagtaacctttttactgtctggatgtatctcataacatcatgttgtataccttaaatgtatacaataaaatttattttaaaaaaaggagaggaggaaaatggttcctaggtgagcagtcactaaggtttactagaagatcctagcacaaaagaaccaaattacagggagcagaaagaagctaaagctgacactgggcttgttggtctctgattgctaaagtttgaagaaaataatatgtctaattcctaaatattttccagtcttcttcttgttagctgaagtactatttgtagattaggttcatcatttttatgttgttctgtattttgcttactgtaacactttctgaagtgtttgctttcttaagtaaataatgaaaacatttttggtataggccagcacatccagctataatgagtaaataggtaccttagatggattcagaaagaaaatgatgcacaaaatgcatcataaattgcaaaatggttggaatttttgctgagtagaatttgtggaatttatgaattcatggattcatgtggcttatggattcataatttcatctttttccctcgtttaccttagagatgttataagtattaatgagataatatctgtaaaaatccttgagcttctcagaagaaaagggcttataaacatagatactaattggattatgctgagaatgcagctagaaaaataccccaaataatgttatatattgaaaaaaagaaagtttgttccatttcagtagaaattaagcatacgtagtaattacttaatatttatagctatattccctttactgcaacaagcatatattgtgtctaatatataaaaggttctaggctaggtaatggggattcagaggtatataaattggaatttatgatgtcatggcaatctttttttttttttttttttttttgagacagagtctctgttgcccaggctggagtgtatggcgtgatctcagttcactgcaacctctgcctcctgggctcaggcaattctcctgcctcagcctcctgagtagctgggaccacaggcatgcgccaacgggcctggctagtttttgtatttttagtagaggcggggtttcaccatgttggccaggctggcctggaactcctgaccttaagtgatccacttgccttggcctcccaaagtgctgggattacagacatgagccactgcgcctggccaatctactgactttctaattatgatttcatttatgtcttatctaagtttattatttgtttttgtaattcagttccaagcttgatgagggtaaggattttttctgccttgattgctgctgtatcctcagccctagaacatacgggtgctcagtagatatttgttagatgaattaaacaataagtgaatactgtttcttaatgcagcagtactttttttttttttaaatccagtgccttcaatctttagatgatggtatcaaatttagatataacgggtgtaagaactttggaaaatattttaaattagtcatgtgtattgttcctacttaagaacagattcaaaccaaaatgtttctttccctagtttcttatgtactgatgggaatgaatagatatgagagtagtaagtagctgctttagaatattacatggcaattcacagtttccctcatactttgcatgaaaatctgtcttgccttgtaattgatattgtgattttagccatctggcatgaaaaaaacagaaccaacatttagattaatcttggtttctagtgaagctgaacccagggaaatattttccattacacaccctctgaaaggctgtattggttaaaagtggtctcatccatgtcatagcacttatcatgcagtattgtctttgtctttgttccccattaggctgtaaagatcttgagattgcctctgatttgtctttgtatccagcatccagcacaaatacctggcacctatgaagtactcaataaatgtttgttaatgagtgagtaaatgagtctcagatcattgattaattcaacaaacactgagtgcctgttatttgtctgtcactgtgctgggtgccgagcttacaccaatgatgttgtgctccccaccctcatggtatgtaaagattaggccagtgacaaaaacaaaacaaaacaaaaaaacatgatttgtggcaagggcgatgaaggagataaggagggataatataaaaaatgggggtgggagaagaaggtatgagaagacatctgagaagtgacatagttcaaggttgacacatcaaggttgacacataaaggtggaggagtcagttcttcaaagaacagagaaaaatgctgcaggaagtagaacagcatggacaaagtcattgaggttaagaaggcacctattcaacaaactgaaggaactcctgcaggaagtagaacagcatggacaaagtcattgaggttaagaaggcacctattcaacaaactgaaggaactccagtatagtgaacgagggaagagtcacataaaaagagatgggaaagcaggtggggtggcacaggcctgttgtcccagctactccataggctgagcatgttatgatcatgtctatgaatagccactgtactccagccagagtgacagagctgagaccccatctccactaaaaaaaaaaaaatgctgatgaggaagttaaggaatagatgatgcagagctttgcaggtcatgtaaggagcacagtgggaagccatgggagtggatgagattaccaagggaagagaatagactcagggctgagcccatgtggtcaagcagaggaggacccagtaccagttgccaaggagtgagcggagaggtaaatagaaaaccaggaaaatatggtctcttggaagtcaaaagaggaatgtagtttgtgaaagggtttatcacctatataaaatactgtcagtaagatatggacaggaaagggaccattggacttggctataacagggtcattgaaaaaagctgattgagtggagcaatgtttacagaagccagatgggaatgggttgaaagtggaatatgaagggaggaagtggtgatggctttttcaagaacttttgccatgaaaacagaaaaaaattgtagcaattattagatggagatggtggttatggatgcctttttggaggatgggaaatactgttgtatttttatagtggtatgggtgattctctagaaaagaagttttaggagaaagggaggattaaacaaaggaagagaaaaatccttgagaaggccaaagggatgggatctacaacatgttgaggatttgctcttcagtgggtggggctagacagaggttggtttatgaagttagtggtgagagcatgaagaaatttacacctgattggcttatacttcatatagaaaatataaacattgtgaagggtgaaatagggatagatgatgaaggtttgaggagagtgagatagttacattggagaggaaaagtaaagcctaatagtgaattgaaatttcaagagccctttgtgcttggcatcaaactttcagtcagttagatgaattaaaaaataatctagtccagtcctgacttaatgggttagaatcagtatttatccttggagatatgatgaaattgttatattatctttgcgatacaagcattttagtttggagaagcaagaagagttctgtaggacccgtctgtgctactacctgtctacctatttccatgtatttgttcttttttaaaacaatttaaaaaaacttttagctggatgcagtggctcatgcctgtaatctcagcactttgggaggctgaggcaagtggatagcttgagatcatgagttcgagaccagcctggccaatatggtgaaacctcatctctgctaaaaatacaaaaattagctgggcgtggtggcaggggcctgtaatgccagctactcaggaggctgaggcacgagaattatttgaacccaggaggcagaggttgcagtgagccgagatcgagatcacgccactgcactccagcctgggtgacagagagagactctgtctcaaaaaaaaaaaaaattatgacatattatttgttctttcattcagtgagcatttacttattgcttggtattctgttttttactaaagagaagcaaaaagaaaaaaaaaaaggaaaagaatgggcctcctggtaaaacataccactcatgttactgtagatgacttaaagatataaaatgagaaatgaacagttacaaagctgcagatgctctgcagtgggaagcagatagattgtggtggtggtggtggttgtgaggagaatgagatactaatatttattgagtgtttaccatgtgccaggcgcttttctaaatccagacttacagactttatttaatacacataacaaccctatgaagtagctagctactgttaaaatccacatttacaagtgacaaaataggcctagaaagattaagtaacttgttcaaaatcacacagccagtaagtgaagttacgattcaaactcagggactttgacttctagaaccaaaagggagctagcatttgtttagtgcctattctgtgctttatttattatctaacttaatcttcctggtaaacctgtgtgatagttgatggtatccctaattaacattgaagaaactgatacggtaggaccctgacacagtcttgctagctgtataactcatgctctttcccataaataaagttgagagaataaaacaaataggtttctttatggtgatctttatgttattttctttgcatttctgagagaaatgtctgcatttatgccataatttttatttttaatttttggagacagggtctcactctgtcgcccaggctggagtgcagtgatgcaatctcaactgactgcagcctctacttcctgggcccaggcaattatcccacctcagcctcctgagcagctgggactacaggcacacaccaccacacccagctaatttttgtattttttggtagagacaggatttcaccgtgttgcctgggctagtctcaaaactcctgggctctactgatacatcagccttggcctcccaaagtgctgggattacaggtgtgagccaccatgcctggcctttatgccgtaatttttaaaacaaatgccttaaatactatttcaaaaagaaagatgaaaaatatctaacattttattagatataaatttttattttgaatagttatgtgttaaattagttgcagtttatttttgggtaacttgagttgaagtcatttttgtttaacatttgagaatttagatgtgaatagagaataaccttcataaaatctgaattagtaacacattaagacaaataatgttttggcttataccttcagagatcagttttcttaaggattttttttatcctgttttttttcctgggttttttttttttttgagacaaactcttggtctgttgcccaggctggagtgcagtggcatgatggtggctcactgcaaccttgaccttccaaggtcaagcgatcctcccacctcagcctcctgggtagctggggctacgagcatgtgccaccacgtgtaactaattttttttttttttttttttttgagatggagtttcactcttgttgcttgcccaggctggagtgcagtagcaagatcttggctcactgcaacctctacctcctgggttcaagcgattctcctgcctcagcctcctaagtagcagggattacaggcacctgccaccacacccgactaatttttttatttttagtagagacggggtttcatcatgttggccaggctggtctcgagctcctgacctcaggtgatccacccacctttgccttccaaagtgttgggattacaggcgtgagccgctgtgcccggccactaattttttaaaaaatttaatgttgcccaggctggtctcgaaatcctgggctcaagggatcctcttcacctcggcctccccaagtgttgggattatatgtgtgagccactgctcctggctgcctttgattttaaaacatggccactggttgggctccttgggaagcagaaaggtagtagtaggccctcactcagtaccaaatgttattaacagataacttaggtgcaaagtgggataaaacacatgtagctagaaaatgtttgcactaagttcatgctattttttgtttttttgcatctcttctcctgaaagccatctccctttcaatatctagtctgctgatacattctaaatactagtcacaattttttattgtaaaatatgcataacataaaatttaccagtgtatatgggtttgagggtatatggttcagtggcgttacatgcattcacattgttgttgtacaaccataacaactatctccagagctttttgtttttttttgagacggagtctcgcttcgttgcccaggctggagtgcagtggcgcaatctcggctcactgcaacctctgcctcctgggttcaagtgattctcctgcctcagcctcccgagtagttgggattacaagcacccaccaccatgcctggctaatttttgtatttttagtagagacggggtttcgccatgttagtcaggctggtctcaaactcctgacctcaggtgatctgcccgtcttggcctcctaaagtgctgggattacaggtgtgagccactgtgcctggccatttttatcatctcaaacttaataacttcccatctttccttgcccctaatgcctggtgactgctattctaccatctgtttgtatgaatttcactattctaggtacctcatataagagtggttacacaatgtttgtacctttgtgtctacacatttcatccatgtcgtagcatgtattagtcagaaggacagaaccaataggatgtggagatatatagatatatatatatgactttaataggtaggatatatgtatatatacgagagtttattagggagaatcaactcacatggttagaaggtgaattcccacaataatctattggcaacctcgggaaagagaagctagtggtagggctcagcccaagtttgaaagcctcaaaagcaggaaaaccaacagtgcagccctcaatctgaggcctaaggcctgagagacccccagaaggctgctagtgcaagtcttagaatccagagcccaaagaacctggagtctgatgtacatgggcaggaggagaggatataagcatctggcaaggaaaaagagaaagcaagcaggaagactcagcaagcaggcttatctttgcttcttctgcctgctttgttttagtgcactggcagctgattgtatggtgcccacccccattgagagtgggtcttcttctcccagtccactgactcaaatgtcagtctcctctggcagtaccctcacagagacacccagaaacaataccagccatctaggcattcctcaatccagtcaagttaacacttaatactaatcatcacatagtgtgtatcagagtttcattcctttttaagtctgaatatttcattgtatgtatgtaccacattttgttaattcatttatccatcaatggacacttcagttgtttccacctcttgggtattaccaataatgctactatgaacatgggtgtacaagcatctgtttgagtccctgctttcagttctttgtgtatatacccagaagtagaattgctggattatatggtagtcctgtgtttgattttttgattaagcaccatattctttttccactgcagttgcacaattttccattcccgtcaacaattcacaagagctccagtttctccacatcttctttggctctgtgtccccacccaaatctcatctcgaattgtaatccccatgtgttgggggaggggcctggtaggaggtgattgaatagtgggggcagatttcccccttgctgttctcataatagtgagttctcatgagatctggttgtttgaaagtatgtggcactttcccctttgcatgctctgtctctcctgttccaccacggtaagatgtgcttgcttccccctttgccttttgtcatgattgtaagtttcctggggccttccagtcatgttccctgttaagtctgtggaactgtgagtcagtgaaatcccttttcttcataaattatccagtctccagtagttcttcataacaatgtgaaaacagactaatacacttgtcaacacttgttttctattgttttgatatagccatattaataggtgtgaagtggtatctcattgtggttttggtttgtatttctctgatggttagtgatgttgagcctcttttcatgtacttactggtctctatattaaaaatctttggagaaatgtctattcaggtcttttgcccatttttaaattgggttgtgttttctgttgttgagttttagagctctttatatataattcagtctcctatcacataaatgatttgcagatattttctcttattcttgggtttttcattctgttgtcctttgatgcaccaaagtttttaattttgatgaactccaacttacattttcttttgttgcctgtgcttttggtgtcatatcaaagaaatcatctccaaatttgatgtcatgaagtctttcccttatgttgtcttctaagtgttttgcagttttagtgcttgcgtttaggtcttttatccattttgagttaattttttgtgtatagtattagcttagttttattcttttgaatgtggatatctggttttctcagtatcatttgttggaaagactgttctgttcctatggaatggttttggcactcttgtcaaaactaactggaccatataagtgagagtttatttctgggcttttttctattccattggtctttatgtctgtctttaatgtcagtaccacatggttttgattaccatagcttcatagtaagttttgaaaacatggaatgtgagtcctctggggttgtagtttgtcaggattattttggctattctggatcccttgagattcaatttgaatttgagaatggatttttctgtttctgcagaaaacatggttagggttttgatagagattgcgttgaatctgtagatcactatgggcattgttgacatcttaataataagccttctagtccatgaacatggaatgtttttccatttatttgtatgttctttaatttcttttagcaatcttttgtcttttgtagttttcactgtacagtattttacctccttggttaagttaatttctaggtattttattctttttgatgctattgtaaatggaattgtttccttgatttcatttttggataattcattattagtatgtagaaatgcaatggacttttttgttgatttttgtatcctgaaactttgccgcatttattagctctaacagtttttgtgtgtttgcggggaatctttaaggttttctaaatgtagcatatgttgtcagtatacagagataattttaccttttcctttccaacttgggtgccttttatttatttttaattgctctggctaaatttccaatactatgttaaatagatatggcaaaagtatgtatccttgtcttgtttctatcttaaagcaaaagttctttcagtctttttttttttttgagacagggtgtcattctgtcacccaggcttgagtgcactgccatgatctcagctcaccgcatcctcaacctcctgggctcaaggtatcctcccacctcagcctcccaagtagctgggactaacaggcgtgcactaccacacctggctaatttttttttatttttagtagacatgaggtctactgtgttgcccaggctggttctgaatgtctaggcacaagcgatctgcctgtcttggcctcccaaagtgctaggattacaagtgtgagtcaccatgcttggccagttttcagtcgtttttgttgttgttgttgttgttgttgttgtttgtttgtttgttttttgtttttcttttttgagatggagtctcgctctgtcacccaggctggagtgcagtggcgcgatcttggctcactgcaacctctgcctctcgggttcaagcaattcttcttcttcagcctcctgagtagttgggattacaggcacatgccaccatgcctggctaatttttgtatttttagtagagacagggtttcaccatgttggccaggctagctttcggtcttttaccagtgcatatgatgttggctctgggtttttaatatatggcctttattatgctgagataatttacttctgttactagggttttttaaagttttttttaaatcatgaaagagtgttgaattttgttaaatgctttttctgtatgaattgagatgatcatttggggttttttgtttcattttgttcaggtaatgtgattacattaattgattttcataagttgaattatccttgcattccagtaataaatatcacttggtcatggtgtataattctatcaatatgttcaattcaatttgctattattttcttgagttttgtatcagtatacattcatacagaatattggtctatagttttcttataatatgtttgccttgttttggtatcaagatagtgctggcttcacagaaggagttaggaagtatttcctcctcttcaattttttggaagagtttgagaaggattggtgttctttaaatgtttggtagaatttgccaccaaaatcatctgatctagggctttactttgttgggaagtttttgattactgattcagtctccccactagttataggtttattcagattttctgtttattactgattcagtcttggtaggttttgtgtttttagaagtttatccatttaatctaggtaagtcacatttttgttgtagcgttgaggcattttttttttttttacaaaaaattggtactcatatacataaagtaatatgaacttaaaattcatacatttacttcattttttagcttgacattctagtaaatcttttgctccatttatttttggttatgatagcagaagatctacctggatgatttaagagcatcatttgtcaatgagcacctcttattttctctttattggcagtagtgcttacagctactattaatgctgctttccattttgtcgtttcgggttcaaacatacctctgtaatagccaccactgaaggcagattttggtagactttgaaaaatttgttttgttgttgttgttgttgttgttgtttgttttggggtttttttgttttgttttgttttgttttgttttgttagagacggagtcttgctctgttgcccaggctggagtgcgatagcgcaatctcggctcaccgcaacctctgcctcctgggttcaagtgtttctcctgcctcagactcccaagtagctgggactacaggcgtatgccaccacacccagctaattttttgtatttttagtacagacgagttttactgtgttagccagggtggtctcgatctcctgacctcatgatacgcccaccttggcctcccaaagtgctggaattacaggcatgagccaccacgcctggccgaaaaatttgttttacttgaggttccacatgccttatataagggttgcaaaacataacagcctgcaaatcctgcagcagcaatggtcagtccgactgctaccactgtactggccatggctgggctcccctactgcaccaggagcatggctcatcccagcccagaggttgcggccaacaatgacacacctttaccagagagtgacacaggcaccgatggcaagcacaatacactggattataatttttttaaacaagaggattatttgaaaaacagtctaggtgcggtggctcacgcctgtaatcccagcactttgggaggccaaggcaggcagatcacttgagcccaggaattctagaccagcctgggcatggtggcatgtgcctgtagtcccagctactcaagaggatcacctgagcccagggtaatcgaggctgcagtgagctgtgctcacaccactgcactccagcctgggtgacagagtgagaccctgtctcaaaaaagaaagaaaaacacagtttatgttgttgttgtatatcgagtcttaaatcaatgcttcctctggcagaacaaatcagaagttggttatacagtatcaactggccaagtgtctttattatttacagcatctacattagtttttaaaaccatcacattttcaatatataaatgggcaaaaagatgtttagatgggttagtaaacaatggagaaatattttaatttactagatactaagaggtagaaattaaaatttttaaaattttatgcctatataacaaaaaatagaaaatgttgatagtatgatagatagtgaaattgacactggcatatttacacatttaaaaagccacacgtgggtcgctggggaacccaggctgtcctaggaagccgagtgggagtggcacagagctgctggagatcctgagaacctgagttttggcaagcagccagaatacttaaaaaatgaccacaccaaacaaggcacctcctggtactgaccctgagcagttggaaaagactggaacagtacgggaaattgggtcacaagctgtttggtcactctcatcttgcaaaccaggatttggagtggatcagttacgagatgacaatctagaaacttattggcaatcagatggctcccagcctcatttagtgaacatccaattcagaagaaaaacaacagttaagacattatatatttatgcagactacaaatctgatgaaagctatactccaagcaagatttcagccaaagtaggaaataattttcacaaccttcaagaaattcggcaacttgaattggtggaaccaagtggctggattcatattcccttaactgataatcataggaagccaacttggacgttaatgatacagattgctgttctagccagtcatcaaaatggaaaagacacccacccatatgagacaaattaaaatatacacactggtagaagagagcgccattggtaaatttcctagatgtacaactatagatttcatgatgtattgttcaataaggtgactttaaaatgatatggaagtcattaaacgtatctttgttttatcctgtctttaaatagtatatcagttacctttattgaaaaaaacatcagttatttgcaactttatatatatttaaaaatattttattgtaattttgataaatttgggtcatattatctttaacatgtaataaagctcacatattttacattactaaaaaaaaaaaaaaaaagccatatgtgtggctgggcgtggtggctcacacctgtaaatcctagcactctgggaggccgaggcaggcagatcgcttgagcccaggagttcaagagcagtgtgggcaacatggcaagacctcatctctgccaaacaaaaggggacgtatgttccaattttttgagctaatgattccttttttgagtaaataattcttaaaacaagtgcagtaaacaaaaagatgtgtattttagtgttactaaatagcaaatacatttaaagtaatttgtgtccaaaattggataatgggccaggtgtggtggctcattcctgtaatcccagccctttgggaggccaaggtgagaggatcacttgagctcaggagttcgagaccagcccaggtaacgcagtgagacctcatctctactaaaaattaaaaaatggcgggatgtggtggtacatgcctgtagtcctagctacttgggaggctgaggtggaaggattccttgagcttaggagttcgagaccagcctgggcaacataatatctctgctaaaaattaaaaaatagctggatatggtagggcatgtctgtagtcccagctacttgggaggctgagttgggaggatcacttgaacccaggaggtcgaggctgcagtgagccatgattgtgccagtacacttcagcctgggtgataaacgagaccatgtctcaaaaaaaaaaaaaaaaggttaatggtaagttaagtacaatacatatatttgcttcagccattaaaaattattacaaggcagtgtagaaaatgcttatgatgacatatgaatagaacagaatgcaagcttatgctttgtttacaattaaattattcttgggcataaaaacagatatgtctgaaggaaacatatttttaaaaagtaattttagagccaggcacggtgggtcatgcctgtaatcccagcactatgggaggctgaggcgggcggatcaccagaggtcgggagttcaagaccagcctgaccgacctatggagaaaccctgactctactaaaaatacaaaattagccgggcatggtggcacatgcctgtagtcccggctactcagggggctgaggcaggagaatcgcttgaacctgggaggcggcggttgcggtgagccgagatcgcaccattgcactccagcctgggcaacaagagcaaaaccatctcaaaaaaaaaaaaaaaaaagtaattttaggctggatgcagtggctcatgcctgtaatcccagcactttgggaggccgaggcaggtgaatcacctgaggtcaggagttcaagactagcttgggcaacgtggcaaaactccatctttattaaaaatactaaaattagctgggtattgcggcgcgtacctgtagtctcagttacttgggaggtcgcagtgagccgagattgcatcactgcactctagtctgggtaacagagagagactctgactcaaaaaaaattttttttaattcattgagtctgagctattatgcttatttcttttcttttcttttatttgctgtactttacttttcttttcttttcttttcttttcttttcttttctctctttctttctttccttccttccttccttcctggcttccttctttcctttctttctttctgtctttctttctttctctctctctctctctctctttctttcttttctttctttcagatggagtctcgctctgtcttccaggctggagtgcaacggcgcgatctcagctcactgcagtctccacctcctgggttcaagtgattctcctgcctcagcctcccaagtagctgagataacaggcgtgtgccaccaccacgcctagctaatttttgtatttttagtagagacggggtttcaccatgttggtcaggctggtcttgaactcctgaccttgtgatctgtccacatcagcctcccaaagcgctgggattacaggcatgagccaccatgcccggctcttttttttttctttttcttttttgagacagttttgctcttgtcgctcaggctggagtgcagtggcacaacctcagctcactgcaacctctgcttcccttcccaggtttaagcaattttccttgcctcagcctctcaagtagctgggattacaggcatgtgccaccacgctcagcagatttgtatatttttagtagagatggggtttcaccatgttggctgggctggtacagcctcagttggatataatattgaaagtctgaattagagatctcttttaaccctttctgtaatggacacttaaaatgactctgataattattattgttttctattaataacagtgaagtttaaacaggtgtttagacagaggcaagggtctggatttgtttgaactgctttagatcttatgatactgatttttgctatgtgctaataagtggagggataaagtactcctgcatttgacaatttttataagttgttactttcactggtctttgtgaacagctggacactggtcagttctatgcactctcctctcctgtttttattattctcacatcacagttatttttgtcataattatagggctttttgaagacctgggacatcattttttgcattttctaatttggaaagaaataagtgagcatttgatgatttgaattttcaagaattgcaaaggaataagtgttattcacactgtaagagggtataaataggcacaaagtggtactttgaatataaagcatgttcacagatttagcaataggatttgttatgtggaaagcctgtagtgggaaattttaaaaggaaaggaaagggaaataagaaaggtaccaacatacatttagaacctattatatgctacattttatacatataatttcatttaatcttcataaaagccatatgaaggaaatactgtattagcatttctattttacatgtgagaaaaactaagacctagagagtttaaattattcccataaggtcatctgactagagaataatcaagttgaaataggaacacagaagtgccacatttaaaaaaattacatataaacacacaaatggaaccttttaaccagtacttagctggaacatcgtatagaatatatattataaattaccttactttgtctctttatgcttaggcaggtcatacggatcctgccatatgatgtcagctgtaaccattaggcataaaaatcttgaggtcattcttataaacagattaaaatgtgttgttgcaaaagttgaatggctctagattattttctgaatttggatatgaatcatatagtccttccccaaaaagtttacattaatgtttgtttctccattcatacatttatgtatttatgtatttatttattttttgagacggggtttcgctcttgtctcccaggctggaatgcggtggcgcgatctctgctcactgcaacctccacctcttgggttctcctgcctcagcctcctgagtagctgggattataggcgcctgccaccactcctggctaatttttgtatttttagtagagatagggtttcaccatatttcaccaggctggtctcaaactcctgacctcaggtgatccacctgccttggcctcccaaagtgctgggattacacacatgagccactgcacctagtcccagtcatacatttatttatgcaataactttacttttcaaggaagcaataagcaaatatttactgagtactatgtttcagacacaatattgaagataccagtattaaaaataatttagctcattattccatggagtttacattctagtgtggggaaatggagaataagttcaatcagtgcagtagattgtgttgtgataaagatatatggcatatggtaagatatttcagcagtataatttaagttcaggtgtgcaaatatgtaattttcttaatttttagaactgactttacttttttactctaagcctgtagcttagagaactggggaaggtacttagatggtatatggaatatagtggggtatttttagttgtcagaatgactgaggttgctactggcatttagcaacctgtgcataccaagactgctaaacatcttgctatgcccaggacagtactgtcctatgaagaactggcccacctaaaatgccaagagtgcccctgttgagaagcactgactaacctggctcatggtagacaatttcatcttgatctttttaggcaaaattgactattatccagtaatttcaaattcaggattatttaaactatcccaaacctggctcaaatctcttagattctgcccatctcctctgtgatactaattcttatgacctatgaatctcactacgtcatagtctggcgttgaagagtcatctacttttctagctaactcctgtgctttcctctaatctcattggaaacgtaaaggatctctctatactgttcttcggcctgtgggatattgagaaagatgggtattcttgggttcttctgtgtttactccatttgctgctcccttgcttgcttttttttttttaagatactttgttttttattcaaaaatcattatttgagattattgtcccaaagcctaactcactacttctgaatgttcccaactatattagtttgctacagttagcaaaataccacaaattgggcagcttaagcagaaatttattatctcacagttattagaagtctgaaattaaggtgatagcagggttggttcctcctgggggctgtacggaaaagatctcttccatgtctctctccttggtttgtagatcgacatcttcatgttcatatggtggtgttcttgtatgtatacctgtgtccatatttgcctcttttataagggtatcagtcatgttggattaggagactaccctaatcacttcattttgattacctctgtagagaccctatcttcaaataaggtcacattctaaggtgttaggagttaagacttcagcttaagtatttgtgggggatacagttcaacccataaaagcaactaatttttttaaatttttttctaatttaaaaagtacagaaaaaactaatcaaaataaaataaaaatatcccaatacaacatttaaaaaattatataaagtaaaaggagagaaaagatagccagctgtggtggctcatgcctgtaatcccagcactttgggaggcccaggcgggcagatcacttgaggtcagaagttcgagaccagcctggccaacatggcgaaaccctgtctctactaaaaaaaaaaaaaaaaaaaaaaatcgctgggcatggtggtgcacacctgtaatcccagctgttcaggaggctgaagcaccagaatcgcttgaacctgggaggaagaggttgcagtgagctgaaatggtgccactgcactccagcctgggcgacacagcaagactgtgtctaaaaataaaaaagaaaaaggccctacttccattccaatctcatcctccaacttgactatatttttcttttccatgtcaatcggtacatacagaactatttcattctttttatgggaacgggattccattttatgggtatactgcagtttaattagctgttacactactgatgaacacttgggttgtttacaacttttattataaacaatatggagataattcttgtgtagatctctttgcacatgtggatgttttcagtagtgtaaaattttaaaactgtgtgctgagtcatactgaataaacacttccaattttaaaagatattgtcaaattaacctaccagcgtatattactaccagcagaatctaagagctataccctcaccaccgttagatattatcagtgtttaaaaaaaaaatctttgctagtctcatagtaaaaacatactataaaactcattgttttattttgtcatgtgtggtatttactatatctgttggccattttatttattttttctgtgtatttaccaatgtgagttctttgccttatttccttggaggtatttgttggttattgaagctcatgtttttatcataaattaatttttttgtaataattgtagtagctcattaaggtttcccaaatccattcttattctcttccttttttttctccctacactgtgcccatacagatctgatcatgtctttctctttgattaaaatgcttaagtgggggctgggcacggtagttcacatctgtaatcccagcactttgggaggctgagccgggcagatcacctgaggtcaggagttcaagaccagcctgaccaacctggtgaaaccccatctctactaaaaatacaaaaattagctgggcatggtggcacacacctgtaatcccagctacttgggaggctgaggcaggagaatggcttgaaccctagaggcggaggttgcaatgagctgagatcacaccattgcactccagcctgggcgacagagcaagactctagctcaaagaaaaaaaaatgcttaagggctttcccattgctctattaaaaaggtcaaaacagatcctacagagcctttgcttggtctggcctcagcatattccatgcatcccttaactcttggggcctcaagccatattaactttttttagttatttggtgggtccatgcttcttcccctaataggaactgtgtacatactatttcctctactattactgtctcttcttggcacctctttgttcacagaaaactcttacccatccttcagatttgatgtcttgtcatttcctaaatcttccctgaccttgccaatctaggctagagcctagattacatgatcttatttcaccatttaccacttttgaaacacgtgatttatattcacttgtatggtttttctttttctttctttcttttttttttttttttttgagacagggttttgctgtgttacccagacaggagtgcagtggccattcacaggtgcagtcatagtgtagtgtgtcttcaaactcctggcttcaagccatcttcctgcctcagcctcccatgtagctgggacaataggtgtactcctctatgcccagccttgtgttattatttgattttaggttataacctgaaacccttgcactaaattgcattgcatgaaggcaaggaccatgtccgttttgttttctgccacatccccattgggtagcttggtgcccagtacatagtaagagttcatatatttgtggaataaatgagtgaatgatggattcttggttttgtctctttattagaaaggttattgaaggattttaagaaatttaacattattagatttattttttagaaagttcagtctttgtttggaagattaattggaaaggcagatgtgaagattaggagaacagttaggttatcatcatgatcgtttagtcctcagataataacagcctgaacagaggcagcaatgttagagataggagaagatgtgattttggaagaacaatttcagaggaaaactaacaggacttaatgactgactggatgtggtcatggcgagggagaaggaaaagtcaagactcaaaatttaaatgaaatatgtaatttagtatgaagtagtattacagagtagttaactatagagccattgcagtcatacagattaatcatgtaatttactagctgtatgaccctggtaattttacttaatgtcttagtccattcgggctgctataacaaaataccatagactagatggcttataaataacagagatttgttacagtctggagcctggtaagtccaagatcaaggcaacggtagatttggtatctggcgagggcctgcttacttatagacagctgtgttctcactctaacttcacagggcagaagggtgaggagtctccctcaggcttcttttatagggcactaatcccatatgccccactacctaataccatctcttttggggttaagatttcaacataggagttttggaacattcatctgtttacctaactgctaattgtaaatgagtgtcttcatggaatttttgaggttaaatgtaacacatgtaaagtgcctagtagtcatatagtttgctgtgaacttgaggaagtcatttaaccatctaaactcagtttcttctgatagaaaataaggataatatgtataccctttgttctccctgtatcacagggatatctccctatatcacatttaagaatgtcaagccctataaaaattgtaaactgataacagtcatagtaactagatattaattatacatagaaggatgggagatatcgagcttaacttagactttaatatgacccctcatctcttggttcaactttgtaaagtataggatgcttcttggctgtaaaaactgaagaagtagaatttatcctactgggaacaggcttttgccactgtaaggctctatgtggtaaatgactgatgagttctcaagaaaataaatctggccgggtgtggtggctcacgcctgtaatcccagcactttgggaggccgaggtgggtggatcacttgagttcaggagtttgagactagcctggccaacatggtgaaaccccgtctcttctaataatacaaaaaaaaattagccaggcgtggtggcttacacctgaagtcccagctactcaggaggctcaggcagaagaatcacttgaacccaggaggtggaggttgcagcagtgaaccaagatcgcaccactgcactccagcctgggccacagagtcaaattgtgtctcaaaaaaaaaaaaaaaaaaagaaaagaaatcttaacaggaacaaaggagattgttgttgcctggtgtagaggggagaaggaagtgagattaccaggaaccaagcccagaaggtggaaattggcatggcagattttgattgcctgctgtgatttcctgtagctaaagcagtgcgtttgtttatgattgagttgtatatattgacccttggccttcatagcaaaaacagtgaaaacagctggtatagttattattccacatataaggatagtaacaaacagaagttaaaacacagaaattccaatctttgtttatttcatcctgctataattcctttccaaacggaaatagcacatgtaactatctttcaacacccatgttaggtgattgtgtgcatagaaatcttgcctaggggtaattcaggtggttttttccccactgctgtatatttgccacgtgatcttagttaagatttttattttcagccaatgtttcccatttctttattgttgacagacttgtaatctcactcttgcttttgaattacccaacttcctgaactacattttctttgaaactttagtattgtagtttaataaggttcactgacaatcagtgtttgtcaatattggttcactctctttgcatggcaatcccaagtaaattttgtgtgttcttccccccccccccccacaggttttctgtgcttcctgctgtagcctgaaatgtaaactgttatacatggacagaaaggaagctagagtgtgtgtaatctgccattcagtgctaatgaatggtaagtattaaaacaggttgatttcatagttattgagacaaaacaagggaattacgatgagaagacttttttccccctgcctttctttacaagttgctcaccttctcaaatgtcataactttaactgaaaatatttagctaaatttccatgttttgaaagtatcttagcatttcagaattcctgtgcctaatttaatgaataaatgctaaagccaggtaagttttgcaggaataatggaagttctttggaaatctggtgcgaggtagttatttgtgttcctataaaataaccagagtgaggtgggaatggggagcttttgatcaccagatgataagatgttaaaactgggctgagattttccttttaagagaagccatctctttctaaggaacaacttaataacttagcatgtgttcttatcaacaccttgtttcattcatcttgttgaagataactattttagcatctaggaccaagtagaaaattgcatttttaaagcccatttatctctttaatgctacttagatttgctatgagaataatggtttagaatctagttgttacgtggtaaaaagaatatggccggggaaagtaaataaaacttacccagtgttcatcttttgctggactggaaatgattttaagggcatattagttaaaaaccctgagtattcttgtaaaaagatacactaaaattgttcaggttatagtattttctctttgaatgcatctttgtacagttactggaacaattactaatagacataaaatgttgaacttgaacaccagtgctacctgtgccaggatagtgtgcctcctggaggctggaacttatctgctctgagacccctcctgctctgtccgtctgcattgctgatagtgatgttttcttgttgctggcttattaacctgttgcatgacagttaatctgatctgttctaatttcctatgatccacccagtttcctcccatttctgaattcttacaattttgaccaaatatgaatcattctctccactcttaagggttactttttaaatagtggttatttcacttggttgctcaattgatgatttttattctgctgctttcattttcgggcacatattcacagataagagcatgctgcttaattatagtacctaatacctcttttatttgatgagatcttccaacttgatagctaatttttttaacttggcatagctaaagatgaaggaaatggcagaggattcacatggaatacttactttttattaagccaaggaggcccttaacaggggatcctaaggtaatccacttttcctggtttttccagtgtctttcctctcgcatggcttagcccggtctttttcttaatatttaatttgatgcttttcggtgttccctatccctttttccctttctccttttctcttcctcccctctttctgccagtgctttcaaaggaacatagcttttgttactagccttgtcttgcagtttggaggcaataaatattcaaaatcctatggatcattctttgatgttgaaagagatttttgaaaggatgcttaaaaagagggtggcttctatttctgggcatgtggtattacctgaacctagaagataaaatttggtatctttcatttctgtagcacctttcatcctatttgctttaaaggcgataggtgatgtgtcagtatttagtgaaattatagggtacacagaatcttaatgtatttgtgatcatttatattggttgatcacacttacatgatattggcacattttcatgttcaaataggtcctgtgcttttgagacacaccaaagatgtgaaatggttgttactgatggatagttttatacagggtgatgattacataaaagcagaattcagaaaaagattgagatgtgtcctcctgagctttaggctttagaaatttttaatgagattttattttaactaacaagagccttaaaagtttagaaatgaaacttaaaattttacagtagagttattctattttagcccctgattttgctttttgatagaactttataaaatgcattaaatattaaatgaaaaaatgtctaaatgctatccaagtttcaaattcttaaagtttgatgttgtttgactccctcttaaggaaatgtttggtctcctataaagaaaccaggctccaacctttaactcagattgatctgctatcagtctatcagaagtatcctataattcttttttatttttaatttttttgagatggagtcttgctctgttgcccaggctggagtgcagtggtgtgacttggctcactgcaagctccacctcccgggttcatgccattctcctgcctcagcctcccaagtagctgggactacaggtgcctgccaccacacctggctaattttttgtatttttagtagagacggggtttcaccacgttagccaggatggtcttgatttcctgacctcgtgatccacccgcctcggcctcccaaagtgccgggattagaagcatgagccaccactcccggtctaattctttaaaaaaaaaaaaaaaaaaaaaaaaaaaatcatgttactcttatttgctccaaccaaatagtttacttggctaaatggtctcctttattacataaaatcacctatctctttaataccttcactaggtggaagagagacatactatgagtattaattaggagaagctgcattatttatccaatattgtggaggtcttgatgtccatattttgcaatccattcacattgattgtgtctgtatttgctttagctcaagcctgggagaacatgatgagtgcctcaagccagagccctaaccctaacaatcctgctgaatactgttctactatccctcccttgcagcaagctcaggcctcaggagctctgagctctccacctcccactgtgatggtacctgtgggagttttaaagcaccctggagcagaaggtaggggatcatgtgctattctctctctttttcctcacgaagttcctctgaaaaggtgctgatatgactttacagcacaagtcttaaaaaacactgcagataagtctctttgggtggttattaaaatggaacaacaaggtgagaaatgtgtcaagactatttctgggcaagtagagaataatatttgtgttgcttggtattttagaggcacctcagaatatatgtcagtctcctctccaacttaagaatggagtaattacactgcttgtccttaaaaagaggtgcagaatttgaagtcaatctgtaaattcctagcctacctcatgcctgtcttaatgttctttgtaggagtttagtaagtgataaaaatgagagttcttctttccgaccagcccattcaagtattgctttttggagtatacattgccattttctcttttcatttttaatctgtccatataaaaatatgaacatttttgtgttagggacatagactttaaatctagaactttaattctgattatatcatatgataggtagaaaattacaggctcaacttacattggtttattatatctttatgatgataatattgtcagatgaaaggcactgtgtaagtgcaggggattatgaatagtaaaaataacatttatttccttaaaatgatcttatcaagtttcccttggtaattaaaatcagtcttccttcattaattttatcttttcatctattaatattcccttccccttgctaaataacccacctttccttttgaagatcatagacttctattgacattatcatactcttccccattttttctcttttcagatcatcccttagtcatactccttgtatttttatgaatttaggctttcttaaaatctttattctcttcatttgttgtttttgttgttcttccctagtctctgtgtgttttggctgtttgaattgatttctaaaactggacttaaagggatcatttcatcagactcagttttccagctttttccctgtctttttactaaaacacaaattacttttgcactgccagatcagtctttttcttcttcagttacacttcaggcaaagatctggtcagtttgcttcccaattcttacatatctgtgccagctcttctgttataaatgaattattctttaacattcttcagggcatcttttgccctttgaaagtaccatatcactttaccagatgtttaatttctttggaaacctcataactttagaaaatgtgaatgtctattgcttttttcaccatgctattaatttatttccgaggcccttgaacactttccttagtttctctgtcagtgatacgggacagagtatgtgacataatcatagatgtatttaagaactcttaatatttcaaagcaaagtattttactctttgcatataagttaaacaagtaaagaatatatttaaatttgtatttttaattcatttataaccacttttatatacagttacatttctgatgtttctgattgtaagttgccaagtaatgatttctttgtacatctggaattggtgaccttctcttctttgatgttagaaaaccttccaatgccacattgatgcctgttttatttttctggcccctcaagtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagaggtaagaaaacaaaacagcaactaaaattgcatagctactttactcagcattgtgctgcctctgttgaattacttttgtgtggaactctgtaggttttggatacaacttagtgtatacgtgcacatatatggataaagtaaatgtggcaaaaatcagctgctgttctttgctgtatatttagaagttttttcaggagaaaggttcttaatgaagattgttctcagatgagctcaggtgctccactttagctagcagtcgggctgtggggaattctgtccccttgctacattggtttttaaagcatgttccccaggttccatggcagcctctcaggagtgctatggtgaggaagagcaggtaacatgaaagggcctgaggagctgagtttaaaaccctggcttatcaacatcccctaccagagtggtacacttgttacacttgttgaacctacactgacacatcgtagccaacccaagtccacattttacattaggattggatacttttttttctttttttgagatagagtctctgttgcccgggctgcagtacagtggcgtgatcttggctcactgcaacctctacctcccaggttcaagcaattctcctgcctcagcctccaaagtaggtgggattacaggcgcctgccatcatgccaggctaatttttgtatttttagtagagacagggtttcaccatgttgcccaggctgcgtctcgaactcctgacctcaagtgatccaccccctcagcctcccaaagtgctaggattacaggtgtgagccaccacaccctatcaggattggataaaaattttactcctgatgttttcatagaattgttagttactaattatttatattaatgataagtaatatttttttagacatttacatcctatataatttgtgagtttgattgtaattgaaattgcatgttgttaagattagattttttgacatgcagagctgacttacctgtttggtgagttattgaaccatgtaatatctgtcttcaaatatttctagtttttgaatttttctgtggctgcagagggtgacagccagaactgtgtcttatccttctttgtatctccacagtgactttgtcaagaaagttttttctttattccccccaactgtttttttgtttgtttgttttggtttttttttttgagacaaggtctcactctatcgcccaggctccagtatagtgccgcagacatggctctctgcagccttaacgtcccaggctcaagcaatccttctgccacagcctcccaaatagctgggactgtaggcaagcctggccacaactgtttatttggaaaaaaattcaacctacagaaaagttacaagaatagtacagtgaatacccatatactcttcacctatcttcatcaacttaaccattttgccacatttgctctaccacttcacagtacacacgctttttttttatgacccatttaaggattggttgcacttcaccacttaatagttcagcttgtgtaccctaagaaaagtcattttcttatacaaccacaatgcaattatcacatgagatggaaacttaacatgtaattctggtttccccaattgtcacaataatgttctttatagctttaatttttttgttttgttttgttttgagatggagtcttgctctgtcgcccaggctggagtgcagtggtgcgatcctggctcactgcaagctccgcctcccgggttcacgccattctcctgcctcagtctcccgagtagctgggacaacaggcgcccgccaccatgcccagctaatttttatgtatttttagtagagatggggtttcacgatgttagccaggatggtctcgatctcctgacctcctgatctgccctccttggcctcccaaagtgctgggattacaggcgtaagccaccgcgcctggcctatagctttcatttttacatatatgtgtgtgcacagatatattaatttttaaaataaaatttatttttaaaaatcaagatctcattaaggaccacagttgcatttagttgtcatatttctttggtttgctttaatcttgaatagttctctctcttttttaaagtttttatatcattaatatttaagtatttgggccatgttttacatgatactctcaatttgtatttgtctgttttttttttttctcatgactagtttcagattaaacattttttggcagtaatgacaatcctacataagtgagggtgatttcttaaaggatcacatcaagaagtattagtttgggttgggtgcagtggctcacatctgtaatcccagcactttggaaggccaaggcaggaggattgcctgaaccccgagtttgagaccagcttgggcaacatagtcagactctgtctctatataaaattaaaaaattagctgggcatgatggcacatgcctgcagtcccagctactcaggaggctgaggcaggagggtgatgattttctctttctgttaaatttctttcctatctcttagtttgtatgatgggttcttaaactataaatatttttgaaagaatgaggaaagtctagtgagtgaatgttatagggaaacaattttctgctcattataagacaggctaagccacattattttgtgctctcacattgtgcaacactctaatatttatgtggtaaaatgagagaaagcaaactctttaatgccagactagaaaatattaatatttttcttatttttatggtctagtagagtgcctggcacttaacaagtgcccagtaaatgaagtaaatgtctttttattattattattatactttaagttctgggatacatgtgcagaacctgcaggtttgttacataggtatacatgtgcaatggtggtttgctgcacccatcaacccgtcatctagattttaagccccacagtaaatgccttttcacagaaggcatttaagtagagaccaactgaccactttttatgatattaaaaggaggatttttgcaccattcaatagtaggttagaatagattattttctgtaccaggccttcaagtcagttaatggtagtttgccagtaaaattttataaagttcctatatgatgccataccggaaaattttagaaatcccactaaaaatgtatagtcctaaaaactttgtcctaagtagagacagaagtatggcaaaacatgggcatatttattttattttattttattctttgtttgagtcagagttttgctcttgttgtccaggctggagtgcagtggcatgatctcagctcactgcaacctccgcctcctgggcttgagtgattctcctgcctcagcctcctgggtagctgggattacaggcgcccaccaccacacctggcaaattttgtatttttagtaagagacggtttcaccatgttggcaaggctggtcttgaactcttggcctcaggtgatctcccctccttggcctctcaaagtgctgggattacaggcatgagccaccatgtccagccatattttgaagaaatagttttaatgtttgttcaggtatacaatatatgtagcaaaatgcatgactaaggagcatgaatctttaggaaacaccttgaatttatacatggttttatatatatgtgcatgtgtgtatacacacacaaacacacacacataaaatatgtaagcaccattcaggtgaagatacagaacatctccagcactccataagggttccttatgcactttttctgtcagtaccttctcctttcatcaaggtaaccattgttctcacttctgtccctacagattagttttgcttattcttgaattcatataaatccaaacaatagtatataatgttttgtgtttagctttttaagctcaacttaatattatgagatttatccatatgcatcaaaaattaatttatttctgagtagtattccattgtatggatatgccatcatttatgttatgttctcctgttagtggccattcaaattgtttccagtttttggctattatgaatgaaatgaagctgctagaaataatcttttttttttttttttttttgagtctcgctctgttgcccagactggaatgcagtggcaggatctcggctcactgcaacctccaccttccaggttcaagcaattctcctgcctcggcctcccaagtggctgggattacaggcacacgcccagctaatttttatattttttgtagagatgggatttcaccatattggccaggctgatgttgaactcctgtccttaaacaatctgccttccttggccttccaaagtgctgggattacgggcgtgagccactgtacccggccgtatgaatattgttatacatgttaaaaacagcttttactgtttttcttttaactttttgttttgagacggagttttgttcttgttgcccaggcggagtgcaatggtgcgatcttagctcactgaaacctccgcctcctgggttcaagtgattctcctgcctcagcctccctagtagctgagattacaggcatgcgccaccacgcccaactaatttttgtattattagtagagatgggatttcaccatgttggccaggctggtctcaaactcctgacctcaggtgatccacccacctcagactcccaaagtgctgggattacaggcgtgagccaccgcacctggcctcttttaactctttaaaagcttctatttcatgtttaagttatagagaatatacatctgtatagtatgggaaataaaagttatagagaatgtagagaggagagcatcattttaataaacatttgagcatgttctatttaataattaagtggatttaacgccaaccaacatgttttgcaaccttatacttcattaaatatagctaatgtgatctgcctagtaatgcaaagaaaaacaaacttcaggccgggtgcagtggctcacacctgtaatcctagcactttgggaggccgaggttggcggatcacaaggtcaggagattgagaccatcctggctaacaggtgaaaccccatctctactaaaaatacaaaaattagccaggcgtggtggcacgcacctgtaatcccagctactcgggaggctgaggcaggagaattgcttgaacctgggaagcagaggttgtagatgatgccattgcactccagcctgggcgatagagtgagactccttctcaaaaaaaaaaaaaaaaaaaatgaacttcaagatttattttattacatagtaaatgaaaaatgatgacattttatcaaagttgatttttttcccttttttattgtggaaaaatattaacatatataacaaatgatttacaattttaacaatttttaagtgaattcattggcatcaagtacattcacattgttttgcaactatcaccactgttttcaaagttaatttttaaaagcaatataaattagaccttaagtagttcccaaggtattaaagattaagaaattatgaaataatattgaagttttgtttcttttgccactacagttttttaaaaatatttttctcttatggcaaaagaaacctgggtaaaggaagctttaatgcaggttttaaggcctcttctgtcattaccatgatttgatgataccaaaaggagaaacttacacatttgaaaacattttcatagtataagcctgatttgtttttttgttttttttaatccatgggttaatgaatattttgtgctacctttcaaaaagtatgaatttcagattttcacttaagttcccatttgtatttttaattatgtcctgccaaagtcttgaattctctgtagtgctcactttgttgatttgcttttcctagacggatatttgtctattctctgggagtataactcaggttggaagtcctgttggaagtgcaatgaatcttattcctgaagatggccttcctcccattctcatctccactggtgtaaaaggaggtaagtggactacatatttaaacagtgatagttctatctgccaaatgttaccttctaattaaggtagagagacagaatttgagtgacattcacctttctcttatccaacaaaacaaactcccccaaaactatgaaaatggttgttgctgttattattttagagtagatgcttatgtttttatattataatgtcattttcagtttttgaatggatataatattacttataatgtaaatgtagtttattagcagtttttaaaaatatttcaaagcacataatattctgaaggattgcttgtggtttaggatgaacccactctgatacagtcatttatttagcttttcattttgaggtataatatacattcagaaagaacgtatagtaagtgtgaagagcactgaatttaaatggcagttttactgttaaaaatatttttagggatcttgataagaagtaaaattattatctaatcaaaagaatgcttaatattatgtgaaattttatttttataattttaacttttattttagattcaaagggtatatgtgccaatctggtacatggatatagtggataatgctgaggtttgggttatgattgatcctgtcacccaggtagtgagcatagtacccaatgggtaatttttttttgtttttgtttttgttttttgttttgagacagggtctctttatccagtcagccactgatgggcagttaggttgattctatgtctttgttattgtgaatagtgctgcggtgaacattcaagtacatgtgtctttttggtagaacaatttattttcttttggatatacacccagtaatgggattgctgggctgaatggtagttctcctttaagttctttgagaaatctccaaactgctttccacagtggctgaactaatttacatttctatcaacagtgtatacatgtccccttttctccacagcctcaccagcatccatggttttttgactttttaataatagccattctgactggtgtgagttgatatctcattgtggttttgatttgcatttctctgatgattagtgtgaaattttattgctgacatatatggatcagtatacaattactacatttttagaaggtggcttattaattaacctctcctgaactttgtcctaggcttttaactggtctccttgccttcagtctttctttccttcattttgtcttccacactgttgccagttatgtttttaaacatagatattatcttatattgcttttacttagaaatatttaatggattcccaatgtctttagtgtaaattacttaccttagcaagcaatttttttttttttttttttttttgagatggagtctcactctgtcgccaggctggagtgcagtggtacagcctcagctcaccacaacctccgcctcccgggttcaagcagttctcctgcctcagtctcctgagtagctgggactacaggtgcatgccaccatgcccggctaattgttgtatttttagtagagacagggtttcactatgttgaccaggctggtcttgaactcttgacctggtgatttgcccacctcggcctcccaaagtgctgggattacaggcgtgagctaccatgcccggtctgacaatgtttcttataaccttatctcagcctgtctttctagccatttattatcaactttatttccagctattccccagcaccttacatgtatactgcagattatttgctattttttgaatatttacttttcattcttctgtactttttcttgtgctgtggaataatgggaaagaatggacttcagaattgaacaaacctgacttttaatgccagtaccgttccattctagctgtgtgatccagttggcaagtcattcatcctctctgaatttgtttcctagtctgttttatttaaaacaattatataactacacctacttaaaagtcattgtggttattaagttagatatcatacctgtaagtacataccaagaaagtatctggcataaagtaggcatgtaattaatattttccatttcttcctttcttctgcctagaatacccctctctactgtagacttcctgaagaactcctcaaccttttaaaatccagcttaatggttaattcttctctgaatccttacctgggctgcttagaaaatagtgatttgcttcattatctctgttctaatagtggttcctatagactgttggctacattaacactttttctcattgcaatttagatattatattttcagatcgtattctttcacttagactatgaaattcttcatcttattttatacttgcatttactgctccttgcatggtgctaggcctgtagtaggctctcagcaaatgctgtctatattgtactctcaaatgcagctatgtcccagatagttcagcagtgaactttcacatacagttaagcattcttttgactgcataatgcttttgcttctttaccaggaccctgtaaaaatatctactgttagtaaaattgctgcttagggttcagatttttattttaataaatcttagattaataaggaactaaattggcctactctgttgttaaaaagagtcagattgttggattctattgttagtaaaatacctattgttagtaaaattatctattgtaaaaatatctattgttagtaaaattgctgcttagggttcagatttttattttaataaatcttagattaacagggaactaaattggcctactctgttgttaaaaagagtcagattgttggattccattttcataaaaagttatgtccgttaaatctaattgtcaaaacttctcctaccaagaaagaacagtgaattatctatattacttaaactatattacagtctcttcatcaaaattttgtaattttttattccagtgggatgactttacttaaaaaattttaaactcaggatttctctttccaataaatatttttaataatggagtagatatttcccattgtatccaaaaaatccattttaaaatttccattagaaaatgggaaatgatgttactttgttctacctgactgtccctcaaatatgcattttatataagaccaaccaagcaacattcaacttttaggttttcagttcctttcccatatctctaggttctacagtgattattacgcatgatttgacttcaagctgaaaggaccactgtcattcaaaatgagatgctgaagcacatactgtgcttccagagattaaatgagaagagttacattcagtattaacttgttcatgttcagaatcttatgtgtgatttactgatgattttagtgacatatgtactaaactcttaaattatacttaaaggaattgttttatgaagccagtcacacacaatacttttattttctgggttcattttttaaagtttaagtttttaattgtcaaaaatgtcaaacagtacaaaaggtcatagagtaaaaggtagggctctcttctaccccaactatttgatatcctttccagaggtaactagtatattatcactttcttgtatatcatgagttattttaaatgctggtcttgaacatttattatgtgaaattcttgttataatagttggaaaatttttattaaatagaaaggtagtctttagattgtggcacaaaccactgtggggagaggtctatacacaggataaccacattatcatctaaggtggactgggtcacttttgagagtaaaagagggcactattaatttgatactgagccagcagatacaaaccatgctctgtatgcacctattgataaatcaaatgcatgtctcttttctgtgaataattagctcatttctccatctgatctctttcttgatttgttcctttaaccaatctattacattgttttctcccctttcagactatgctgtggaagagaaaccatcacagatttcagtaatgcagcagttggaggatggtggccctgacccacttgtatttgttttaaatgcaaatttgttgtcaatggttaaaattgtaaattgtaagttataaatttttaaaaattaaaatcagatgttttactgactcatagtacataaaactttcagatttattacacacaagtatttttatatagagccacatctttttttttttctttttttttttttgagacagaatctcgctgtgtcacccaggctggagtgcagtggcaccatctcggctcactgcaagctccacctcccgggttcacgccattctcctgcctcagcctcctgcctgagcagctgggacaacaggtgcccgccaccacgcccggctaatttttcgtatttgttttttttttagtagagacagggtttcactgtgttagccaggatggtcttgatctcctgacctggtgatccgcccgcctcagcctccctaagtgctgggattacaggcatgagccaccgcgcctggcctagccacatcttactgaacactgagttctgaaaaagttggtttttataaaatgatatatcccagaggacagctgtggaactaaccgaaactctcacatttagttacaggggtgaggtaggtgaattctccatggatgaaagccaaacaaatcttgaacttatctgagttaagttcttcttgagatgagtatgttaaatcacaacttaccaccagaataactggtggtagataaattatacaggctactcaaataatttacatgctgtgttttaatcccagaaacctcaattatggtgcaaaactttatttaggaaaagtgttaactaacacacagtaaagcttcaatacatcataaattgagattcagaagaaacttctcaattgttggtgctagcatcatgggcatcaggatgagaaagacgacagtatttgagaattttttgagacagagtctcactctgtcacccaggctggattgcagtggcatgatctctgttcattgcaacctctgcctcctgagctcaagcagttctcccacgtcagcctcccaagtagctgagactacaggtgcacaccaccatacctggctaattttttttgtatttttttgtagagacaggagtctcaccatgttgcccaggttgttcttgaactcctgaactcgagtgatctgcctgccttggtctcccaaagtgctgggattacagatgtgagccactgcgccagctagtaattttgagaattatttagagaatgcatttattctgaatgagtgttaataggcaattttaaaggacagaacctctggggaaccatcctgcagttctccatgtgtacttaagttgattttggaaaccagaaacatatactacttccttagaagttctacattgatgaaatgtgggtttctggcttacttgctaatcacactcttgtatgtttggccagttattaatgcttgctaccttctaggatcagatttaaaatgaatttgcttgaaatttcaatttgccatatctagtttataaattatgcttagaaattagctaacctaagaccaggcaccatggtgcacacctgtagtcccagtgctttgggaggccaaggcagatgaatcacttgagcccaggagttcgagactagcctgggcaacatggtgaaacctcatccctaccaaaaaaaaaaaaaaaaaaaattgggcatggtgacatgctcctgtagtcccagctactctcgaggctgaggtgggaggagttcttgagcccaggagacggaggttgcagtgagccgagatcatgacactgcactccagcctgaatgacagagtgagaccctgtttaaaaaaaaaaaaaaaattagctaacctagattcttgaagtatataccatcatgaggaatgtcctatttaggtacataaagcaaggattcccaaagtgaaataaagatgtctttgtttttttgattaacatttgttttgatttacatggtggtattcataattttatttgagtcctttttcagttcctttggggatcccattgtgttggggtatgaagagtaaaagtgtcaaggattaaacattgtttttgactacatatggtttctgctgttcatactctccatatagccttaaagtgaaggagtggaactaagtagttcagaaaagccatccttttcactaatttttacagcatgaagccaagtaaagtcatgttgctgattatctagaattttttcctggaaaggactatagttaaaatagctggaatctcttggtcatatattaaatttaataaatatacataaaaatatatttcctttaggtcacaacctgaagataaagctatattattggcttttgttgtaattacttctagccttacattggtaattacttccttcgatgatgtgattttttaaaatataaaggtggaggactatgttcttcaatcacgtttggcttacaatacatagtttggttttattttagtattaatagaatgttgcttcttttaataggagttaaaagttttaagtgcgttttattattatttcttttacttccatttcaatcatttttcttttcttttcttttctttttttttttttttgagacggagtctcactctttcgcctaggctggagtgcagtggctcgatctcggctcactgcaagctccacctcccgggttcacgccattctcctgcctcagcctcccgagtagctgggactacaggcgcccgccactgcacccagctaatttttttgtatttttagtagagacggggtttcaccgtgttagccaggatggtcttgatctcctgacctcatgatccacccgcctcggcctcccaaagtgctgggattacaggcgtgagccacctcggccgtcctcaatcatttttccaagtgtttagaaaagagccagaggcattggcatgttttattttctacaataggtttttggctcaatgcagtgacagttcacagttgaattatacagactcagtgtgatctattttaatctttgctgtattgtaacacagatttctgtgcatctttttttaagagtaaggattgataggaatgtctttatttttgtgtttttattccatctgtagatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcaggtaggaatgctttatgacttagtctgctccctttgtagatgacaaaaaaattttgaattcaaatacaaaataatagtcttaactttggacttaagcatggcaggggactttgatattagtggcaagttgaagctttccatggtttgaagaaattataaattttagtattgtacctggtatagtttttattttacagaggctggaatcaaagctgtaagagaatctggtgacctaaatgtaagaatattttctttttagtggcctggggtcaggatattggtacctggtagaaggaagcatatttgtaacttacttcttgtttctttggttaacaatatttatttaatcatagtgtaaatgctaatgaatattcaaatttcaaaaacaattagcatacatgactatggcttcaaaataaattgtaaatattaactgtaacaacttaaaagtaaaagcatagaggttagaagctgggaaagactaaggatattaacataaaaagaaactaagattgagagaaaagaaacacattatttgacattatagttatttattatgacattgtgttatttgacattacaaagtcagcctccctttgatttaacaaatgaggtagaaaaacggtgtaattgaactattctcgtttattgtaacaggaagtcagtacataatatctgtatttgataaatagggtttatctttgaggaagaaggcctggagagggtgtgagggtgaccggggtattaaaactattttcatgtattatttgataatatttcatacatatattaaaacaataaattattcagactttcttaatgcaataattttcattgtgggattctgtgccaaagacagtatccagaatataaaatgcacttctgtgaatgaaagggtttattgcaacattacctaaatttaacacaaaaattcagaagcaacctgaatgccttagctataggtggaaagtttaactgtgttatacttattagatgtgaggatctttttgagaactttttttggccattaaaacaatatttatgaaaagaatgtagtaacatggaaaatgctctttaaataattacagaagcaggatatataattgtatttttaatgtgatgtagattatgcgtaaaagattgtgcctttatgtcttcattagtctctacaataatttaggtgtagcattacataagggcaaggtgatacattggaaactgaccacatgatacctgtgaagtaccttttaatgtttaccctgtctgttccaaaatgtatagggttaaatctgaaatcatccaggtcctccaggccacataataccctggagctgaatttagtcctggaaataactgggaactttcacttttctcctcaatctgaatgtattcacttttaaacactctagaaaaatggcattggaggttcaagtaattgtagattcatgtgggttttgagagtgtgttagagactagggtatgggaggttcatgaatgtcttatttaggagcccatgctttattctgtaggcaatgaagaaccattgaaagtatttgagatgatgagtgacataatcagatttgcattttagaaagatgactctggaagcagtgtgaaaaatggatcaaagtccgtgagtctggtggcagttaagaagcaatttcaggataagcaaatgtatattcatacactagaatactgctcaacagtaaaaatgaactaactgctgatgtacacaacaacatgcatgaatctcacagacattatgctgagcaaaagccaggcacaaaaaagtacatattggatgattccatttatatggttttctaaaacaggcaaaattaatctttggtgatagaaattaggtcagtgtttgcctaaagtgaggtgggggtgcaggtgctagaactgactacagagagtcccagaaaactttctgagatgagaggtctatatctggattaggatagtggttatgtgggtgtttgccaaaactcattgaaatgtacacttaaaatctatcatttttataatatatagattatacctcagtaaaatttattttttaaaaagatattgcaggaatccagcaagaaattaagaaattatcaggatttaaattaaataattgcagtggaaataaagaagagtattggagagatacgaaagatgtggtgcttcaattcagtaggatttggtaactaactggatatagggggttagaggggacaagtcaaggttggcctcagattcctcgcttgagcacctaagtgtatgttggtcttcttctattcaccatcttgatgaataacagatttggcagaggtaagggaattctttgttcagtgtgctgaatttgaaataatgacatcagatgaaacatgaaaatggcagatgattatatgggtatggatcccagaagatagatctgagttaaaatacagattttggagacacagctttcctgtgatagttgagagtatcgttgtgaatgggataggcctgtgtgaagagactacggctgtagatggaatcctgagagatagacatcctctcaaggagaggatgtgaattattgcatgaattattaaaatatgtttagcataaattttttttttttttgagatggagtctcgctctgtcacccagcctggagtgcagtggcgctatctcagctcactgcaagctccacctcccaggttcacgccattctcctgccccagcctcccaagtagctgggactacaggcgcccgccaccacgcctggctaattttttgtatttttagtagagacggggtttcaccgtgttagccaggctgatcttgatttcctgacttcgtgatccgcccgcctcggcctccgaaagtgctgggattacaggcgtgagccaccgcgcccagcaatggttatttttttaaaaaggatacttatatgtcagttcagtccattttgaactattgcaaaaattttgaaacaacaaaaatacttggaactgattacaagatactaatgatagtctaaggtcagactataatacatctaagccaactaaaaatattttctataatgtaggatagggacacgaacatatatatgtatatctaaggaaataacatttcaaaagcataagtgagacgaaagagtttttccttgaataggaatcatttcacaactcatcaaatattgggactagaaggcattttagataatttaatacaaactcttcattttttagataaggaaaatcagacctagaagtgttaatggcgtacctaaatcacagaccaagttggtggcagaattgggactgtagctcccagatcagtattgtttacattatgtcagttgcctctgtgtaccattaataatatatcagttcttaaaaacacagatatattatctatatactatacatatttattaagaaccttatttttagataatcagggtaatagcttgatatatttcactataaattttttaataagtaaaagcatattttgggtgttctaaaacggggtccccaacccacaggccatggactggtattggtccgtggcctgttaggaaccaggccacacagcagaggtgaggggcaggcaagcaagtaaagcttcatctgtatttacagctgctccccattgctcacgttagcgcctgagctctgcctcctctcagatcagcagcggtattagattctcatagaagtgcgaaccctgttgtgaactgcgcgtgtgagggatctaggttgtgtgctccttatgagaatctaatgcctgataatctgtcactgtctcccatcacccccagatgggacagtctagttgcaggaaaacaagctcagggatcccactgattctacattatggtgagttgtataattatttcatgacatattacaatgtaataatagaaataaggtgcacaataaatttaatgcgcttgaatcatcctgaaaccgtctccccttccccacagtccgtggaaaaattgtcttccacaaaacccatccctggtgccaaaaaggttggaggctactgttctaaaatgatagcaggctgggcacggtggctcatgcctgtaatcccagcactttggcaggccaagccgggtggatcaccttagctcaggagttcaagaccatcctggccaacatggtgaaaccccatctctactaaaaatacaaaaaattagccgggtgtgatggtgggcgcctgtcatcccagctacttgggaggctgaggcaggagaattgcttgaaccctggaggcagaggttgcagtgagccaagatcgtgccattgcactccagcttgggcaacaagaatgagactctgtctcaaaaaaaaaaaaaaacgtatcgcaatttattatttttctcttctgtgtagcacattgagtgaaattgacaaattgtatcttaaatttctcctgagtgtgaaaccttgaatactgtattactagcttagggttattctgccctaaatcacagaaaagccttaggagctattgaatgaacttttttataacttcctgtgaattttaaaatctaaactacaggtatttaataaccatatgtgtgttgtatatctatatatgtgtgtgtatctgtgtttcacatatatatacacacacacttttttgtcatacacagtttttgcattctgcagtggagggaaacattataatttgtgagaaattatgttctgagagtttcagaatgccttctggttatgacagtgccatcggaggttgtagactatatattgtttctccctgtctcctattcattcctccatattttgtacctgtttttttgcaaacaatctattcagaacatagacttgaatgaaattggacttgtatctaccagattgttatttctggagttaatctctggttgtttccctatcttactcaaaagctactttggctttgtattgcctttagaataaactgtgctccaacattcagtattctgcatgatctgttcctatatttttagtctcatctcctgctagtcatctctccatacttccgttgtagccaaacaaaacatttattggttcattttgtgtatattctgatgattttccatttcattacccatgattatgctactcccaaccgtgctatttccccacaccccaactgtctcaatcctatcagttgtcctaaatcttaaagaccactttctccatgaattctttcttgatgaccctcccagacagaagtagtctcttctgaactcccttaatcttttatttttaatttaattaatttatttattttgaggcagagtctcgctgtgtcgcccgggccggagtgcagtgttgcgatcttggcaccctgcaacctctgcctcccgggttcaagtgattctcctgcctcagcctcccaattagctcccaagtagctcccaagtaactgggactacaggcacctgccaccacacttggaataatttttgtgtttttagtagagacgaggtttcaccatgttagccaggctggtcttgaactcccaacctcaggtgatccacccgcctgggccacccaaaatgctgggattataggtgtgagccaccatgcagtctaatcttttattaagaaagtgtttggtgttgttatggtttcaatgtttgtccactctgaaactcatgttgaactttaattgccattagaacaatattaggaggtgggacctttaagaggtgattaggccatgagggcttcaccctcatggatgggattagtgctgttataaaaggagggggttcattcccttcttgctctctctttgggaagctgaggcaggaggattgcttgaggccaggactttgagactagcctggtcaacataatgagaccctatctgtaccaaaaaaaaaaaaaaaaaaattaactaggcctaatggcacatccctgtaatcccagctacttgggaggctgaggtgggaggagtccttgagcccaggagtttttgaggccgtagtgagctatgagtgcaccactgcattacagcttgagtgacacagtgagaccctatctttaaaaataataataatatgtcatggttcatgtttttattttatttttcaaattctgaaccttttggtaaatttattagaattatggtattgtagttttgcaaagtaacttttcaactgatgagaaagttatatggaactatttatgaagaagtgatttaagacaaaatacctaacattttttgaacacttaatatatgctaagcagtatattcattgccttatgtacactattttatttcttcttaagtacaactcagattcatactgttactgtttctatttacacatgaggaaaatgaaagacaccaaaggcctaagtaacttaagatcacacagttaggtgataagtggctgaacccaggtttaaattcacctatgttgtccgtaaatctcatgtttcgaaccataagaagtactatagtgtctcttgagctgtttgtttaagagatagaagtcttgctctgtcacccaggctgtgtagcagtggtgccatcatagcacactcactgcagccttgatctccttgggcccaagtgatccttcctcctcagcctcccaaggggctgggattacaggcatgagtcacctgacctggctcctcttgagctttcatgatcaatgtcagagatacactaaactgaggacatgaccttttatgaagtagtcatgcataactgcagtttgctgcattacaaagaactccaagaagctttctaaattcttttgatggcttgagttttagtcatattaccacttagaaatttatttattggccgggtgcggtgggtcacgcctgtaatcccaacactttgggaagccgaggcaggcaggcagatcacttgaggtcgtgagtttgagaccagcttggccaacaatggctaaaccctgtctctgctaaaaatacaaaaattagctaggcatggtggtgagcgcctgtagtcccaactacttgggaagctcaggcgggagaatcaattgaacccgggaggcggaggtttcagtgagctgggatcacgccactgtactccagcctgggtgacagagcgagactctgtctcaaaaaaaaaaaaaaaaaaaaggaaaaagaaatattagtatttcttgaaatgaatgaaccatttgcttggaaatggttccacttgagttgatgtgaggattaataaatatactttgaaacaaaaggaagctattgacacatagatatttaagttatatttgaattgaatttaaagatggctggctacttataagcatttgaaaaacagtttaaattccaaattaaagatggaaaattgtaaattactgtatctgtatattttttgaaaggctgcatgacatacaaagactaggagattgaaagatctgctttctgctttctaggttttactttgccacttatttacctcgtcttttcagagttacttcacctctacctctaagcttcagtttcttcatttgtcaaataaaaccccaaatttcagggaaatggtaccgttctgcttacctactagcactgatctgatgattacctcattaatgttatgtaaaattactttataaaccattgatataaagcatttaacacctttgacaggtcacttagaagcaagatttggtatctattttggttatatgggttcttcactagtattggggtatatataaaattagttctgtggattcattacattgagtgcagtcgttgagaagtacctatataaattagtacattacagactttatgaattcaagagcttcagattaggtcttcagatgaaagcctttctttctttgtcaaattcttatacccactgttttatttttgccaatatctacacctgtgcagtgttacttgtttgtagatgagatggtacatgatagtctaattcagttattattggtaatctacattttttaaagtgattaatatttaaaggataaaagatatattttataatgagagtggacttcgtgaagaatctgtgattgggatgaagagagtgttaaatggaagaggcagaaaggaaatcagtatctgtggaaaataactaccaatagattctaggctctaatagggaaatcgcaaaggaataatgagtgaataccttgagtactaagccaacatatttttcacctctaagctatatttactaggacagtctttgtgaaatataaacattacactgtgtcttagtctatttttgctgctataatggaataccacagactggataataggtgatgaacagaaatgtatttcctgtagttctcatggctgcaaagtccaagattgaggggtaggcatctggtgaggacctttttgctgcatcatcccatggcagaagggcaaatggggtggggaagagagagaaagaatgtgcatgtgcgtgagggcatgtgtataagggagggcaaacttgtcctttcataacaaacccactcccaggataacagcattaatccagtcacctctcatgaggccttgcctcctagcaccaagtttccaacacatgctttttgagggatatattcaaaccacagcatgctgttgatagagttacaggaatgctgtcatgcaccctacattgtagagggaaagcatctctttaattccctattctcctccttattcaccaaagctagataaagagatgaaaaaaaatttttttctctttgacaaattatctgttgaattttgtatgaagtgtctcttatattgtatcctagaattccaggatctagggaggtggtaaagaagcaatggtaaatttggggatcttatctccctaaagttcctgacactctatccctgatcctgcagtggctgccagaaaaaatgtaaatttacttaaatcttactctaaaatcattgaaagtccccccaaaaatcatatatttggctgatcaatatatgtatatttgcattagaataataatagttataattttttgagaatacagtgttgctggtcctgttaggcattttatagatttcctttcatttattctttataacacatctggaatttaatatagtttctcctcccattttacatggacattgaggctcagagaagtaacttgccccagatcccacaacagtgaatgatcaaactagcattcaaacccatatctctgggactccaaaatctgcaatttatttttcaaaatgccatactgctacgttgatatgacaattgttttgttttcatagatctggcctagcagcttaattgtgcagccagacctgggtaatcctggagcaagagtactacccctaaattcctaaatgtactaccttaaatgcaaaatatagatgataatgtttaggtgaacatgactttcagccacaaagcttctctgagtttaaaggggaggtattcccttcacttgtggctgctactgtcaggatacctgtccgctaaaatcaaggatgcaaagacccataaccattataagaataaactctagttttcaagaaaagtaagcataaatttctctgatggagattgcttcattgggtgttattgctttcaaaggtatcaaaggaagctcgtacttggctagtgaacacattcgttgttccatcattgagcagctcttgtcagaaagtccttttgcaattctaaactgaggaaaatgtctccttaatgaagggttgatatgtttgttactgtttcattcacaaaagtattttgaattataaaatgctttggccaggcatggtgtacatgaattacatgctcacacctgtaatcccaacactttgggaggccaaggcgggtggattacttgaggtcaggagttcgagaccagcctggccaatatggtaaaaccacatctctactaaaaatacaaaaattagccaggcgtggtggtgggtgcctatagtcccagctactcgggaggctgaggcaggagaattgtttgaacccgggaaggagaggttgcagtgagctgagatcacaccacagcactccagggttccagggtgggtaacagagcgagactctgtctcaaaaaaaaaaaaaaaaaaaaagagaaacctgcttaatatgaatttagataagccctaaattatagagctatgtttcatatttgtctcaaaaaattataaacaataaatcctgtccaagcacggtggctcgcgcctgtaatcccagcactttgggaggccaaggcagatggatcatttgaagtcaggaatttgagaccagtctggccaacatggtgaaactctgtttctactaaaaatgcgaaaaaaatcagctgagtgtggtggtgcatgtttgtaattgtagctattcaggaggctgaggtgagaggaattgcttgaacctgggaggcagatgctgcattgagccaagatcacaccactgcactccagcctgggtggcagagcaagactccatctcaaaaaaaaaaaaaaaacaaaacgagaaaaaaacaacttgtctgtggtaccatcttcataaatcctcatcttcccttaatgtcttataactgtacttattaccataattcattatgttcatgagttgactttgttcacccagtgaaattataagcttggtgacagcagcttcctaatctgaacatttcttttttttttttttttttttttgagacagtgtcactctatcgcctaggctggagcgcagtggcacaatcttggctcactgcaacctccgcctcccaggttcgagcaattctcctgcctcagcctcctgagtagctgggattacaggcgcacaccactacgcctggctaatttttgtatttttagtagagatggggttttaccatgttggtcaggctggtctcgaactctgaccttgtgatccacccacctcggcctcccaaagtgctgggattacaggtgtgagccaccgcacccggccttgaacatttctttatgacctttgaggtgatagttcttgagacctctaaagcaattcatacagtaaagctgtacagtttaaccaaggaaggcatcaatatttttggcttttacttagacaaacttcaacaatgtgataatataacttagtttatgctcattagaagccctgataaaattggaaaccaaattttcatttaataaatgccatttatttaaaaatcagctttttaaatgtaagtctttcatagtgaaagattgggaattactgtttggtagtgtccatccagcccagagttgcataatgtttattaaaaatatgattaattggccgggcgctgtggctcatgcctgtaatcccagcactttgggaggctgaggcaggtggatcatgaggtcaggagatggagaccatcctggctaacacggtgaaaccccgtctccactaaaaatacaaaaaagttagccaggtctggtggcgggcacctgtagtcccacctactcaggaggctgaggcaggagaatggggtgaacctgggaggcggagcttgcagtgagccaagattgcgccactgcactccagcctgggcaacagccagactccgtctcaaaaaaaaaaaaaaaaaaaaaagaaatatgattaatttattgatacaaagtagctaataaacttttttgtttttagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgacgtaagtagtaaaaacacgtttttcaaggcatgatgactaaaataatgcctgaaatattcagagccctctgtttggtgatataattcagcagaaatagtcttttgaaatagctaaactaaatttggccagtgtctgcgtgtattgggcataatgggaagcactgaaaataacgaatgaggaagttgattatgtattaccttgtaaacttactgcttttatagttcattgataaaaaacacgatcatctttagaaaagtgaatttgaacttaagtaactttattttttatagtttctgtatatgatgagcatattctttgtcacttggttggaaaacagttacgatcaattatattttacttaacatactggaagctagtggaatggaaaccactctcagttggtaagatacaggctacagaagaaggagcttccttgctcatggctttagcagcgtaactaagatgtgatttttaaaaagacattaatggttaaatgcaaactttattttaaattttatatctccatctaattaaaagtgccctgtgctaggaatccgaccacttgagtaagattctcaactctgccacttatgagctctgtaactttgggcaagtcacccaagttctctgattgtgtttcttttgtaaactggaaataataatgcttgccttctattttatattgggttgttaacaggatcaaatgagagaataaatgaaacataattttataaaccataaaacagtttatgttctcagcaagtcaacttcattcttccaccaattatttatttattcagtaagaatttaataaaggcctcccatatatcctgaatcctgggaattctgaaatagctaagatgtgattataggctctcgggaacttttataaggaatacatacagaaataatgattgtagtggtatcttgtattaaaacctgtgctcaaagttaagttcattgggagctccaagacaggctctaacttgaccagaccaggaatgaaggagtagttggaccttcagttttcttggaccagagtgcctctggattaactctgaaggaggcatatgaatcagctaaatgaatcagggaaagggaaggattgtgtgcaaaagaagcaacatgtgtatcttcctattttatacaggcatttcaaaccataaaattcaagagatgagccagactgatttgcctctcctaaggaggatcctggttaggaggtatagaagaatgaactcttggctgagtgcggtggctcatgcctctaattccagcacttttgagaggtggccaaggcaggcagatcatttgaggtcaagagttcaagaccagcctggccaacatggtgaatcccatctctactaaaaatacaaaaaaattagctgggtatggtggcgcatgcctgtaattccagctactggagaggctgaggcaggagaatcgcttgaaccctcctaaggcaggagatcatgccactgcactccagcctgggtgacagagtgagactgtgtctcaaaaaaaaaagagtgaactcttaaacttgttggaaaaagaaaaagtgaactcttaaacttattgagcacagaggaatcaggagatatttatttcctggatcgtatcaattcagtttgaagaagattgctccctaagaccttgtgggtttgtttgtttgtttgtttgtttgtttgtttgttttggagacagggtctcattctgtcaccaaggctggagtgggctccagcccactctgtcacccattctgtcacctgggctcaagccatccttctacctctcagcctcccaagtagatgggactacaggtgcatgctaccacacccagctaatttttttgtttgtttttttgtagagacagggtctccctaggttgcacaggctggtctcaaactcctaggctcaggtgatccttctgcctcagcctcccaaagtgctgggattacaagcatgagccactatgcctggctattgtgtgtcatttttgaaacatttacatcgaaaggcttattctggttatcagaagacttaatatggctcagcatttgtctgctaccatgccaaatactttttgagcccaaaatttgatatgttctaatgagccattataattatattttgaaaattgtattagtcatgaaatctcttttaccaaagttttatgttgccaaatttaagtttgatcatttctcatttccatagtttatccatgcccactattcagtgtcagatttcggaagccattgtttggagagacggggcataccatcatgaatcttcttgcagtaagttgggaattttttttcctttgtccttactggagtttatatgggagaaggaagaaagcaattttattattttcttggtagctgtgcccaagctgcttaaggcaggtaaagatatatgctgaagaaaaagaacagtatatgtatgtgtatatatatatatacacacacacacatatacatatatattcatatgtatacacacacacacacacacatatatatattcttttgcaaacatgaagtgaaatggtacaggattccagcgcctgattatacacttaccgtccaaccttgcagaattattgtgaggactagaagtaatacataaataaaacacctagcattctgtcttgtttttattttaagactggcattctatgagtttctcttgtgtctatataggttattatccaagcaaagattggtcagagattgtacccagataccccaagccagtaaggctactgccctctgctgatggatctgaatatggactggaatttaaacttcattgttttcctttcttctgggctctctcatgtctcctacacacgtgcacaggttctgactctgttggccaagatcattggttggcttgagtccactaagttctctgctgcatatatgcacagactaggatcaatcctggatatttggaccgtttatgaagctccctatggttgtcttacctcccagaacttgccccaaacaggtttggtgaaatcaaggtaatcaagctactgggcctccctttttaataaccaccgagattaccactttgacaatgttccatagcaagtaaactccttcaagtagcaaagctcatttttttgtttgttttgttttattttgtttgagacagagtctctatcgcccaagttggaatgcagtggcacgatctcagctcattgcaacctccacctccgagcaattctcgtgcctgagcctcctgagcagctgtgactatgggagcacactaccacacccagctaatttttgtattttttgtagagagagcgttttgctatgttggccagactgatctcaaactcctggcctcaatgattcacctgcctcagcctcccaaagtgctggtattacaggcatgagccactgctcccagctgcaaagctcattgtttttacaaactaccttgccctggttgaactacctaactacctaatggggctagggggcagccccaggcaagaaggtcacagactcaattcaaagttcagtagttttcatgaaaaaaacatttctttttttttttttttttggagatggagtctcgctctgttgtccaggctggagtgcagtggcacaatcttactgcaacctctgcctcccaggttcaagagagtctcctgcttcagccttcagagcagctgggattacaggcacctgccaccacgcctggctaattttttgtatttttcatagagacagggttttaccttgttggccaggctggtctcaaactcctgacctcaggtgatccacccatctcaacctcctaaagtgctgggattacaggcatgagccaccatgcccagccaaaacacttcttaatgttaatatgcctttgatctaattccagagcactgaaatggttctttttaagccacttatacagcttttcggttgctttttgaggagtgggtttggtgatttcctccctctgtgatgcttaaaagctatatttccagttatctttttttttttatttctttaaaaaattttgttttgttttgttttttgggacagagtctcgcactgtcgcctgggctggagtgcagtggcacgatctcggctcactgcaacctccatctcctgggttcaagcaattcttgtgcctcagcctccccagtagctggaattacaggcacgaaacaccatgcccagctagtttttgtatttttagtagaggcgcatgttggccaggctggtctcaaactcatgacctcgagtgatccacccacctcagcctcccaaagtgccttttgcctgttttttaattgggttgtctttttgctgctaggttaaatttgttatatattctggatattaactccttttcagatgtatggtttgcagatattttccatttctgtaggttgtgtcttcactctgttaatagtttccttttctgtgcaaaatctttttagtttgatgtaattccatttgtctatttttgcttttattgcctgtgcttttgggatcttatctaaaaattcattgcctagcccaatattgtgaagcatttgccctgttttcttctaatagtttcatagttttgggtttaaatttaagtctttaatccgtttttagttgatttttgtatatggggagaggtgggggtctagtttcattcttctgcatgtggatatatccacttttccaagtactatttattgaagagagtcctttctgcagtgtgtgttcttggcacctttgtcgaaaattagttggctgtaggtgtccaaattcatttctgggccttctattctgtactgttggagtatgtgtttgttttggccactactatgctgttttggttattatagttttgtagtatatttggtcaggtagtgtgatatctctagctttgttctttttgctcaggactgttttggccatttgaggccttttgtggttttataagaatattaaggttttggtttttttttctgtttctgtgaagaatatcattggcattttgatagagattgcattaaatctgtagatacctttgggtagtatggctattttcacggtattaattcttccaatccatgaacatggaatcagtttcctttgtcaatgtttttttttttttttttttttgagacggagtcttgctctgttacccaggctggagtgcagtggcgcaatttcggctcactgcaagctccgcctcccgggttcacaccttctcctgcctcagcctgccgagtagctgggactacaggtgcccgccaccacgcctggccaattttttgtacttttagtagagacggggtttcactgtgttagccaggatggtctcgatctcctgacctcatgatccgcccgcctctgcctcctaaagtgctgggattacaggcgtgagccaccttgcccggccctttttcaatgttttagaggtttctttgtaaagatcttttacctcttaactaagtgtattcctaggtatcttattttttttatagctactgtaaatggaattgttttctttattttttattagcgtatagaaacactactgattttacatgctgattttgtatcctacaactttaccgaatttgttcattagctctaacaggtttttggtggcatctttagggttttctatgtatagggtcatgtcatttgcaaacaagcacaatttgactttccagtttggatgccttttatttctttctcttgcctaagtgctctggctaggactatgttgaatagaaaggattaaaatgggcatccatgtcttgttcctgttctttgaggaaaagatttccactgttcccattcagtatgatgttagctgtgggtttgtcacatatggcctttattgtgctgggctgcttgtccagctgggcacagcaggccagccagctgtgtgttggtttctccactgtacaggtctgtctgttccctggggcagggaggtgccatgtgagttcagtgccagggctccctcattctgttgggcctaggctctcagcagctggatgatggtgatacagctacatgtgtgtgttgtggactgacagtggagcttcagagatggagagatgcagtggcaattggcccccaggcaggatgaactctagcagtgggtccagtttcaagatggcaccatgctatgactgggaatgagggctgtatgacatgggctccaactctggagcagtgtagtcctgtgaactgcaggcaactacaaactggattcagggtttgtgaggaccgcgggacgaggctgcagtggtcatggggaccatgggtccccagcttaccctttccccattagaagtagtccttcctgactccaggccactccttgcagggaggcagtgcggcagaggcagagtgcttcgctcccgtctctgtggtgctatctggggcatctggtgctccacaggaatttcagcactcccctggtgctctccagcatacttccacagccactccagttgaaatatagtttgtttattgttgttttggtcccttttgttgagtagaggggagcaagagccagacaactccagtcaaccatcttgctgatgtcactgtcgtttagagagaacaataagaaaaaaaagtcttggctgggcgtagtggctcatgcctgtaatctcagtactttgggaggccaaggcaggcggatcacgatgtcaggagtttgagaccagcctggctgatatggtgtaaccccgtctctactaaaactacaaaacttagctgggcatggtggcacatgcctgtaaatgccagctactcaggaggctgagccaggagaatcttttgaacctgggaggcagaggttgcagtgagccaagatcgtgccactgcattccagcctgggcgacagagtaagactcagtttcaaaagaaaaagaaaaaaaatcttgtagatttacccatctagttgccatttccagtgtttttcattcctttgtataactctgtattttcatctggtgtcattttccttctgccaaaatgattgcctgtaatatttcttacagtgtaggtttgctgctgatgaattattttagcttttgtatttctaacaacatctttatttgatcttcatatttggaagatacttttggtggttggagaagtctaggttgagttttgttgtttaggttttttggttttttttttttttgagacagagtctcactctttcacccaggttgtagtgcagtggcacaatctcggctcactgcaacttccacctcccgggctcaagcaatgctcccacctcagcctcccgagtagctgggattacaggcatgcaccaccatgcccagctaatttttgtatttttagtagagacagggtttcactatgttgctcaggctggtcttgaactcctgacctcaagggatcctcctgccctggcctaccaaagtgctgggattacaggtgtgagccaccatgctcagcccgagttttcttctttgagtgtttttgagatgttgctccactgtcttctgctttgcattgttttccctctcatctttgttcctctctacataacaattttttcttttcttaacgttgtttttctttttccatctttttttttttttttttttttttttttggaaatagggtctcactctgttgcccaggctggagtgcagtggcacaatcacggctcactgcacccttgacccacagggctcaggtgatccccccgaccttggcctaccaagtagctgggactacaggtacgtgccgctatgcccagctaattttgtttattttttatacagacaaggcctcgcagtgtttctcagactggtctccaactcctgggctcaagctatccttccacctcagcctcccaaagtattgggattacatgcatgagccactgtgcctgaccttctctggctagtttcaaaagctttttaaaattacaagtttgaagcaaattgattataatgtgccatagtgtagttttcatgtttcccgtacttggggttcattgagctttttgaatctatgggtttatagttttcatctgatattttttctgttcatccccttctctccctgaaggagattactccaattacatatatatcaggctgcttgaaattgtttcacgtcttactaatgttctttttatttctttttcagtcttttttgtctcttgttttcatttaggatgaattttattgctgtgctctcaatttcactaatcttttattttggtttaagctgctgttaattctatcaatcttttaaacaatctcaatcaaatactttgattttcatctcttgaagttatacttgggtcttttaagatcttttatgtctctgcttaacattttgtacatgtagaatacaatataataactattgtaatgcctttagtaattctaacttcttgtataagttctggctccgtttccatggattgattttttttcctttattttgagttgtattttcctgcttctttgaatgtttggtatttttttattggttgccagacattctgattttaccagttgggtgctggttatcaatattcttgagctttttttgcaagtaatgaagtcaagttacttagaaaaaccctccatctcacatcatattctacatttcagtaaatggcagttccagtcttctagtagccctggctataaaatttagaatcatctttaacttttatcatttgttcacattccacatccacagtggcaaatattatcagattttcctttaaaatatgtctggaaacaggctgggcgcagtggctcacacttgtaatcccagcattttgggaggccaaggtgggcggatcagctgaggtcaggagtttgagaccagcctggccaacatggcaaaaccccatctctactaaaaatacaaaaattatctgggcctggtggtgcattcctgtaatcccagctacttgggaggctgaggcagtagaattgcttgaacctgggaggcagaggattcagtgagccaagattgcgccactgcactccagcctggttaacagagcgagactctgtctcaggaaaaaaaaaaaaatctgtatctatatatctagaaactgacaacttctcatcactttttaaactgttaacatcctggccaggtgcagtggctcacgactgtaattgtagcactttgagagaccgaggcaggtggatcacctgaggttgggagttcaagaccagtctggccaacatggtgaaaccttgtctctactaaaaatacaaaaattagccgagcatggtgacgcacatatgtaatcccagctacttgggaagctgaggcatgagactcgcttgaaccctggaggcggaggttgtactgagccaagatggcaccactgcactccagctcgggcaacagagtgagactccatctcagaataaataaataaactgttaacatcctggtctaagctctcactatctcctaccttgattgtttttatggtatttatctgatcttttcttccattcttcctcccttaccacctattcattaccaaggagtcagatctgttaaaacaggtcaaaagcctcctaaaggcaaaagtcctcacggtgacctataagaacctatgaaatctagccatttgctattactttgaccttgagtccaccactcttgttcattttgtttcacccatactggatagatgatgtgttagtgtgtgtgtgtgtttccttacagatattcattgagtgcctaagatgttccaggcgttaaggatatagcaagaacaacacaactgagagtttgtactctcttggagcttcagagggaggagacagatagttaacaaataaatacagaaaatgttaagtggtggtaaagcagggtagacattcaaaaatattttttaatgttgtgtataagaggtatatgataatgtttggtttacttataagagtttaaagactaaagagctaaaatacatatagtggggctttcattatacatttccttattatttaaataaataggatctttcaatattgacattttttccattcgtgttaattttattactataaattaaaccctaccattgatgaattaatttattctgcttcaatctgctttggcccaggacttcagaaattaccagtataccttgccagtagttcaaggtttggtggttgatatggaagttcggaaaactagcatcaaaattcccagcaacagatacaatgaggtaagatttaccatgaaggcgtatttttcatagttgaaaacatgagtgaaggtgaaaaatgcatgattatatataaattttacttataattaattaacaatgaaatcagttaataatattgtatggcttagttcaattatggggaatttcattacaggaagacaagatgtcaaatttctgacctagtggttcattggatgtgtcattttaccttttgatgttatgataattagtattagatttgcattttgattaggtcatgaaattagccttgtatctgtaatattagtggtgagatttttaaaatgtccccactcctactataaatatttatttatttatttatttattttttgagatggagtctcactgtgtcgcccaggctggagtgcaatggtgtgatctcagctcactgcaacctctgcctcctgggttcaagtgattcttctgcctcagcctcccaagtagctgggattacaggcacccgccaccatgcctggctaatttttgtatttttagtagagacgaggtttcaccatgttagccagactggtctcaaactcttaatctcaggtgatccacccacctcggcctcccaaagtgctgggattacaggcacgagccactgtgcccagccgggtttctttgtataaaataatttttccttcctttttcctttttttttcctttttcatttcattttttcttcatttagccactaaatcatttatgcgttgaataaacattatgtacttggtatgcacgtagaatcacacagatgttttattggatttgtgagctcagttctcagcattattatgagaatgacctctgtgaagaaagcttttagccatgactttccacgtgatttttttttttttaaggatattagaaaatagtagctagaatgtgtgcttacttttttctgggatacaactagcagtcttcagcatttagataatcctgccttggagtatcaaggagtaatcgatgagactaggtagagtcaaatctttaaagtgaactatttgtagttcacagatcttgctctgttgcccaggctggagtgcagtaatgcaatctttcatggcctaaagaattttaaaagagattgtgctttgaaaacctattttatttctcaaatttgaaatattattgtctatttcacaaacatgtattaaatatattctgtgatttgaaatataaagatgagataagaacattaggcctgctggccaagcgcgatggctcacacttgtaatcccagcactttgggaggccaaggcaggtggatcacctgacgtcaggagtttgagaccagcctggccaacgtggtgaaaccccgtctctactaaaaatacaaacattggctgggtgcctgtaatgccagctactcgggaggctgaggcaggagaattgcttgaacatgggaggcagaggttgcagtgagctgagatctcaccattggactccagcctgggcgacaagagcaaaactctgtctcaaaaaaacaaacaaacaaaaaccttatgcctgctttcggagcgtttgctgtccaggaaaatgatggcatcagtggcctgtctggagtggctgctgccatcatgctggctgcagcagggtggtgctgccagggctgcatactccgtggagcctgtaggagccggggacaagtgggagccccaccccttccgagttggtggggtgggcctcccaaggtgcagctgcccaagttatggctgcagacctgggccttctgctccatggagcaggcaggagctccccccttgcaggcacagctgtagctacccgagttgtggctacggacccaggcatcctcgtgcttgggaaggcccccctcccttacagccctggaaatgcctgctcctactgcctggcttttccctgctgtcagcacccactccaatctcagagcaaagtcggggcagtgctgacacaccagtgccctgccgccttggccccctctggactttgggcactgacaaacataggaagtaagctgatgggggatgtgtgcagctcaatgctggcctgcagacaccccatggaacctacagcttgggcaccatgaatagcaggaggcaaacacgttcctgagcagaagaggccaggtccccgatgaggttccaccttcaggctaggaagggcctgaaggctggggggccaggccaccagtcccatggactgtagtgggaacttggggtgccttttctcagcctgcccatggctgtccatgcaccagtcggtgcatgcttcccctcctctgaggcctgtaaaagccctgggatcagctagagctgagcagacatcgggatgaccagctgcagagaggagctgcccactccagggtctcctctctgctgagacctgcagacgctgagatgaccagctgtagagaggagctgctcactccagggccgcctctctgctgagagctgaatactcgatttgacaacctgcctgtagagaggagccacccaccccaggccctcctctattacgtcactcataaagctcctcttcactttgctcaccctccacttgtctgcatacctcattcttcctggatgcaggacaagaactcgggacctgccaaatggcagggctgaaagagctgtgacacaaacaaggctgaaacatgccccttgcttgccacattgcaagtgaagagaaggagagaagagctgcagccctttggggaacccaagcttgggagctccctgagccagggctgtgactccctctttggggccctgtggttactgaagtctccaagcttccgaatgtcaccacattccctggtggcagctgtggaagctgcttgcggtgcacctggtccagctgcagcctggcagagagccagggcctgtgcaggcacctggagctacctgcctcactgcagcagccagcatgcctgactgtgtgcagtggccggaacccacgcttgctttctcacacaccccttgctgctccatgcctggctcacccttgacagacatgggatccaggctggtagtgtaagcctagcacagcctgccaggctgagtggccggaacaagcccagcaggcctgagcaaaactcaggcaaaggcaccactggccacagagctttccagccagaaaagcaacacaccaaggatcctgtaacagttagatgatcagatgtcattcccaagcaaataacatattgctatccttgatgtttgcgaggtagtgctgtgtgtttagaaattttgtttgtacaagtatatctgtaaaagctgaggcgctcatagttatttctttttttttgttttgttttgtttttgagacagagtcctgctctgtcacccaggctggagtgcagtggcacaatcttggctcactgcaacctacgcctccaggattcaagcaattctcctacctgagcctcctgagtagctgggactacaggcatacaccaccatacccagccaaaattttgtatttttaatagagacaggatttcaccctgttggccaggctggtctcaaactcctaactgcaggtcttctacccaccttggcctcccaaagtgctagaattacaggtgtgtgccactgcgttcagcccccatagttacttcagtactgactggacactttcacaacaatagctcctattcatataacctgtttttatctgaactctgttgcctccgtttatggtgtgcaggttcagaatcctttgttctaaaagagtaacagtatttcttgtcatttattttatggattatgtatcaggtctttttcttacctgattagcaaactgaattttcttttttcttctttttttttttttttctgatacggagtcttgctccgccacccaggctggagtgcagtggagcgatctcggctcactgcaagctccgcctcccgggttcacgccattctcttgcctcagcctcccgagtagctgggactacaggtgtccgctaccacgcccggctaatttttttgtatttttagtagatacggggtttcaccgtgttagccaggatggtctcgatctcctgacctcgtgatccacccaccttggcctcccaaagtgctgggattacaggcgtgagccactgtgcccggccacaaacaattttccttctgatttaatttttattttaactcaacataattttatctcctacaatctcatacagttaaattgtgttgtgtctaataattccacttcatagttgaaaaagtaatttcttttttcttttcttttctttttggaaacagggtcttattgtgtcaccaaggctagagtgcagtggcacaatcatggatcactgcagtctcaacttcctgggctcaagtgatcctcccacttcagcctcctaagtagctgggactacaggcgtgtaccatcacacccagctaatttttgtatttttttgttttgtagagagaggatttctccatgttgtctaggctgatcctgaactcctgggcttaagtgatactcccatcttggcttccctaagtgctggaattacaggcatcactacacccggccataattttcttgtacattttatttaatcacaatattcttcttttcctctcattcattttttccatttatactcatagtctttcttattattgcccatattttgtgctcttttgttcatggcttttgcagagctggttccttattgattcatacttcccctactcttcacctgcctaacccccactcattattcaggtgtcaccgtaaatgacatttttttcacatatactttgatttaactcccaactggggtaactctattatatgcattcctagaattctatgcatactatttgtaataatcagtacatttgtaattccttgttgtgtgtctgttttctctgctgtgagttccatgagggactatgtctatcttgtataccacaggtatcatcagcaaacaccctagtacggagtgggttagcaagaaatatctgttggatgaagacatgaaacagatctaatatagataaaacaatatgaaaacaaatggtgaaatttattgcaagtatactaaaggtacagagaaagtagatctctagaggatgaatagaatagacaccaatgtttcttaatttcttattgaccctgaatccctaacagagcaacacattgcatgtaggagatgttcgtaaatgttcaccaaataactagatgaatgaaagatttgaaatggataatgaatgataactaggcactagaaagagaagggcagacggcatggtgactcacgcttgtaatcccagtactttgggaggccaaggtgggcagattgcttgagcctaggatttaaagatcagcctgggcaacatggcaagaccccatttctacaaaaaatacaaaaaattagctgggcatggtggcgcatgccccgtagtcccagctacttgggaggctgaggtgggaggatcacctgagcccaggaagtcgagactgcagtgagctgagatttctccactgcactccagcctgggtgacagagtgagaccctgtctcaaaaacaaaaacaaaagcaaaaaagggcagaaaagaccttaagtgaaaagggggatagatacctgcctacacaaaggaagggaaggagcatagctcatagggaaatgggagacaacaaagtgcctagcaaagagggggttaaagcagactgatggctttgtgggatgtgaggttgtactaagactgctggcttcaaaatccactcagaggaatttagattttaatatgataatttataaagagcttttataggttcttaagcagaaaaagtgacttaatgaaagcaggattttggaaaactgagtttggtggctatatggaaaatgaggagggagggagggactaaggaaagactttaagcttagaaagctagaagatagtacttctgacggcatggaaattttaataagcattgtatataaaatttctaatctcttttgtcaaggccattaaagatccttgttggttaaggtcacctggttcatatatatatgtatttttttgagacagagtcttgctctcgctctgttgcccagctggagtacagtggtggtgtgatctcggctcactgcaacctctgcatcccaggctcaggtgatcttcccacctcagcctcctgagtagctgggactacaggcacacaccatcatgtccggccaaattttctgttaatagggatgagatttccccttgttgcccaggctggtcttgaactcctgggctcaagcgatctgcttgcctcagcctcccaaagtgcttggattgcaccattgcactgggcctcatgttgttacaatgagattattttcaccattgtattaactaataataaatatttagtatgtaccaggcactattctaagcatatatgtatctttacactaactctatgacatgagtatgctaactacctttttacagatgaggaaattaagatacagagaacttagctgggtgccatagtgaatgtgtatagtcctaggtacaggctgaggtgggaggatcacttgaacccaggaggtggaggccagcctaggcaacatagcaagaccccatctcttaaaaaagcaaaaaaagacacatagaacttaagtaacttgcccatgatcgtacagctagcaagtggtggagctgccatcaaacctgggctttctgattctggtgtccctactcttaaccactgcactgtagactttagtttaaataattaccaatttagttttagggctgatgagttaaagtgattgtatgtggttctatttacattttgtatgtaaccagatcactggcatagctagtacatgcacttaaatactgaagtctcatggaacggtagaactaaaattacctctggggcatttcctaatatgtgactagttttttgttgttgttgtcattgttttcttttttgagacagggtcttgctgtgttgcccaggcaggagtgcagtggtgtaatcgtagctcactggtagcctcctgggatcaagggattcccccacttcatcccctgaagaagctgggactacaggtgtgcaccactgtgcgcagctaatttttaaattttttgtagagatgaggtcttactgcgttgcccaggttggtcttgaactcttgagctcaagcagttcttctgccttggcctcctcaaagtgctgagattacaagcatgagccaccatgtctggcaatgactgttatttaatatgtttgtttaagatcagaaaaatgatgagccatagtgaaagaagaagagatgttagaatcaaatagaccttggattgatttttttttttttttttttgagatggagtttcactcttgtcacccaggctggagtgtggtggcacgatcttggctcactgcaaccttcacctcctaggttcaagcgattctcctgcttcagcctcctgagtagctgggattacaagcgtgcaccaccacgcccagctaatttttgtatttttggtagagacagggtttcaccatgttggccaggctggtctcaaactcctgaccttaggtgttctgtccgcctcagcctcccaaagtgctgggattataggcgtgagccaccactcccagctggattgatgtttaattactagctgtattaccttagtgggttaatctctcttctggaatatgggtatgctcatattgtgaagttttgtgacatttcaatcacgtgtcaaataactagtgttgtgtattagcctggtatactataattgtacataaattgtatgctattgttgttgtgttcatttttatcattcagattaattgttcatatggttaatttttatttttatttatttattttttttttagatgaagtctcactccatcgcccaggctggagtgcaatagtacaatcttggctcagtgcaactttcgcttcctggactcaagcagttctcctgcctcagcctcctgagtagctgaaattacaggcaaacgccaccatgcccagctaatttttgtatttttagtagagacggggttttgctgtgttggccaggctggtctcgaactcctgaccttaggtgatctgtccacatcagcctcccaaagagctgggattacagacatgagccaccacacctggcttcatttggttaacttattgaacttgtgttacaaacttctcattttcatgtgcttgtaggatgtatctaacttcccaatatagctaaattcccttaggatgtagagggcatctgggtaaatctataagaaggtgaagtggcgaagactcaaaacatcatttaacaaaatatatattgaatctaactgtaggtatttaatataaggaaaagaagactataaaggaatagcacagcatccaccattaatatgcataggctctattacactttgagactcatgaggttatttggttataggatatacttaaccctagggttcccataaggatgtggaacatgaaccatagcttgatagtagtacagtgtcaggcgtttgttacctttgacagtctttgcaacaacccatgtagcatctaacgtagctaattgggagcatctttttgggccttcctccagccccagataactgctcaaatgacaagattcacatcaggcaggtgtaggagctgtcctggcttagaagtcttattcctgacagcaaccaatatctcttggaaaaacttcataggcatagattccagggtgtctctaggggacttgctctgctacaagagtgactattgaagtaagaccaaagttatggctatctatcaggggtgtacggttctccctgttcaaatataatttattatctttcacttttgcccatgttggaatagtaaggattgattgtatggattgaattgtgtccctctaaagttcatatattgaagttgtaacctcccagtacctcagaatatgactttatttggagagagggtctttacaaaggtaatcaagtttaaatgaagtcattagagcaggtcgaaatccaatatgactggtgtccttataagaaggggaaatatggaaacagacacacatatagggaagatgatgtgaagagacatagggagaagatggccaactacaagccaaggatagaggcctggaaacagatccttctttcacagccctcagacggaactatctctgctgatgttgattttgggcttgattttggacttctagcctccagaaatgtaagacaatgcatttctgttatttaagccatccagcttgtactttgatatagctgtgcaagcatgctatcacaccagtccaccttaaacaactaaatatcaagacaaagtatgataaaaacaaaagataatgggcagagaaggtgagtcttctgcttaccctatcttactgcctgtagttttcaggccatagagcgggtaggggaaacccaaactgacttagaggtctccctgacttgaggagacagagttgagaaatatagagagcctacgatggttagaatttgcaggaccgattgccagaagtgttttaaaaattcaggagatctggaaagatttctggagtcttagctgattacttactagtcagtgtgtctatacgaggaaagcactgcaaagaaatgggtagaacaattctcacagggccaggaatagtttgtattcttaccagccagagtgacaaaggttcttgtactacatgggccacattatgtctaatgactcaaattatgtacagattcaaactgctctgatcctacctaataagctttaaagaaagcttgaaaaggatgaaagaatgggcacattaaggagagctatggaagatataaaaaagacccaaatcaagctttaagaaatgtaggtggcaacgggatgaaaagtatgttggatgaaattaaatgcagtttagacaatgctgaagaaaaaactcgtgatcatgaaaacataacaacagaaatgatccaaaatgaaacacagagaaaaggctgaaaaattaaataaacagcacgtcatcgagttgtggaatgtcaggcagccaaattctgtaattgaagtacccaaaggagagaaaaggtggtggacctaaaaaatatttgaagaaacaatggttaaaaaatttccaaatttaatgaaaattataaacttacagatccaagaagctcaatgaaccccaattgcaagaaacaggataaaaactacattaagaaatgttatgatcataatcaaattgtataaaaattcacataaagagaaccttaaaagcagcttgagggaagaaatcttccttatatacttaggtattttgcaaatacaaaagtgacagcatatttctcatgaaaacaatgcaagttgcaagacagtgcagcaaaatctttaaaatgctgaaaagaaaaactgtcatcctatattttatacccagtaaaaatacgttttaaaaatgaaggcaggctgggcgcagtgactcacacccataatcccagcactttggaaggccaagatgggcggatcacttgaggccaagagttcgagaccaaactggctaacatggtgaaagccccatctctactaaaagtacaaaagtacgccaggtgctgtggctcacgcctgtaatcccagtagtttgggatgccaaggcgggtggatcatctgagctcaggagttcgagaccacctagggcaacgtggtgaaacctggtctctactaaaaatacaaaaaaattaaccgggtgtggtggcgcgcgcctctagtcccagctacttgggaggctaaggcaggagaatcacttgaggcaaaggttgcagtgagccgagattgcaccactgcactccaacttggactacagagtgagacccggtctcaaaaagaaaaaaaaaagcaaaaaccgccaggcgcggtggtgggcgcctgtagtcccagctactcaggaggccgaggcacgagaattgcttgaaatctgggcggcagaggttgcagtgagctgagatcgtgccactgaggcaaagcgttttctcggatacatataatttatcaccaacagacctgttccacaagaaatgtaaagtccatcaaggagaataccaaatattggaaatctggatctacacaaaggaatgaaaagtgacagaaatgataaatttataggtaaacataacatctttttaaaagacaattaactgtttcaaattaaatgtttggccgggtgcagtggctcatgcctgtaatccctgcactttgaggggctgaggtgggaggattgcttgaagccaggagttcaaggacagctaggcaacaaaatgagacaccatctttacaaaaaatacaaaaattagctgggtatggtggcacataccagtattcctagctactctctaggctgaggcaggaggattgcttgagcccagtgattggaggttgcagtgaactatgatcacaccattccactccagcttgggcaatggaatgagaccctgtctctaaaataaaataacatatattaaatagtaatgtattgcggaatttataccatatgtagagacaaaaatgtagaacggtaacaaaaaggccagggaagaggatatggaagtatatgacatgtgatgtggtataattttacttaaaagtttattgataagttaaagatacgtaatataaacccaaaagcaaccactaaaaaaatcaaaatgggtaggtatatctaatcaacaaaaataataaaatggaatcataaaagaaggctgaaaaagataacaagagatgggacaaataataaatagcaagatagtaaatttaaatccagccatattaaaaaaaatgactcaaatataaatgatctaaataccttcaagtaaaaggcagagattgtgagactgaataaggaagattcatctgtatgttgtgtaagaaacatacgtataagaaaaacacggccggggctgggcgtgatggctcacgcctgtaatcccaacactttgggaggccgaggcaggcagatcacttgaggtcaggagttcgagaccagcctggccaacatggcaaaaccccgtctctactaaaaatacaaaattagccaggcatggtggtgcatgcttgtagtcccacctactcgggaggctgaggcaggagaatcacctgaacccagaaggcagaggttgcagtgagccgagatcctgccattgcacttcaggctgggcaacaagagtgaaactccatctcaaaaaaaaaaaaaaaaaaaaaaaaaaagaaaagaaaccacagccgggtgcagtggctgatgcctgtaatcccaacactttggaaggccaaggcgggtgcatcacctgaggtcaggcgtgtgagaccagcctggccaacatggtgaaaccccgtctctagtaaacacaaaaattagctgggctttggtggtgggtgcctgtaatcccagctactcgggaggctgaggcaggagaattgcttgaatctgggaggtggaggttgcactgagccgagatcacgccactgcactccagcctgggcgacagagtgagactggtctcaaaaaaaaaaaaaaaaactaaatgggtagaaaagatagcatagtaatattaattaaagctgaaatggctatattaatatctaggttatttcagaacatatattacaaccagggataaagaaatacataccatatttataaagggatcaatttatcaaaatgatacaacaatttcaaaacatgtatctaaataacagagcttcaaaatgcacagtgagagaactggtaaaacaaaaggttaaatggagaaacccacaataatatttggagatttcaataaccctgtgtcactaattgaaggaagtagtaaatagaaaatcagcgggactatggaaaacttgaagaacacagccaattttacttaattgatttttataaaatgttccgcacaacagcatcagaatgcacattcatttccagtgcacacagaacatttacaaaatagaccattttctgtggtgtaaaagaggtctcaataaatgtaagatgattcaaatcatacagaatgtggtctgtgaccacacagctttaaataagaaaccaatgccagaaagatctctagaaaattcccaaatatttggaaataaagtgtacatttcccaataatccatgggtcaaagaataaaccaaaaggaaaattataaaatattttgaactgcttgaaaatgaaaacatgagatataaaaattggggatacagctaaaacaatgattagagataaatttatagcattaaacccttgtattagaaaaaaaggccaggtgcggtggctcatgcctgtaatctcagcactttgggaggttgaggttggggggatcacttgaggtcaggagtttgagaccaacctggccaacatggtgaaaccccacctctactaaaaatacaaaaaaattatccgggcatgatggtgcgtgtctgtaatcccaggaggtggaggttgcggtaactcgagatcacgccattgcactccagcctgggtgacagagcaagactctgtctcagaaaaaaaaaagaaagaaaaaaagacatctcaaatcaatgacctactcgtctaccttaagtaattagacaacaaagagtaaatgaaatacaaaatagaagaaataataaagataagcaatccataaaatagaagacaaaaacaataaagaaaattaatgaaaccaaaagccagttctttgagaagagcaataaaattgataaacctctagttagactgattagatagggaaagcacaaattacctttttaggatgtaaaagagggaaactatcattacaggtccgatagacagtatgaacatgttttggtcagtgtgcgttcaacttagataaaataggcaaattatttgaacagtaagttttcacagctctcaagattaaatagataacctaaatagccctgtatttattaaaagaattgactttattgtttaaaaccttctcacaaagaaaagtcctagttcagatggtttcactggtaacttaacaatgaaggaagaaataacaccatttctgtgcaaacacaccaagaaaatagaagagaaggaatcttactctatgaggtcagccttatactaataacaaaaccaaaaaaagacattacaaaaaatgaaaactatacatcatacctctcatgaagttatttgcataaatagttaacaaatttttagtaaatccactctaacaatacataaaataataatgtatattatgactaaacatggtttatttcaggaatgctaagttggtttaacattcaaaactcattccatagtttaggatacaggatcctttaacaggatgaaaaaggaaaaccatatgatacagcaaaagcagttgacgaaatcctacttccattcaagattagagagagcatgattgtatgtgtgtgtgtgtgtgtgtgtgtgtgtgtgtgtgtgtatcttggcaatctaagaagagaactttcacaagctaatgattatctatgaaaaatctataacatctctaatggtaacagactgagtgcttcccctttaagattggaaacaagaacgggatgttcactcctgtttttattgagcattgtaatggagcttctagcccatgtaataaggggaaaaaaaataagagtcataaaattatatatataaaaaaagactgtcggtattcatggataacatggctgtctatgtagcaaatccttatggagtctacaaaatggccactagatctactaagtgaagttagcaaagtcgtgagattattgtataaaaatcagtagtattttggtatactagcaatgaacaattgaatatagaaatttaataacgatacagtaggccaggtgtggtggctcacacctgtaattccaacactttggaggacaaggtgagctgattgcttgagcccaggagttctagaccagcctgggcaacacggtgagaacctgtctgtacaaaaaatacaaaaattagccaggtgtcatggcacatgcctgtagttccagctactcaagaggctgaggtgggaggatcacttgagcctaggaggcagaggttgcagtgagctgagattgtgtcactgcacttcactctgggtgacagagtgtgaccctgtctcaaagaaaaaaccacaacatcaaaaatatgacataatttgggataaatttcttaaatgatctgtaatacttatacactgaaaactacaaaatattgttacgagaatttaaagacctaagtagagatatataatatttatggattggtagactcagtactgttaagattgcagtagtccccaaattgatctgtagcttcaacacaatcccaatcaaaatacgagtaggcttttttataaataaaaattggctgggcacagtggctcacacctgtaatcctaacactttgggagcccgatgtgggcggatcacatgaggtcaggagtttgagaccagcctgaccaacatggtgaaaccccatctctactaaaaatacaaaattagctgggcgtgatggcgcatacctataatcccagctactcaggaggttgaggcaggagaatcacttgaacacgggaggtggaggttacagtgagccgagatcgcaccattgtactccagcctgggtaacgagcaaaactccatctcaaaaaaaaaaataaaataaaaacaaataaaaattgaggtactgatcctgaaatttatatggggataaaaagaacctagaagagccaaaacaactttgaaaaagaacataatagccaggcgcagtggctcaggcctgtaatcccagcacttggggaggccaaggtgggcagatcacgaggtcaggagatcgagaccatcctggccaacatggtgaaatcccatctctactaaaaatacaaaaataagctgggcgtggtaatgtgtgcctgtaatctcagctacttgggaggctgaggcaggagaatctcttgaacccgggaggcagaggttgcagtgagctgagattgcgccattgcactccagcctggtgacagagagggggagattctgtctcaaaaaaaaaaaaagagagaaaaagaaaataattccaggacttcttagatgatgttaagaccttttttttttttgacagannnnnnnnnnnnnnnnnnnnttatttttttttgacagagttcgctcttgttgcccaggctggagtgcaatggtgcaatctcagctcactgcaacctccgcatcctgggttcaagtgattctcctgcctcatcctcccgagtacctgggattacaggcacatgccaccacgcccagctaattttgtatttttagtagagacggggtttctccatgttggccaggctggtctcgaactcctgacctcaggtgatccacctacctcggcctcccaatgtgctgggattacaggcattagccaccgtgcccggctgttaagatgtattttaaaagtagagtgatcaaagcagtattgtttgggtgtaaatatatatgaatagaccaatggaacagaacagagagtcaaaacatagatgcttacagatgctcaatagcttttccgtaaagatgccaaggcagttcattagcaaaaggataatcttttgaacaaaaatggtctttataattgtatagccagttgtttgaaaaagaagatgaacctcaacctttacctcataccatgtacaaaaattaattggaaatggttcatagatttatacagagttaaaactaaaacttctgaaagaagacataagataaaaatcttagtgacctttggcttgaaggagggtgagggaaccatatattacaaaggggctcaaggaaattttggggggtgattgcaagtgcctttttatgagtatatgcacatgtcaaaattcatcaaattgtacactttaaatatgtgtaattcatcagttattttaaatataactgtaaaagaaaatacatcattttttttttctggtaatgtaatagacgttcaaactttgatcaggtcactgcagtgatatagccaaagagttaacctatcgaagtctcacacaaaaaggaacaaggttttgttaactctttactcaacaccaaaaagataggaatagagaagtttatgttggttgtgatacaagaatctgtgaaatcatgtatttgtacaattctccatcttgtataggacaggctgaaaaataggctgaatggcctcttgagattctttcccactcttaagcttctaaaataggagttttggtttattttaatttgaaactacacatattcttcagagaagtgtgaaattacaaaagcataatttcataggttctttgtagcactggcgagaacagatggcgctaaaatctgtttgaggaatgtttgattctctggccttcaaggaatacatttcttttagggaattaggagctgatagtcctcttcttaaaggaatgaaaggagttggtcaaaggtcctctggagaatagtgcagaggagagagatgatgttccattgattattggtatagcttttcctagtttatacataaaagacagtatttaacaatagatatgttcaaataaaagaatcctcaagaagaagcccatgatactgtacctccactgactgcaagaggaggccactgctgaaccccacatgcccaggatagtactgtcttctctcttgtgtacatgcccattgacaggagtggttctactacactggacttctagtcaaactcctggctttccctgtctcccagaactcacaacctcgctgccatatttgtccttgagaccatcagctctaatctcattgtgtttatgtcaagcaccacaagaagttctggactcctagggcatccctcatttatcgtaatttaatttctatctctgtacaccctcctttctgaccccatttcgtattcattttggaaaacccaagatattagttcttgtaagtcttatttgcctctatacatttccttggtaatcttatccagttctatgggcttaaatactatttctaagctgacatcttccaaatgtttgttttagcctaaatctctctgctgttttgtagacttgactgtcttattgcccacttgacatctccacttgcatacacatttcaagcttagcaagttcacctttgacatggtcatcttacaggcttctctatctaaattaatgacagtgctgtcatctttccagttacccaagcccaaaactttagagtcatctttgaatcttcttttcctcattccttgatagacaaatctatcaggaaattctgctgcctctactttctaaatatatctataatccagctgcctctcaatcctgggaccagtctggtctctgacctagatttctgcagtggcctcctaactggtcttcctattagtacccttgtcagtctgtttttaatgtagcagcctaagtggtcttttcttttttttttttttttttttgagacagagtctcgctgtgtcgcccagtggagtgcaatggcgcgatctcggctcactgcaacttccgcctcccgggttcaagcgattcttcttcctcagcctcccgagtagctgggactacaggtgtgcaccaccatgcccggctaatttttgtgtttttagtagagacggggtttcactatattggccaggctggtctcgaactcctgaccttgtgacctgcccgccttggcctcccaaagtattgggattacaggagtgagccaccatgcccagcctggtcctttcaaaactaagtcatatcatatcactcctctgcttaaaaccttccacagatttttcatcccaatcagaatgacacaagtcctctacaccatttgtatttctcgactcattatctctgtgatctctttttttcttttttggagacagagtctcgctctatcgcccaggctggagtgcagtggcgcgatctcagctcactgcaaactctgcctcccaggttcacgccattctcctgcctcagcctcctgagtagctgggactataggcgcctgccaccgcacccagctaattttttgtatttttagtagagacagggtttcaccgtgttagccaggatggtcttgatctcctgacctcgtgatccgcccatcttggcctcccaaagtgctgggactacaggtgtgagccaccacgcccggccctctgtgacctcattttttataactattccttttctgtcactcagctctggccacactgtcctcagtgttccttgaaattccagggcatgctaccttactgccctccagggccttgcacgtatccccatgcagtgggataaaagcctttggcttttccctcacttttttcagtaagacatcctctgactctcctatttaaaattgtacccaccaatactcccagtcctccttccatgttttatttttctctgtagcacttgtcattgtataatagttttatgtattttacttatttgtttattgtttttgtctcctcctcctacacacaagaatataagctctgtgagggcaggaatttgtttgcttgtctactactgaataaagcaagcactaaaacagtgtctggcacgtattagatactcaatgcccattggctaaatgaataagtattttctaaatgaatgagtgaaggcagcctgggcacatagcgtgagacctcagctctacaaaataaaagtaggccagagggccaggcactttgcctcatgcctgtaatcccagcacattgggaggccaaggagggagggtcacttcaggtcaggtgtttgagagcagcctggctatcatggtgaaacccatctctaccaaaaaataacaaaaattaggcgggcatggcagcacatgcctataatcccagctattcgggaggctgaggcaggagaatcactcctgaggtccggagttcacaaccaccctgactaacgtggtgaaaccccgtctctactaaatacaaaaaaaaaaaaaaaaaagccaggcgtgatggcgcatgcctgtaatttgagctacttgagaggctgagacaggagaattgcttgtacctggttggcggagattgcagtgaactgagattgtgccattgcactccagcctgggcaacaagagcaagactcagtctcaaaaaaaaaaaataaccacaaaaaaacaaatgaaaataaagatagctgggcatagtggtacatagctatagtctgtgtacctgggaggctgaggtgggaggctcacttgagcccaagagttggagactgcagtaagctatgattatgccactgcactccagccggggcaacagaacaagaccctgtctcaaaaacacacacacacacacacacaaaaacaaaaacaaaaacaaaacaaaacagattgaatgaagactcatagttgtcaatatgtagattcataggacttgaagatggggtctagcctctggacactagtgaatttcagctaactggaagggtacgtatttacatttttcttaaaattactccaagaaagtatattcttccaccttttccatcgttcttcagctcagtgtttctttctcacttctagttctgttcctcacttatgctgtttcctctgtccaaaatattctttttatatacctgatagcctttagcaaacctccctagaattctccatcccctagacagtgtcactgtttttctcctccattttcctgttgttctttatttctgtaacatgcacaggatgatgggtgtgaatcctgtcctctgaattgtgagcctcttgagggcagagagtaagtctttcatgcttccctgtatccttgtagttgttcacttttcatagatttttcacacctttgtactggatcttcctgtctaaagcctttgttaatcacttgataatgtttgtagaactgaatcactaaaacttattttatttggccgggtacagtggctcacgcctgtcgttccagcactttgggaggctgaggagggaggatcactttagccccaagatttgaaaccagccttggcaacatagtaagaaagaccccatccatacaaaattaaaaataaaagaattaggctgggcgtggtggctcacgcctgtaatcccaacactttgggaggctgaggcgggcggatcatgaggtcaggagatcaagaccatcctggctaacatggtgaaaccctatctctactaaaaatacaaaaaattagctggatgtggtggtgggcccctgtagtcccagctactcgggaggctgaggcaggagaatggtgtgaacccgggaggcagagcttgcagtgaggctgaggcaggagaatggtgtgaacgtgggaggcagagcttgcagtgagccgagactgcaccactgcactctagcctgggcgacagagcgagactccatctctaaaaaattaaataaataaataaatacataaaaaataaaagaattagccaggtgtggtggcacatacctgtagtcccaacttcttgggaggttgaggtgggagggtcacctgagccccagaggtcaaggctgcagtgagcagtgatcatgccactgcaccccagcctgaacgagaaggcgagactgtctcaagaaataaaaacaaaaacagaaacttattttattagatacccaatctatgtgacactaattacaagtgaatcaagatttaaaagaaaatcgtgctaaccacattaactctcagtatagttttatgactattacaagccatccaaatctattcctacttattcggtttactaactagtatattcagcaagtatttatggagtgcctgccatgacaaaggccctatgctaagcctaacacatatacaaattgtatccactcctcaacactctgcttaaactcctctataaatcctttccagttcaaatcgaaaggctagtcattttttaaacatgagatctcagagaggaaattggaagtacatgatgtgttaactgaaagatggattaggtgttataactcttcacacacttctgcagcataatcattcatagaactgtgttcttttaattggctcctgtgatttttccgggactccaagggtgggaaacaccgggaggtaaagctcgtgctgtttcacttgatgtgctaaaatggttcttatgagataatgctcctgtagcatttagctcagcttgctcagtgcctggttcatggttggtgctctggaaatgttacgtactttgcacattctgttgttacagcagttgtttctctgccttttactggtatgtcattctcaataatttgtaaacttttaggaaaggtctttaatttcattatcttataagaggtataggagctacctggttgaattatttgctgctgattttaaggttgctgtaaggttcagtaggcagggtagggaagatgagcatacaaattttatttaacaaattgtttgttaaaagagtacttattatatgtttgatgctgtcctaagcactttgtaaatattaatttatctaactctcataactctatgaaatagttacttttattatcacattttatagaagagggtcctgggacacagagaggttaagtaagtttaccaaagacacacagatagttagagcaaggccagtattcagatactgttggtcgaaggccaggcatggtggatcatgcctgtaatcccagcactttgggaggtcaaggtgggtggatcacctaaggtcaggagttcaagaccagcttgaccaacatggtgaaaccctgtctctactcaataccaaaaaaaaaaaaaaaaaaaaatagctggacatggtggcacatgcctgtgcctgtaatcccagctacttgagaggctgaggcaggagaatcacttgaacccaggacgtggaggctgcaatgagccaagactgcaccattgcactccagcctgggcaacaagagtgaaactccatctcaaaaacaaacaaggccgggcacagtggctcatgcctgtaacccagcactttgggaggctgaggtgggtggatcaccaggtcaggagatagagaccatcctggctaacatggtgaaaccccatctctactaaaaatacaaaaattagctgggcatggtggcatgcacctgtagtcccagctactcgggaggctgaggtaggagaatcgcttgaacccaggaggcgaagtttgcagtgagccgagattgcaccactacactccagcctggtgacagagtgagactctgtctcaaaaataaacaaacaaaaatactgttggtcttgcaattaagcattattcaaggttgaatgtgaatgatggcatataaaaagtacagagaatgtgctatggcatttcaaagaaggtaatggtcacattaatgtctcactgggggttaaagaagtcttcatgctggccaggcgcggtggctcacacctgtaatcctagcactttgggaggctgagtcgggcagatcacaaggtcaggagttcgaaaccagcttggccaatatggtgaaaccccatctgtattaaaaatacaaaaattagtggggcgtggtggcgtgtgcctgaagtcccagctactcgggaggctgaggcagaagaattgcttgaatccgggaggcaagaggttgcagtgagccgagatggtgccactgcactccagcctgagtgacagagggagacttgtctcagaaaaaaaaaaagtcttcatgctgaaattggcattttcaggggactactttttcaggtgcttggccatgggagaagaaaagggaaggtaggccgggcgcgatggctcacgcatgtgatcccatcactttgggaggccgaggtgggtgggtcacttaagctcaggagtttgagaccagcctggccaagatggtcaaactccgtctctactaaaaatacaaagaattagcccgggtggtggcgggcgcctgcagtcccagctacttgggatgctgaggaaggagaattgcgtgaactcaggaggcagaggccgcagtgagccaggaccacaccactgcactccagcctggccaacagagcaagactctgtctcaaaaagaaaaaaaaaaaaacccaaaaagaaaatagtaatgcaaagcctcagggatgggaaatggtaggccatcaggaagtagtcctacatgtaagcagcatgtaaggatactgtaggagggaggcaagatttggggttagagcataggaagcttgagattctgaatggaggacaagctggagaagatgtgacatagagctgtgctttgataagtacgaaaacattgtatgtgatgaatcagaactgatagagattcactgtaggaaaaccagttacaaggtcattatgtccagaaaagaggcaattaggccttgaactatggtgaaaataggtatagatacaagaacattacagaatttgaattgacagcagaataacacaaccaaaatggatagtcaaatatttatatcattatatgactagtgtaagtttgttttatggtcagtaaggtcctttgaatctcttgaaaactctgctcttgttgtaactgagcattatcttaagagaaaatatattcatttatctctaaagaaatatgaagtttctttcattggacttgtaatttacatccaaggaaatgatttcctttgaggccagctaatttattcagaatgtctggattgaaaatgtttcttagtctgcttagtgtagacaaaattagaaaccactttagcctaatgattcggaagaaatgatttctttaaaattgtgatcatctcagtttctttcatgtgatacaaatgtaaattgcaaatgagaacctaaatgtgtctgtcagttggctttgctaagcagaaatcttctagctgactcatcctatttacagaagaattatttcaaagtaacctttggaaaacctgggtagaagtggtttggattagtgaggttgataaatatcagtgtaagaggagtattcaattatagtttggatacctctggtgctttggaagagttataataaagtaaagccaagagatgatgatgatgccttagagttgtatggatacaatacctaggagtaaatttaaccaaggaagtaaaagacttgtaccctgagaactacaaaacgttgctgaaagtaattaaagacctgtgtaaatggaaagatgttccatggattagaagacttaatattgttaagatgtcaatattaaaagtgatctacaaatgattcattgcaagccgtatcaaaatttcaatggcctttttgcagcaatggaaaagccaatattcaaatcatctgtaattgcaaggggcccttaatagcccttcgtggatgttcttgaaaaaagaagaacaaaattggtggatttatacttctcaattttaaaacttacccttacctcacattatatataaaaactgactcaaaacaatcaaccaacaaactaaatataagagctaaaaccataaagctattagacgaaaacagtaatctttcgtgaccttggatttggcattggattcttagatatgaccccaaaagcacaagcaacaaaagaaaaaaaatagatgaattggatttaataaaaattagaaattttgtgcatccaaggacattagcaagaaaatgaaaagacaacctataaaatgggagaaaatattttcagatcatatctctcataagggtcttaagaattcttacatatcggccgggcgcggtggcacatgcctataatcccagcactttgggaggccaaggctggcggatcatgaggtcaggagatcgagaccatcatggttaatacggtgaattcccgtctctactaaaaatacaaaaaattagccgggcatggtggccagcacctgtaatcccagctactcgggaggctgaggcaggagaatggcgtgaacctgggaggtggagcttgcagtgagcctagatcgcgccactgcactccagcctgggtgacagagcgagactgtctcaaaaacaaaacaaaaaaaaattcttccgtgtcaacagcaaagacagcaaggcaaagtgggtatgtgcctgtagttccagctacttggaaggataaggtgggaggatcagtgtcaacctggataacataacataacataacatagcaccatagtctctaaaaaaaagacaacccagttaaaaaatgggcaggccaggtgcgatggctcacgcctataatcccagcactttggaagccaaggtgggcggaccacttgaggtcgggagttcgagaccagcctgacgaacatggagaaaccccatttctactaaaaatacaaaattagtgggtgtgctggcacatgccagtaatctcagctactcgggaggctgaggcaggagaatcacttgaacctgggagctggaggttgcggtgagctgagatagtgtcactgcactccagcctgggcaacaagagcgaaactccatctcaaaaaaagaatggctgctccataggcagagcagtgtcatgggctgcctgactgagtatagttacggtatttcctgattatatgctaaacaaagggttttctgggaaaggggtggggaattcctggaactgagggttccttcctttttagatcatatagggtaacttcctgacattgccatggcatttgtaaaactgtcatgtatgggtgggagcgtcatttagcatgctaatgcattataattagtgataatgagcagtgaggacctccagtggtcactttcatcaccatcttggttttggtgggttttggctagcttctttacagcattctgtttttatcagtggggtctttgtgacctgtatcttgtgctttcctcctatcctaagaatgcccaacctcctgggatgcagcccagcaggtttcagcctcattttacccagcccctgttcaagatggagtcaaacaactctgacagcactacaacttttttattttatttttattttttgagatagtctccctgtgttccccaggctggagtgtagtagcgcaatcttggctcactgcagcctccacctgttggggtaaagtgattctcctgcctcagcctcccgagtagctggaattacaggcacccgccaccacacccagctcatttttttgtacttttagtagagatggggttttaccatgttggccaggctggtctcgaactcctgacctcaagtggttcacccacctcggcctcctaaagtgctgggattacaggtgtgagccaccgggcctggcctgcaacactacagcttataggaggaagaggggagtaaaacaaaataagtttccagttagatgtttaaaggctcaattttaaaggattagatcagaaagttggacaaatgggatgacatgaaggaaaaaatgggaaataaaaacaaattatcattaacccagagctgggctaggtggcatgtgcctatataatcccagccattcaagaggctgaggtgggaggatcacctgagccaaggagcttgaatccagcctggacaacatagtgagatccctgtctcttaaaaaaaaaaaaaaagtgtcggccgggtgcagtggctcacacctgtaatcccagcactttgggaggctgaggtgggcggatcacgaggtcaggagatcgagaccatcctggctaacacggtgaaaccttgtctctataaaaatacaaaaaaattagctgggcgtggtagcaggcacttgtagtcccagctactcgggaggctgaggcaggagaatggcgtgaacccaggaggcggaggttgcagtgagccaannnnnnnnnnnnnnnnnnnnaaactcttttttttttttttatttttttttgagacagagtcttgctctttcctcaggctggagtgcagtggtgcgatcttggctcactgcaagctccgcctcccgggttcatgccattcgcctgcctcagcctcctgagtagctgggacaacaggcatctgccaccatgcccagctaaatttttttttatttttagtagagacggggtttcaccgtattaaccatgatggtctcgatctcctgacctcgtgatccgcctgcctcggcctcccaaattgctgggattataggcatgagccaccgtgcctggccccaaactctttatagaaataaataacaacaaatgatcattaacctgtttcagccaagggttggagtttaacatcaaggtgagttcttacatattacatgcaaaacagtggcccatgaatttttttttttttggattaggtcagaattatcatgttaaatcttttgagaagaataaagcaaaatattagtaactaatttcattgaagatctcaaacataagttagtaaaattaagaaacaatttgaatttcatatgtttttagagggaagttcactcctttgaaagttgaaaaagaaagcagatgtacttaaatatgggacattcttttgaacttagaatttcagattatatatcctcagagaatccagtatataggagaaactacaattagctaaactaattttagctacttgagttcaattcagcaataagacaaaaagtgaatgcaaaatgtatcatgtgcttattaggtcatagtacaaatggcttataaaatgtacagggaatttttgtgtacattgatttgttaatggtgacatttttttactttgtttcattatttggtggccctttttgtcactttaatacgtaatattctgttagttttgtttttgagaagatggagttgcaccatgtcagacagaaaaatgcccattcttgtcagaataaggttatctctttgattgcagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaaggtgagcatttgagctggttgagattatgataatggaaaattatactggacttggacagttagatacctcagtcccgtaacactcactttctagataggtgaccacaaacaaattaattaacctttccaaccatattcttcaggattatgttgactccccaagtggccagactcagagttgcaaatgggatatgtgttattgagggaacaattttgaaaatatgcccttaggagggagggatagcattaggagaaatacctaatgtaaatgacgagttgatgggtgcagcaaaactaacatggcatgtgtatacgtatgtaacaaacctgcatgttgtgcacatgtaccctagaacttaaagtataataattaaaaaaaaaaaaaaaaatatgcccttaggatattgacaagggccagctctgacatttgaaggcacgactaggccccataatgagagtatgtttaggtaaatttgaagcttgttggatgaccattcccacagaatgctaattaacttgacaggattctgaaggaggtttcagtgctattcagaatgtggtctccacaccccagattcactaatcaaaatttgcattttaacgagatctctgtgtgattcaagtgcacattcgactttgagaagcattgctcaagaggcgttacccaaagtgttttctcaggcaccatggtgttaaaaacttcacatgaaaaaataagtcttgtttaatagatttaatctaagaaaccccgtgttaggccagccgcggtggctcatgcctgtaatcccagcactttgggaggccagggcgagagcatcatttgagctaaggcgttcaagacaagcctgggcaacatagcaagaccctgtctcttaaaaaaaaaaaaaaaaaagcagggcatggtggctcacgcctgtaatcccaacactttgggaggccgaggtgggtggatcacctaaggtcaggagttcaagaccagcctgaccaacgtggtgaaacttcatctttactaaaaatacaaaaaagttagcggggcatgctggcacatgcctgtagtcccagctactcgggaggctgaggcaggagaatggcgtgaacccaggaggtggagcttgcagtgagcagagatagcaccgctgcacgtcagcctgggtgacagagcgagactccgtctcaaaaaaaaaaaaaaaaacttagcagataaaatagttggcaaccatatttctatcttcagaatatatttgatctaaaaaaatctgaaaatcaatggattagattgggggtggcaaactttttttgtgaagggccaaatgataaatattttagactttgcaagctgtggtttttgtcaacaactattcggctctagtattatagtgcaaaaactgccatagacaataagtaaatgaatggacatggctgtgtttcaataaaattttatttacaaaagcaggctggaggccaggcaggctatagcttgccaaccccctgacctcaaccattaagattccttttcttgtaagatacttggattcttaattagaggaagaacaaaacaaaatgggggagtgtatcttaaaacctagttcccaaagctgttgtaagcatcagaattgttggttacatgtttattgtggaatatagatttgattttttaaaattttctgtgtgatgatggtcggaattctcaacttctgaatattttgttattattttcaatccctccagcttagggtctgtcttactaaactatttctattgctgttttagtgactggtgccagtttctttgtgttcagtggcgctctgaaatcctcttctggataccttgccaagtccagtattgtggaaggtaaagaatgaattgttcagtcctcataataaggactgaacttatgtacataaagggaatcctttacacttctgctgtagatgtctgactcctactgttttttcagtagcatctcttcagcaaattaaaactgccatgagagtgcttagttctctgaagaaaggagtaagtggtagggataccatgtgacaatgacattaaaactaggagatggcctttcagagctctgggataaggtacctgagggcatgtagtctgagttcaaatatatcattgggtggaaatattaatatctaaatgtgtagatgaaagtcctgtccacaagaatgctgtggtcatcatttggagtacaaaatggcatgtgcttgctgctagtgtgctataattagacatgacacatatgttgacaaaagttaattaaactaaaagctaattggcacaccgtttattttctttgttggttattcattgtgttttgattttgctactcttatttcataacagatggcttaaaacaaccattttatcatgcttgcttatcctctagatcagtaatcttgacagggcaatgcagggatggcttaacactgcttcatgatgtttggagtcttagttgggatgacttgaagttatctgatgactgggagctagaattatatgaaggtttgttcacacacacgtctgaggcctggcctgggatgatttaaagactaggagtggtgactggggtacttacgtggggactccttaacatggcttgataccattgggatagctggactttttacatggtggttcaggactccaaacatgaatgttctagcaagaaggtggaagctgcattgccttttgtgacccaccctttaaagttatattgtgtcatttccaccatactctggtgttggaaaaagggagggaaattagacttcacttctacatgggagaatgggaagatagcattgtagaaaaatgagatgggagatatgaccatttatggaaaatgtagtctgcctcacatgatgacaggttttcatttttacagtagctcactccaaagctctgtgtaaaaacagtcctttcttaggccgggtgcggtggctcacgcctgtaatctcagcactttgggaggccgaggggggcagatcacttgaggtcaggagttggagaccagcctggccgacatggtgaaaccccatctcaactaaaaatacaaaaaacagccaagcgtggtggcgcatgcctgtaatcccagctacttgggaggctgaggcaggagaatcacttgaacctgggaagcagaggttgcagtgagctgagattgtgccattgtactccagcctgggcgacagagtgagactctatctttaaaaaaaaaaaaggtcctttcttagggctggattccagtgtgttgattgaaatacgtagataatcttacatatatttatagatactagctttggtcttcttttggtaaatttaataaaacagtgagtgaaacacagagtgcactaatattttacaactaaaatttacaactcttgactacaaaacagaaacatgccgttaacaaattgttatgaaatctaagaggtttttttttttttttttttttttttttttaagatggaggcttgtagcccaggctggagtacagtggcacaatcttggctcactgcaacttctacctcaagtgattctcctgcctcagtctcctgagtagctgaaattacagttgtgcgccaacacgcccagctaatttttttgtatttttagtagagatggggttccaccatgttggtcaggctggtcttgaactcctgacctcaaatgatccaccaggctcagcctcccgaagtgctgggattacaggtgtgaaccaccacacccagcttaaaatctaggagttaaacagtcatttggtctaaagcaactagttaaagcctatatgatgaagtgttgactatagttgaaattgtgacttcacaaggtgattttaaaacaccccttaaatgttgttaaatgataaaatgagctgggcatggtggcatacacctatagtaccagctacttgggaggctgaggtgggaggaccctgtgaggccaggagcttgaggctgcagtgcattatgatcgtccctgtgaatagtcactgcgctccaacctgggcagtcatctcttaaaaaaaaaaaaaaaaaaaaaaagataaattgacctgacacagatccttaccaattcaaagcagtgtgtttaaaaattatgtgtttatgtgtctggcttgggaatttcttgggtcttgcatttcacttgtgtgtttcagtggagcgattggctgactatgaaattgttattgagactctttagaaattatttcattgtgtgtcagtgaagcagagtaattgctcagcatgtgacaacttttactgtcaatttcagtgtttgccttcaactcaggtaggtagcagctgaaaaagttaccatctgttggttatctggtagcccatatgaaactctgtggtaggtttgccttatttgctagtcaataaatggatttatctccaagcccactactataatttattcagtgatttatttagcaaacatttattgggcattcactgtatgccaggcagtcatagtaaggtgagagagatggagatgcaaacaaatgaatatgaccagaggatgataaatgcaggagtgaaaacaggaacaaaatattcagtgtgtccagaagaagaatgtgactgtgtttaagttttccccttaagtagtctcaggagaaattcttagttgtgtctgaagtgaaatcaacaagcatgtgttttaatcttggcattgcttctcacaacactttcagtaagaggttcagctcaaagagcaaaacctctgtatcagtcagctttggaaagcagagctaaggtttacatttaactcggaggaatttgctagatgccaggtgctgtgtttcatttgcctctcctttggctttgtactgattcttagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaaggggtaaatgcagcacatgtccccctttgtggcttttagttataggttaggctctgggttttgtctgctgtctacattggtgttttatagttttactgaaagccctgcctaagagaaagactgctttgtatgcttaacgtagaattttaaatttctggttttgtaagttagtttctgaaggagtttctgtatgtatttttgagggaagtataagtagagggattgatgaaacaaaaaagtccctctatagttattgagataacagtaatacctgagccttttaagatttacaacacatttttgccaacattgttttgtttgatacaataacaggtgttaacatttccattctataaatgagtaaacaagtaccaaaaggctaagtgacttttcaggtctacaaagctaggaagtgataagactagctctgaaaaccaccttcttgggcttcaaactctgtattctttctcagtgttcggcaactctattctaatggttcaagccaaaaccttggagacatctttgacacttttctttccccctcacccctttcttcctctcatacccagacattcagggacaagctggaaaacattgcatttatacattacaaactgaactttgtatcctttctcaaaggattctacacaacaaagggtgctctttttttgttttgtttttaacattgctatttgatgaattagaaattaaacttaaattcaagtaattttgactaaatgaagtgaatgcctgatatggaagtttaagttagattcgacttttaatacatagagatttggccgggtgtggtggctcacgcctgtaatcccagcactttgggaggctgaggcaggtggatcgcctgaggttgggagttcaagaccagcctgaccaacatggaaaaaccccgtctctactaaaaatacaaaatcagctgggcgtggtggtacatgcctgtaatcccagctactcaggaggctgaggcaggagactcacttgaatcgggaggcggaggtttcggtgagccgagatcatgccactgcattccggcctggacaacaagagcgaaactctgtctcaagaaaaaaaaatagagattcaagaacataaacaggtttgaaaattgttagggaaagtttagaatctgtgtgccaattattttgaatcctaatcagaatgaatgtgtatctccatgtatttatacttgtatttcagggaggaaatgactatcagaagtggcctttttgtttaggaatctaggagtgataatttagcactaaagggaaggtgttatgacagatacatagatacttgtttacactagcactgtcataattagcaacttggtcaaataattcctttttttttttttggagacagagtcttgctctgtaacccaggctggagtacagtggtgcgatcgcagctcactgcaacctccgcctcccaggttcaaggtgattctcatgcctcagcctgcccagtagctgggattacaggcatgtaccactattgcctggctaattttttgtgtttttagtagaggtagggttttgctatgttgctgatgctggtctcgaactcctgagctcagacagtctacccacctcagcctcccaaagtgctgggattacaggcgtgagccaccatgcccagcaaatgattcttaataaatatttattagactcctaagttccaagcagtgggtcagtaatgggaatataagcacatagaggggaatatatcatattccctccccttcagaagttcatttgtaagtcaggtatgcaaacatgaagaatatatcatgacaagtatcattacagagtcaggagcagagtgaaaacaagattgagtgggtgaccatgcattcactgaaagaagggatactggaagaagagcaggtttgattaatcaatttctttacgttaaagagaactagctcctggaaaaatgattccttttttgcatgtgtgttctttgaactatttcagtgcatagattctttcccaagagctcagttcatgtacatttttatacagtggctgcttcttgctatgatgtgctgcacaggtgtgttcagcagggtacccagtgtaattagcaggaagacttctgcagcaaaacgtgataggaaaaatggcttttctaacttcaagagctgcttctatctttcctttgcctctattttagtgtcgtaagtcctatagatgggaagtccatggagactataacaaatgtgaagatattccatggatcagaatataaagcaaatggaaaagtaatcagatggacagaggtaaggaaatgaaacttggcatacttgacccactttgagcacaactttttgctaggccaagagccacattctgggttgactttgtaggataagaaaaaaatatctctgagaaaaatctttctcgtttatactacaattcctatctgaaatcaccaggaagaaatgctgccagttgcagcctgcacctgtctgatgtatcctccttcctgtgaactaacttttagatatttctttgcattggaactccagaagagtagatctctgagtggtacattccatctttgctgtattcttcagaaagctgggtcagttattctgtacttataaactattttagataacatgacggtctttaaaaaatacttatttcactaataagaaaactaggccaggcacagtggcttacacctgtaatcccagcattttgggaggctgaggtgggtggatcacttgaggtcaggaattcaagaccagcctgggtaacatggtgaaaccccatacccactaaaaatacaaaaattagccgaggcatggtggtgcacacctgtagtcccagctgcctgagaggctgaggcatgggaatcacttgaacccgggaggcagaggttacagtgagccgagatcacgccactgcactccatccagcctaggcaacagagcaagactccgtctcaaaaaaaaaaaacaaaaaaaaaaaaaactaggccgggtgtggtggctcacgcctgtaatcccagcactttgggggagaccaaggtgagcagatcacctgaggtctggagtttgagaccagccctaccaacatggagaaaccccgtctctactaaaaatacaaaattagccgggcatggtggtgcatgcctgtaatcccagctactcaggaggctgaggtgggagaatcgcttgaacctgggtggtggaggttgtggtgagccgagattgtgccattgcacgccagcctgggcaacaagagcgaaactccgtctccaaaaacaaacaaacaaaactaaagctcagagactaattaacttgctcaagattacaaggcaaataaataatgataaaatcctgattaaaacccagatctggccaactcctaagctctttcccactgtattaatttgctccttaacttgaaagctgtattagaggctcacctgggaatgagaggagcagggcagtgacccttttttgtatgtacatgtcatatagatcagaaagtttattctcttcatccccaagaggtctgagaaaaaataaaatacgaaaaaaattttaaaagttctcgtaagctggtagatcttagatccctttattacttttgaacctcatgtatgctcatttgtaaaggattaaattataagatctctaggattcttttcagctttgaaactcttatgtttttttaaaaaaattctacgacttctggcttttccatttcacacaaaaggaaacagagacccagggttgttaaatctcttactcaaattcatatggctagttcctgatagcagagatgagacctggttctccagttctgagcagtagtcctaagggactcatcctgcataacaggctccatgatttcatatgcagccaagggattttagttgcttgctatgtaatgattcgtccctttgacacattttgagcagtgcagagtctggaacgtgtaaaacactttatggcttataaagcagtttgacctctgttccctcctttttgctccccagtagcagtgaggtaggcaagctacccatcctaagatgcagatgagaagacaggctcaaacaggtcatgtgactgtaactttgtgactgatgttggttaatggcagagcaggggccagcgctcaggtctcctgactcccactctgtcatttcatgccaccactctccagtgcatccaggtacggggcttcggagctgcctcctttgtagtcctctcagtgtaagttccttatggagcagtaagctaggggttgctatatagaaacatcgtgtatttgcatttctgtgtcttttatattttgcctttttttttttttttttgagacagagtctcgctctgtcgcccagacggcagtgcagtggcgcaatctcggctcactgcaagctccgcctcccgggtacacaccattctcctgcctcagcctcctgagtagctgggattacaggcgcccgctaccacgcccgactaatttttttttttgtatttttagtagagatgaggtttcaccgtgttagccaggatggtctcgatctcctgacctcgcaatccgcccgtcttggcctcccaaagtgccttttttttttttttgagacggagtctcgctcttgtcacccaggctggattgcaatggtgcaatctcggctgactgcaacctctgcctcctgggttcaggcgattctcctgcctcagctttctgagtagctgggactacaggcatgtgccactacacccagctaacttttgtatttttagtagacagggtttcaccatgttggccaggctggtctcaaactcctgaccttgtgatctgcccgcctcggcctcccaaagtactgggattacaggtgtgagccaccgcacccggccttatattttgcctttatatagttttatctttacaataaccagagaagtcaggtgctttccactttacagaggcaaattaatttttttttttttgagacggagtctcactctgtcacccaggctggagtgcagtggtgtgatcttggctcactgcaagctccacctcccaggtccacgccattctcctgcctcagcctcctgagcagctgggaccataggcacctgccaccacgcccggctaattttttttgttttttgttttttgtatttttagtagaaacggggtttcaccgtgttagccaggatgatcttgatctcatgaccttgtgatccaccctccttggcctcccaaagtgctgggattacaggcatgagccaccgtgcccggccgagacaaattaattattaagaagtcctcagcctggccagcatggtgaaaccccatctctactaaaaatacaaaaattagtctggcttggtggcaggctcctgtaatcctagctacttgggaagctgaggcaggagaatcgcttgaacctgggaggtggaggctgcagtgagccgagatcgtgccattgcactccagcctgggcaatagagcgagactccatctcaaaaaaaaagaaaaaaagaagtcctttgggccgggtgcggtggctcacacctgtaatcgtagcactttgggaggctgaggcaggaggatcacctaaggtcaggagttcaaggccaacctggccaacatggtgaaaccccgtctctactaaaaatataaaaattagccaggtgtggtggtgcacacttgtagtcccagttacttgggaggctaaggcaagagaattgctggaacccaggaggtggaggttgcactgaactgagatcgcaccaccgcactccagcctgggcggtgggcaacagagttgagactccatctcaaaaaaaaaataaagtaagtcctttgggccaggtgcggtggttcatgcctgtaatcccagctctttgggaggccgaggtggacagatcacctgaggtcaggagttcaagaccagcctggccaacatggtgaaaccccatctctactaaaaatacaaaaattagccaggcatggcggcacatgcctgtaatcccagctactcaggaggctgaagcaggagaatcacttgaacctaagaggcaaaggttgcagtgggcagaggtcatgccactgcactccagcctggtgacagagtgagactttgtttccaaaaaaaaaaaaaaaaagtcctttaacttcctttagtcctctaacggacttgctcatgacccttcctctatggtgctaggacttaggtcatcagttccaagtgtgttccacttctgcctgtgcacagtgctgacacagttcccgcctctatagtggcagggctgtgtggtggaaaaagctctgcaataaaaggctcagatgccaggctcagcctggctcttcctctgtctcttaaattcttctgtgcccttgagccagtcaattcccttctaagactaattgtaaaataaagcagctgggtcacgtcagctataagagccattctcttagacttaagatcattttctaggtaaattgtccacatacagggattaccttttagtggcatacaatgcaaaatggaggccttttctagttctgagaagaatgtgccattgcaaccatggaggcttgcagggagttaggcaggctgctgctgtcattttgtggatgcagagatggagagacagggattgttttttttttaggtggaagacaaatgcccaacttttcctggaccagggactttatggtgtcctgttcctgtcatgtcttcttgcacatcttggagaatcagggtgctcatatacagtgagctaatctacttctcccaaaatctaggcacaagtttaaaagtctcttttgtttggggaacaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggtatgatgtgtcttccgcagcttttaaagctggccttgggcaacgtctgtatttctgacgtgagtttttctgcatcaccccagagagcttaattctccgaccttctggcctgactggatatagtgtttttggccctctctttaatagtactatacccacatgtgatgcttggtcagattctctcagaaccatttgaactgtggcttcttcacctgcatgccttccaaggagctggtttccttcttagtgtggggtaaagaggggagcatgtggtaggacctgccaggtcctgccttgatgtttacaaattgccagacctctctgttccctcaaccctttagctccgagtcacttggaacttgggtgtaggctcagcttgatcccccttccccactgagtgagtgttaattctgcccagcaagctgcttctggcctgagtgcttatgaggagaaactggttcctgatcacagggttgtgccattatcagggaatgatgaaaggttctgtgtctggccccagttcctgactagtcatcaatcaacaaatatttattttctgcttaacggcttgcccaatgctatactaatgaagtattctggtcctatctcacataaaacaaagaacaagcatttttctgctaaatatgtgagcctcttgagggcagggccctgttacattcatctttggatccctgcatttgtagttgctcagaatggtgcatggatgaacagatggatgcaagaacaaatattcagttcctactaggttagggagctgtacattgtgtatttctcattttaattttcacaaccaaagattaaggtattatttctgatactccatacctttttacacacctctacccttccccagaaaactaagaccataacaggttaagtggcttacccagtgcctcatggttgtcaagtggtcaggaggagtaaacaacaggataagtgatcacccagaaaagaggataaatttgtattcactgccatatgtttagcctatggccaaaaaggacatctcctttcctgctcagcctccttgccctcagccctggagaggccttctctgttcagtaacctctcctccttttctctctgtggtataggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcactctttgtacagaattggtataaaaaggataattccacactgatcttgtcccagttacatcacagctgtttatcaagtagaagtcacacttagatttttgtttttaccagattattcattgaagtgaatcgaagactcaagggcttaatctactcttccagtttcggaagggcaactcagtgtaaatgtcatgtggagagcagaggtgagttcaggattgctggagatctgcccgtgtggatggcaggtattcaactgggtatttctgtgaatgctgatggaatacacccaggacatttttagttataaatactggaggaatttaaaaatacattttattgagaaataatttaaacttctaggaagttgaaagtacaaaaaaccccacgcacactttacccagattcccctcttgttcacttattaacattttgtcccatttgatttgtcagggtttctctctccctttctccttctccataaaaaattgaggcatttgagagtaaattgcgtacatcataggcctttcctcctaaatgcttatttcctaaaaataaggatattctcttacacaactgtaggacagttctctacttcagtcaaacatggatttgatactttaacctggcatctgcccagtgatgttctttgtagcattttttccctccagtaaaccttccagtatagaatcagacatggctatggctgtcatgactcatcttgatcttttatgtcattgatatgtattttttttgagacggagtctcgctctgtcacccaggctggagtgcagtggtgcaatctcggctcactgcaatctccgcctcccaggttgaagcgattctcctgcttcagcctccggagtagctgggattacagacgcccgccaccacccccagataatttttttgtatttttagtagagacagggtttcaccatgttggccaggcctgagctcaagtgatccgccatcctctgcctcccaactcctgatctcaagtgatccgccatcctctgcctcccaaactgctaggattacaggtgtgagccaccgcactcagcctcattgatatttttggtgaatgtagccacccccaaccccaccctgtttttttttttttaacagaaaacaactcagtttgatatttcctcatatttagaatcagtttatgtgtttttgcccataatgacttgatatccatctgccccctcattgatagtggtaaattttgatcacttggtcaaggtgtccaacttctctgtatatccccctacctggaacttataaccagtatatgtagactttcagaccatgcaaatctcttgcctatgaaagtgtcccgttaaattagcatgcattgatgtttcttacctgcactgatcttttactatgtttgcaaaatgattttccaattctagcgcattctccagctttacaggttgcacttggtaatctactataagcagaagcccttccttcccaatttattcatttaattttcattatacactcatggactgttgttttgctttgttttgttttgaaacagtgtctcactctgtcacccatgctggagtgcagtggcacaatcttagctcactgcagcctcaaacttctgggctcaagcaaaccccccaccttggcctcccaaagtgctgggattacaggcatgagccaccaagcctggcctttttcagtggttccaattcattattttggtgcacaaatggtctcagctttagctagacaagagacccttcaagctggctcctacatcctggtgatatgctattttttttttttttttttttgagtacttcttttttatttctatcctaacaagatgcttcaggcttatcttgtgcttatc

SEQ ID NO: 12673 - DNA, 11543 bp, Human; identical to SEQ ID NO: 12071

SEQ ID NO: 12674 - DNA, 151256 bp, Human
  misc_feature (1)...(151256): n = A,T,C or G
cggacacgcacgagacgcccgggccacggaggcgcggggctggcccagggtccccgccaggccgagctctagggctgccggcccggcccggtgacccccgcgctcccctccgtccgctaaggccccgcggcgccgcgcatgcgccccgccgccgcccccgcccccaccgcgcccgcgcccgcgcccaacgcccccaccgcggcccgcgggccatggaacctgccaaggccggcgcggttcgagcgctccggtgcgcgcgttcaggcgcctttcccccgtgagcccggcggcgctcggaccgggccgcccgccgccgggcagctccgcccgcctctagcgccggctgggcgcgcccccgccccggtgcccgcgcgtgcgcgcccccgccgccgcgtgtgagtgtgagtgtgagtgtgagtgggtgtgggtgcgagccgggccgccgacgatgccgcggggccgccccccgaagcccagggagagcaaggcgcgcggcgactccggtaaggcccgcggccgcgccctcgcgccccgccggcggccggtgcggggcccgcgccctgccagtccccggatgcggcgcggggggcgccgggagcggcggggcgggggcgggggccgcgcagacccgggccgccgccgccgccgactggccgggcgggccgcagcgcgggcggaatgatacgggcgagtcgccgcccggcccctccgcgcgctgggcctactttcctgggccgggcggcggctgaggcgggaggcgggaggcgggtgagggagcaggcggccgcctcctgcgcgcgccctgcccccgctggccctgccgcggcccgcgctgaacttgagggaaagtggccgccccgtgttccgtcccggggccggagggccgcggggcgcgctggggaggcggcctggccagagcccgggcctgcggataccgcgccccgggctcctcccggacggcgcccccgcccgaccctgcgcggcgccggctgccccggggacgttgggctcggcccacagggaggccgtggagcgcggggtcgtgcacacagtaggcgccagcgttgtccgggaagcgcagggtcgtgcacacagtgtgctccagtgttatctggggcgcgctgtggggcgtgcatacagtaggcgccattgtgatccgggaacttgaaccctgagcctctgcagacgctgtgggtagtgcatacagtaggcgccattgtgatccggggggctggaaccctgggcatctggagagcgctgtgggtcgtgcaaacagtaggcaccattgtgatccgggtagcttgaacctggagcttctggagagcgctgtgggtcgtgcatacagtaggcatcagtgttatgtggggagcgctagatcgtgcacacagtaggcgtcaggaagtgttttccccagtaatttattctccatggtactttgctaaagtcatgaaataactcagattttgttttccaaggaaggagaaaggcccagaatttaagagcaggcagacacacaaccgggcacccccagaccctggcccttccagcagtcaggaattgacttgccttccaaagccccagcccggagcttgaggaacggactttcctgcgcagggggatcggggcgcactcgccggtgccgcggttcccaggtcgagggcagtggggtagggggcgccgcgctttttctcgcgggcgccgtggttcccgtgcggccttggacgcgagtctccccctgcaggcctggtccctggtcctggtcacccgtgcaactggagcggcgctccgcgtttggaaagggttttgaagggggttctaagggggagtgggcgcctaggactccctatgggagtcggtgggttataccttgactgccgttgatttttatttaactgtttagcttagtgactcaagtgttccccttttcttggggatgagtaaactgaggctcattaaagagcttgtgaccaaacaacacaggtgccccagagaaaggtcgggcctggaaactacaaaggattgtgttaattttgtgtttaggaagaaagaggtaatgggtaggaatcaatgtaaacttattcataggccacaccaaaccaggaattcttgtcgtgattgcacttggtagagttaacacacgtgcacattacggaaacgttggtgaccaacaggcgtttcagcgagctttcgcacacctcatgggcctttgtgggctgctggagagatgttggctgcaccatgacccaggtatgcagatttgtagttggataacagcagtgctcagaattttgattaatggttgatggtgtctggcctttaaggaagtctttgttgcctctcccgcttttgagttttggccttgaccttatttcgttagtttaattgttttgttagtatgccatctgccaaaaataatgtaaggtgcagtgtctcagttacttggaagaaggcttaggatagagaaagaatgtaaaatttccacggccacaggcggggcacccattcccccagtatccccatctcaccgatggtatccctgtccacctggtgtttcaccctcaggcctcaagaattattctatttcttttatcccccaacacacttcctaatttagtgttgcagcttctacctcgggaatgtatttccagtgggccctcctctttccatctccagagataccctctgacccagcctccctctccgggctggagagctgcaggagcccccttcctgggccctgctagtcctgggctcctgtaaataaatctgtcacttgtcagcgtggatgaacttgttaaatgtaaatcagatggctacaccctgattaaaagcgtgcattggcttcctcatccctttaacagaaacccattcctccaggatcctgttgatcgggccttgtctgactcttctctctttccttgctctggcatgcagtcttttgtgttccttgatgccacattagtttttgtcttagggcatttgccatttcctagtctgagaagcactttttgctagtcttgtggctccaagtgatttagcgtcttcagagaggccttcctcaaacctgcttaaaagttacctttcccttctgaacaccagtcctcctgtagcaaagtggttctcaaactgtggttcctggacccctgggggttccctgagatgttttcaggcttctgtaaggtaaatatcatagactaagactgttaggctttttcactctgttaatttttgcactaattgtacaaaagcagttgttggcacaactgctgacatcttagcacgaatctaggtggtggtggcggtgcctaagagtgaggctgtattaccttcatgtatcacagtcaagaagaacaggttgcaccagagaaaatgcagaatagatatgacaatccaactgtcttctgttaatcgagacattacaaagatttgtaaaaatgaaaaccattcttaactatttttggggaagacatatttttcataaaaataattatgttaatgtgtagtagacattttaaataagtaaatattttaaaaattgcttagttttaatttctaataggacaaacatcaatagatataacttacataaactagaaggcttctagggcctctttttttttgttttgttttaaatagagatggggtttcacaatgttgcccaggctggtcttgaactcctgggctcaagtgattctcccacgtcagtctcccagagttttgggattacaggcatgagccactgcttccagctgagggctgcatttaagaatgtatcaaggggtcctgaaaccaaaatgagggacattgctctatcacttactgtgttaatcacatttctcgtaagtgaagtggttttattttctttgttgccctattatgaatttcattcctaagaaaactctgcaagggatgtagggatttttacagataggggaatgaagctcagagcggatacctgatttttttttctttttgagttggagtctctattgcccaggctggagtgcagtggcgcgatcttgtctcactgcaacctccgcctcccgggttcaagcaattttcctgcctcagcctcccgagtaactggtattacaggcgtgagcccccatggctagctattttttttttttttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagactcagtctcaaaaaaaaaaaaaaagcatgcattttagtgttctgccttgataaatataaaacccttcatgtacactaattcctgtattcaacaactatttttttgtttttgtttttgttttttttgagacagagttttgctcgttgcccaggctgcagtgcaatggcacgatcttggctcaccacaacctccatctcctgggttcaagcgattctcctgcctcagcctcctgagtagctggcattacaggcatgcgccactatgcccagctaattttgtatttttagtagagatggggtttctccgtgttggtcaggctagtctcgaactcctgacctcgggtgatcctcccacctcgccctcccaaagtgctgggattataggcgtgagccacagtgcccggcctgttgttgagacggagttttgccctttttgcccaggctggagtgcagtggcttgatctcgggctcactgcaacctctgcctcctgggttcaagtgattctcctgcctcagcctcctgagtagatgggactacaggtgcatgccaccatgccccggctaatctttttgtatttttagtagagatggggtttcaccctgttagctaggatggtctcgaactcctgacctcgtgatccccccacgtggcctcccaaagtgctgagattacaggcatgagccaccgttcctggctgaacaactatttttagagcacttcctgtgataggtgagccctgtgctagggtctagaatacaaagctgaacaagagacatgatctctaggtatccttataaaggtagaaagtgttcatggtgacagattgggcacctgaagtctaggcttcctggagaaaatgttgttaaaattcaagcctaaagagatgagtaagaagaggcccactgaaagaatatttgttgaagtagtcaggacgtgagaagtgagtctcacaggcatcgatggggcagcattcattcagcacttgatgtgtccctggcactatcctggggatagaaggatgagtgagatatgctttttttctttatcataattattttagcaataatgtgaccttgagggaaaccacattttggaatcttgtatgatttccatctgttttctccaatggaatagtgcaaaatttttctttttagcttgcccctttagttggcctcctgctgtttctttttccttttggagggatatttgtaatacttagttcatttccagagagcggagacaggcagaccatgagcccaatggataaacaagtcttttcctgattaggttaccagttcaggaattttcagttttcttggatgaattcaagagcccaaggggaggcaccaccagtgtaagctaggggtagtagggctttacttttttttttttttttgagacaaggtctcgttctctcacccaggctggagtgcagtggcatgatcttggctcactgcaacctccgcctcccaggttcaagtgattctcccacctcagcctcctgggtaggtgggattacaggtgcatgccaccatgcctggctaattttttgtatttttactagggatggggttttgccatgttggccaggctgttcttgaacttctgacctcaggtgatccacctgccttggcctcccaaagtgctgggattacaggcgtgagcccctacgcctgccagactttatcctttgaagcggcaggaggcagccagagctgtaatcccctcaggcttctggtaacagtgcagtccttacttgcttcagggagacagcttctgcttaaaacagtaactttctaacaatatcaggtgtctatccaaggatgaaaccctccactctccataattgaactttttaggtaggccgaaatttggagtatgtgtttatttattttggagacggagtctcgctctgttgcccaggctggtatgcagtggcgtgatctgggctcactgcaacctccgccttctgggttcaaacaattctccagtctcagcctcctgagttgctgagaccacaggcacatgccaccatgcccagctaattttttgtattttagtagagacggggtttcaccatgttgcccaggctggtcttgaactcctgagccaggcaatctgccccgcttggcctcccagtgttaggattacatgtgtgagccaccgtggagtctttagtaatttgaaggaagtgtgattagataacctctaaagattttataatcctggcattaagtagtgacatcacatgggtttaaaaccttggtctttcatgcaaaacgagcttgggaaaagctatagtgtaaaccgtaattccttattagataaagtcaattccacactttcggaatgctttttatatttcaagcctttatgttgtctgtgtgtacagagatagtgcgtctctgctttcaagaaagtagcagtgtttttcaagctatgttttgtcatagaacttttcttcacatgaagtatcatggcaaggcctggagcgtggctctcacccttggcaactcacgcattatggaatctcctgggggaggttttttttttttttggacggagtctcgctctgtcgcccaggctggagtgcagtgctatgatctcggctcactgtaatctctgcctcccggactcaagccatcctctcacttcggcctcctgagtacctggcactacaccctcgtgctactacgcccggctaatttttgtattttttgtagagatggggtttcgccatgttactcaagctggtctcaacttcctggactcaagctatcccctgccttagcctcccaaagtgttgggattacaggcatgagccatggcacccagccggtttatgattgctaagagaagccagaaatgtgtatatttatttgaaacctctttgttgttaggtttaagtaactattttaatcacaaaaaacatctgcctagaaaagtgcacaggttttaggtgaggagcttcatgagttttcctgtcaagccagcatccagtgtgttcgtgcccctcgcagtcacaggccttccccgcactgtcctggcttctgatacgacatgttagctttacctgtttttgttttgctttttcttttttgagacggagtctcgccctgttgccaggctggagttcagtggtgcgatctccactcactgcaacctccgtctcccgggttcaagtgattatcctgcctcagccacctgagtagctgggattacaggcacgcgccaccacgcctggctaattttttgtgtgttagtagagatgggggttcaccatgttggccaggctggtcttgatctcctgaccttgtgatccacccacctcggcctcccaaagtgctgggattacaggtgtgagccacggtgcctggccagctttacctgtttttgaactaaattgaatttatagtatgaacccgtatttttttctggcttgattcattcaatatttatttttatgagatttttcctgttgctatgcagcagaactgtgtttattttgataagtatatagtattacattatatgaacctaccataaattactcttctcctcttgatatttgggttatttccagtttttggctcttttgaataagtgttgctacaaacttttatgtatttatgggccgtagtggatacagccagccagtcgcccagtgacagtcctggcttcctctcctaccagcaggggatgagcgtgcatttgttccgcaggctcggtagcacttattattgcctctccccggagattcaatctttcagcttccctgggccacattggaagaactgtcttgggccatacataaaatacgctaacactaatgatagctggtggagttaaaaaaaaaaatctcaaaaaaagtctcataatgttttaggcaagtttacgaatttgtgttgggccatattcaaagccgtcctgggctgcatgtggactgtggattggacaagatgggcctgtccctttattgtttagctgttttggtatgtatagtggtatctcattttgatttttattttgagttctatactaatacagtttttatgtttgtcagccatttgttctcttttgctaagctcctgttgaagacttggcctgtttttctactgggacatatattaaaattaatactttcttttctagagcagtttcatgcttacccaaaattgagcagataatatggagcagatagtatggagacaccttctgtctctcctcacagtttctcctattggtaacatcttgcattggtgtagtaaatttagccaatgttgatacattgttattaactaaagcccatcattcgcattaggatatattttctatgttgtgtatcccatgggtttggacaaatgcatatttgccgtatagtgtcatacagaatagtttcactgccctttcctccgcctgttcatccatcccttccctgaccaatggcaagcactgatatttttattgtccttatagttttgccttccccagaatgtcacatagctggaagcattcagtatgcaacctttcagattggctttgagtaagacatgcattcctccatgtcttttcaaggcttgataggtatttcattttgttgctgaataatattctactgtatggatgtatcacatttatccatttacattttgaaggacatcttggttgcttccagtttttagcaatatgagtaaagttgctataaatatttgtgtgcaggtttgtgttggatgtaagttctcaagtcattgggggtaaatctcggggactgtgactgctgggttgtatgggaaaactatgtttagttttttctaacaggctgcgaagctgttttccaaagtggttgtaccattttgtattctcaccaggaatgaatgagagtttctgttgtacatcctaaccagcatttgggattaattagttttttggattttagccattctgttaggcgtgtactggatatctcattttaatttgcaatttccatcgtatgtttaatttttaacatacgatgttgagcatcttctcataggctcatttgccatctgtgtatcttctttggtgaagggctgtatgccgttttattactgatttataggaggtctttatatactctggatgagttttttatagtctcctattcactcttttaaagataccttctaatcaattaaacaagttcttaataacaatttgtcagtcctttagtacttttcggatctatttaaataatatttgaaaataagtaatattttcctatgttttcatctagaggctttattgttttacatctttattttatttttttgagacagggtctcgctctgtcacccaggctcaagtgcagtagtgtgatcttggctcactgcaacatctgcttcctgggttcaagcgattcttgtacctcagcctcctgagtagctcagattacaggtgcgcaccaccgcacttggctaattttttgtattttcagtagggatggggtttcaccatgttggccaggctggcctccaactcctcgcctcaggtggtccgcccaccttgacctcccaaagtgctggaattacaggtgtgagctgctgtgcccagctatacgtctcacctttagattgacacttcatctgaatgtgatttgaagagggaaaggtcaggatttttttttttttttacacatatagatacccaattaatctgtagtatttgttggaaataccatttttgtcttttttttacatggttgcaaatcaggtgaagaattgttctgtacttactcttttccactgtttttttttttgttgttgttcctggctagtcagtttcacactgtcttaattatgctattctgagtcttggtatctggtatgggaaatataagtcctccatttagtttttaatttttgcgatcatcttgacaattgttggtacttttcaatttcatgtagatttttgaatcagcatataagttttcctaaaaaaacttgctgggatcttgatcaaattatattgactctatagataatgtgggtggaactaatgtctttacaatcttgagtctttgaatctaaacatgatctctcctatcatttctttcctcgttatcgtctctcggtaatgttttgggacttcaagatacaggacttatacaaatattgttaaatttactcctagatatttgatatttcctgaaactattgttgatggtattttaaaaatttcattttctatatgttgcttgttcatagaaatacaattggtttttaaaaattggtattgtatccaaagtcttttacatatttattatttgtaatagtttagctgtagattcttttggaattttctctgtaatcatatttgtaaatatcaacaggtttatttcttcatttccaatctttatcactttcgttactgttttttctagctcattgtactggctaggatctcttctataacggtgaataaatgcggtgaataagggacattcttgacttgttcccaactgcaggaggaaaattatattattaactagggtgcttgttgtgggtttcttttggggggtggaggtagatattataagattacataagttttatttctattttgctaagttttttatcatgaatgggtcttgaattttatcatgtttactttgtattttttgtggtgatcatgtgatttttcttttatattttgttaatagggtgaaaaacattgatttttctaatggtaagccaaacttgtatccctgggatacaggcaaacttgttgcgatattattcttttttgtatatctggatttgatttgtacatactttatgctttttatatctgtgtttatgagccacattggactacaattttatttttttatattgccattctcaagttttgatactagtattttgctggcttcataaaataggttgggaagtcttcctttattttcttttctctgtaagagtttataataaggttgacattatatggtttttaaatctgtggtagaattccctgttagaatcatctgggctttgagatttctgtggggaaattttatatttttaatttttaaaataattttaaaaatagacatgaggtcttgtcatgttgtccaggcttgtcttgaactcctaggttcaggcagtcctctcacctcggcctcccaaactgctgggattacaggcatgagccaccatgacttggccttttggggaaaattttaaattgcagattcagtttctttagtatatataagacaactgaagtttaaaattttactttgtgtcagttttggtaagttttgtttgtaagaaccatctaatattttaaaatttattaacagaacattattcataagtatctcattatctttttatgactgcaggctctgtagtaatggcccttctctcttccctgatggtggagattgtgctttttcttatttttttcttagtcatggcagggtttatgaattttaacaatcttctcaaagatccaagtttggactttcaattcaatttatagatgtttgttttatattccactagtttcttctctttatcattttcctgcttctactttccttagggttttttttttttttcatttcaagttttaatgaaagcttgtatataaaattactttattcctgcatctgctcaattgtttcttccttatatttgcccttttacttttctacttggcgagatttggctttccgttcaaggagcattttgcggtctttgtccagttttagcctagtgataaccaccttgctggggtgaatgcctgtgtgcacagttggggtgaatgcctgtatgcacagttgtgccattatccttttcccgttgcacccattcaatgtagaggacatatttcttcctgtaaacccagactactttgccagtttgctgacctttatagtgtcctcatacaacctgaacatcatcctttcggatgggcatggatcgaacattgtacttgtctcttagctctttggaaagaagggaagacaaaatcttcctgcgaatgtgggaaggtgcattgaaatgccttttgtggttgttactttggtcagaagtcacaaagggattgaacttcatttgggctgctcccgcttcactgatggtcacaaaagggaagagaactacatatacgccgcttccggttctgtacctacattttattttctgtttttttttttttttctcagcttcttgatatggatactgaactaattttcagcctttcttactttctaatatctacatttaaggttgtaggtattaaggctattggcaattctacagttttaactgcatccacaaaattttgatgtggtttattcttgtcttcactaagttcaagattattttctgatttctattgtgagttctcataagttattgcaaaagatgtggctaaattttgaaattaccttcattgttactgatttctagtttacttgggttgttgtcagagaacttaccttgagttatttaattatttgaaaacttcttgggtcttttcatgttatgtggttatatttggtaaatgttccatgtgcacttgaaaagaacatatatctatttttttctgtcagttactcagaaaagtattaaatattaaattctatgattgtgaatttgtctattcttctgtcaatctttatattttgagctacatttttaaccatacaaattgaaagatcttatattttcctggtatagtaactcttatcattatgaaatgagtcatactttatatctagtaatgacttttgccttaaagcctcctttgtttgatgttggtacacctgcaccatgactgctttggttagtgttctatagtatttatttctcaattcttttactttgtctttctatccttatatgtaagttatatctcttgcaagcagcctatagttaacttttctaagtatggcctgatgatctttgtctttaattgatatgctgattttaagtacatttaaggccgttttgagacatagttttctacttgattcatcattttatattcccctttctttcttgccttcttttggctcaataaagcatttttaaatgtcatttatacctctccatccattagcctgctatttatacattcttttttttttgagattaagtcttgctctgttgcctagactggagtgcattggcacaatcttggcccactgcaacctccacctcctgggttcaagcgattctcctgcctcagcctcccaagtagctgggattacaggcgcccaccaccacacccagctaatttttgtatttttagtagagacggggtttcaccatgttggccaggctggtctcgaacttctgacctcgtgatctgcccacctcggcctcccaaagtgctgaaattacaggtgtgagccaccacgcctggcctatacagtctttataatttttttttctttgaggcagtgtctcactctttcagttgcccaggctggagtgcagtggtgcgagcatagctcactgcagccccaaacccccgggcgcaagtgattctcctgcctcagtctcccaagtagctgggactacaggtgcccaccaccatgcctggctaaatttttatgttttattttttaaagacaggatcttgctatgttgcccttaaacgcctggcctcaaattatcctcctgccttagcatcccaagtagctgggactgcaggtgtgagctaccatgcctggcccttttctccttcttgatagtgccctttgattcacaaaggttttattttcatttatttatttattattattattattttttgagacagagttttgctctgtcgcccaggctagagtgcagtggtgcgatctcggctcactgcaagctctgcttcccgggttcatgccattctcctgcctcagcctcccgagtggctggagctacaggcgcccgccaccacgcctggctaattttttgtatttttagtagaggcggggtttcaccgtgttagccaggatagtctcgatctcctgacctcttgatccatctgccttggcctcccaaagtgcggggattacaggcgtgagccaccgcgcccggcctatttatttgtttttttgagacacagtcttgctctgatgcccaggctggagttcagtggtgcagtcttggctcactgcaacctttgacttccaggttcaagcaattctcgtgcctcagcctctggagtagctgggattgcaagcgtgtgccaccacccctggctaatttttgtatttttagtagagatggggttttgccatgttggccaggctggtcttgaactcctggcctcaagtgatccgcaccccctccccccccccccgccccgcaagcctcccaaagtgctggaattacaggcatgtgctgccatgcccagccttcacaaaagttttaaattttaatagagtggaatttgtgtttgtttcctcctggttatttgtagcttttcgtgtcaaatttaagacactgttgccaaatccgtagtcacgaagcttgtcccttatgtttttcttctaggagatttatagttttagttgttaaattgaagtctttgatctgatttaatttttgtatatggtatgaagtgaaggtctgaattcctttttttctttttctttttcttttttttttttttttttttgagacagagtttcactcttgttgcccaggctggagtgcagtggtggaatcttggctcactgcaacctctgcctgccaggttcaagcaattctcctgcctcagatttctgagtagctgggattaaaagcgtgtgccaccacgcctggctaattttttgttattttagtagagacagggtttcaccatgttggccaggctggtctcgaactcctaatgtcagtcaatccgcccgcctagcctcccaaagtgctgggattacaggcgtgacccaccgcgcctggctttgaattcagtttttaacctttgtatatccacttcggctagaactgtttattgcctcattgaatggtactggcattcttgttaaaaatcaatggatgataaatatatgtgtttacttctgaactctcactagtgtctctgtccttttgccaatatcatactgttttgatgtgtcaatgatactttatgtcaagacacattaaaatggatagatagccattagaattagttatttgtgtatcacttaacgtcacctcacaaattgttggtggtacatgtcatatttagaagacattgcacatttttaggaaatacatacctttgcattgttgggcagcaaactaggctcaaatactcatcatcacatttatcagcttgaaaatgcttggcagagaacattcagtggaggggttaaaacatatggagtgaagtacattgatcttgggcacagaagtcagaaagagacaactgtctttattgtgttaattttcataaagttactatttaggagaacaaccagtctttctatcccatgactaagacaaagggccttatcagctttagggagattatggttaagtaaacattagagctttttactgtagaaaataatgcatagtgcatgtaaacctttaatgcctttatctctcagagacttcactgtggtgggaggagtgctgtgacctgtggaaagtcgtggaaatttcagggattgcagtcgtgatggctgtgattccagatggagtcatagtttacagtgtagtgcaggagttggcaagtattctttatgtcaagggtcaggtggtaaatgttttaggctttgtaggttgtacggcctctgtcgtgactactcagatctgctatatgcctgagtttcagcaaacctttgtgtaccaaaaaaggctaggccacagttacttgacccccaatctagaggaaaagacaggaagagaaaagaaagttatgtattatagcactttacttttgagtaaactatattgatatataacacacagagaagaacagaaattgtggttggctcaatgaatttttctcaaagagaactcacttatgtagtcagcacctagattaagaaagaagacattaagtggcaccctaagaaatcttcactgtgctccatcccagtaaggaccctccttgttgcgactagccactttgctgatttctaacaacgtaggttagttttgcctatttgtttaactttttaaataaaatgaaaccatacagattgttttcttacgtctggcttcttttggtaaaaatgtgagatttgtccgtgtttttatgtagagcagaagtttgctcattctcactgtttgatagtattccatcataaaatctcctccaacatatttgccccttctgttgttggagggcatctgtgttgctttttgttgctgctgttgtaaattgtgctactgtgaatgtttaaacatggcgtttgggtgcacatacgtacacatttctgttggagatgtacctaggagtggaactgctggattataagttatgcatgtatttagctttagttgatgctgctaaatagctttcaagagtggctatagcaattttcatgccctctggcaatatatgagatttccagttactttcttttctcatcaatctgtggtattgtctgtctttttagttgtagccatctgatgggtgtgcatcttaaaaagtattttaaaagttatttcatatttattatataacttggatcttaacaaccctgtgagtaggtaggacagaaatcattatctttatctttgggtgaagaatcaggctgagagagtttatttggcttgctggagactcacagctcttggcaggaatgagactcaccctcaagtcgtctgactccaagtgctgtatttatcagtgtcttcccagtctctgctgtgtatctgtattttgatatacagatatccacctttcaagatgcatgttttattgaacatggggacagaatctcagaatgggctctccacagttctctgtggcgctctttagctctatttatctaaaagttaatatgtgtgttgttttgatgttcacacaaattgtatgtttgtagaggtgaaaacagaataatggcagcaaacaaaacaagaaattatgctatatatagaaaattagttttttgcactgtcaatggaagcactctactttgcaatatgctgctggatcattttcagaaaggccctgttactttcagatcctgagcctagaattcttagagttctggttaaaggtaaggctatagacacttgaggtgttattttgttataatttaatatgctgtggtttttttaaatttgggtaatgtgtgtgtagtgcatgaatatacatttacccaagtttacagtctttctttagaaatacaaatttacaggtagtaaagcaagtatttcaaagggggtcgatgtttctttaaaaaatgagggagaccggccgggtgcggtggctcacgcctgtgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtgcttttgagtgacaggtgagagctccttcttggaagaaagcaggtgcctgtggctggtgctgttacccagtccgagcatttggctttctgagggactctgcaaagaaaataatgcagacttatttcagctggctcctgggaacaaccacatggcccaggtatgtgtgtataaaataagaatagtcaaagggtacttaacaagctggaaaaagattaaatctaacgtaggcagttttgaggtggagagcatgagccggtgaggctgaaatgtgggaatcagataaactggttttgggagcttcagacaactgggaagaggttaaaaaaaaaagctattagggcctatctatttccaaatatttaatgtgtatttgttaggtacacattacatgccaggctttgtgaagcaaaaagggctccaggatccagacacttcagagtttcacctgataaagtccagctgtgttaaaacctgaacgctgacaaatgtggcaggagcagtagaaacagggaagaaagtagaagggagttttaaataaaagaagaggccgggcacagtggctcacgcctgtaatcccagcactttgggaggcagaggtgggcggatcacgaggtcaggagttcgagaccatcctgactaacacagtgaaaccccgtctctactaaaaatacaaaaattagcccggcatggtggcgtgcgcctgtagtcccagctactcaggaggctgaggcaggagaatcacttgaacctgggaagtggaggttgcagtgagccaagattgcaccactgcactccagcctgggctacagagggagactccgtctcaaaaaaaataaaaaaaaccaaaaaaaaaatgttaagaaaagaccgggcgcagtggctcacgcctgtaatcccatcacagggaaaaaggtagaagggagttttaaataaaagtaaagaagaggctgggtgcagtggttcacgcctgtaatatgagcacaaggaagaaggtagaagggagttttaaattaaagaagaggccgggtgcagtgtctcacgcctgtaatcccagcactttgggaggctgaggcggcgtcaggagttcgagaccagcctaaccaatgtggcgaaaccctgtctctatgaaaaatgcaaaaattagccaggcatggtggcacatgcctgtaatcccagctactctagagactgatgcaggagaattgcttgaacctgggaggtggaggttgcagtgagtggagatcacaccagtgaactctagcctgagtgacagagtgagactccatctcaaaaaaaaaaaaaaaggaaaagtagagaaagggtggtagagatgacctaaagcggtagcaatttggagtggcctgatgcctgtcaggtgttccaggcatacttctaacgacagcatctggtctcaggatgagagggtgggagcagtgtgggtgcctggccagggggctgttgtcttagaggaatagggggtgacggagtagggttctgagggtggtgcacactgacagcagagtgaggaagatcaaccatatgttagaacgatttttattcaaaatgtaaaaacaaaaacataaaaagcttgggggttaggtcagttattttagaaagtactcagaagctgaaactgttatatctctcattttaatatgaaatacatcattaagatttatggataactgagattttaaatgcacactgcttacgagtttgtcataagaggccaatttgagttaaatccatggaatgctataaatgcaataagttttgttggaactcggcatccagtagacattttgtataaatcaatgtagggtctctaggtggggaataaaagacctttgccattaagatttagctggttagcctgattgctgggcctgatcggggaagaagagccatttttaagatagcttatctggtgccaagtcatgacagaccaggcctgaatacagtcatggaatagcaggattatggagtgatgggtagggcattgaataaagagatggccgtggtcctaagttattggcaggcccttgtcctagtagctacaggaaacattgtcttatttattccgcacaactgtgagataggctttcttatttttggggtggtaaacagctattattctatttagaatatttatgtaaagccttaaactgattttgaaactagtctctacttaaggcaaacaaagctgctcattttctgatcattgtgcaatcagtttttgtttaattttgatagtttaaagttcttggtagcagaaagggtgaataattaaagcaaacagtggtcatatttttatgtgtgaggtggctgtgtgggtaaactgccttggaattctacatatgcaccccctgtgtatagtgaactcttacagtgacctaccctctgtcttcttagggggcagaaacaggtagctgaaaagtactgttctagatcttagatttgataacagttaaatgcaggcagctttgtgcatattttggtatgtgtgtttgtgcatgagtggcagagaatacctattctgacttgggaggcattaggaatgtctgctgctaaaaacctcaagtccttcttttagctgtctttaaaaaaaatgcagctggggctgggcacggtggctcatgcctgtaatcccagcactttgggaggcagagatgggtggatcacgaggtcaggagctcgagaccagcctgaccaacatggtgaaaccctgtctctactaaaaatacaaaaattagccaggcgtggtggcgcacacctgtaatcccatctacttgggaggctgaggcaggagaatcaattgaacccgggaggtgaaggttgcagtgagcagagatcgcaccattgcactacagcctgtgcaacagagtgagactccatcttaaaaaaaaaaaaaaattagctatcccccagaaggccatcccatgaagaggcggtcattcatttgatcacatgtttctttgatcactggtcccctaatggatttgatgacctctgtggctgcagagacccctgcacaatggaggtgtgtggagacgtgtgcatatgtgcaggtgtgggtatgctgttccagcagggtccacagtctcctgcagcctagctggggctcctttcagttaaaagcccttatctaaggatgcattaattaaggactgtctctttttaaaaaatagagacagtctcgctatattgcccagactggtctcaaactactggcctcaagcagttcttctgcctccaccttccaaagtgctggcattacagacatgagccaccatgcccagccaggatgcattaatttgatagacctcgttctgaacaacagatactctggggaccagaaatttgaatgaacttgaaggcatgatggaccaaaggtgttatttgaggcctgggacactgcccagaaagggctgactttgagcagaaggaaagcaagcgaagtgggggcagtggaggccaccacgtcctggcaggaaggtgtcagggtggaaggtgcttccacagagcgaagggaactggctccctgtacaaaggtgtgcccctaggtagagcaagagtctagaccgccattgggtttcaaaattatgctcagtgtggaaactaaaccatgttgttgtttttaaacaattttccagtcatactttaatttgaattactgttttaagtttgtgtctgaaccaaattaattctgtgttatatcactgtttggaagaagagacttaccgaaataattattattttttgagtttgttaacgtgcagagtcttgcttcttaagataactctttttctggaaaattcttaattcataagtaaagcaacaacatttttctttttttttttttgagacggagcctccctctgttgcccaggctgaagtgcagtggtgcaatctcggatcactgcaacctctgcctcctgggttcaagcgattctcctgcctcagcctcccttgtagctgggattacaggcgtgcgccatcaagcccggctaatttttgtatttttcgcagagggggtatcactatgttggccaggctggtctcaaactcctgacctctggtgatccacccaccctgggctcccagagtgttggaattacaggcatgagccactgtgcccggcctcgacatcatttttcaattttaaatgtatagtccgtatctcctagggttttatctatcaatttcagttaattccttctcatttttgggcaacatattaagtagtttcaacatagaggctgtgaaaattgttttatcatcctgagatagctttttaattttgcatttcagaaattaagttgagctcttttattaatgtactcagcctttaggttaaaacacttgtaactgtgttctgaaaacccaattttcaacagacattttatttgtctcttcctaacctcgaagctgtttcttaccatactacacagttttccaagggaattgtatatcaattgctagggtcccaacaatcattttattttatttatttttatttatttattttttttttaggcagagtctcactctttcacccaggctggagtgcagtggcgcgatctcagctcactgcaagctcggcctcccaggttcacgcctttctcctgtgtcagcctcccgagtagctggggctacaggcgcccaccaccacgcccggctgattttttctgtgtgtctttagtagagacagggtttcaccgtgttagccaggatggtcttgatctcctgacttcgtgttccacccgccttggcctcctgcctcccaaagtgctgggactacaggcgtgagcccctccgcccggccccagcaatcatttgatttgggcctgggaagtcataaaacatttgctgttagttttagtgtagaaattttggaagtatggtctttgaacaggatgtgaatatagttaagaataaatagaataaaaattatgcatatctttttcttagtagactcactttttatgtatgaagttgcagtcttttgaattgcattgtatttcttgaagccggaatttgccttttctcaaggttctgcggaataatgtttgcagctgttgctgacttcctccaccctgtctctgtgcccctcccatgtgggcttcacctacctcctgtcttttggaatctccaggtccttgctacaaggcagattcaactttcagccaggagacttttggcagaaatgggaactgcaggctgttttctcaaaacaaagatttcaaggtctatagaacatttcaagtgcctgtgtttatcacacaaactcttgagaacaaggggctttcttgagctacttggttcttcagcttaccctgtactctactcccaagtttctgaagtctaatatttttggatcaaatttgatacaaatagctgtgtgtaacatatttctggtcttcacatagcaaagtatattacgtatttatgtccaaattataacacttgaagtatatttatttttaaaaattgtagagatttagggcatctttattttacggcatttttgacaagttttgtgattattctgtgatatgttatttgtcatatatagtcttatttgaaaatacttttaagttaaaagcactttacctgggtgggtttatagaagctctttgtaaaaattgaggattgtctgaggcattgcagtcttgtcttcctgaacctcctaagccatgtctatatatgagagagcaaaggttttatttttaagagacagggtcttgctctgtggcccagactggggtgcagtggtgggatcatcggtcactacgccccgaaactcttggactcaagagatccttccacctcagcctcccgaataggtaggactacaaatacgtgccgccatgcctagctaattttttagtagagatggggtctcactgtgttgctcaggctggtcttgaactccagacctcaggcaattctcctgccttgtcttccccaagtgctgaaataaaaggcacgagccactgtgcgtggcagtttttcttttttacttaatcttgttttgcagcagttttgagacattgagtttgtgaattagcatttaaaggctttaatatttctactagagttttgtttactgagtggtttaagatactggagttttgtttactgagtgatttaagaaacaatgtggattattgatgaaatcttaaagtgatttggaggtgaaatgcgtcagtggtttgtagtgactttgaaacactatacagtaggttcacatggtttaagaagcatcattatggcttttgtgtgttttggtgtgtgtggctgtgaagcctcaggaatttagtttaagcttctgaaaagcccaccaatatgtatttagaattctgttgtcccatatcttagtcatctcaatgtttctcatttctaactttaaaacatgtcaattaaaaaaattcagtatatcattaatttcgtctaaaatgtcacataaatctctgacataatttggtttttaaacaataaccaataatttggttttatttatgtgatgagaataacaactggtatttattgtctatacttatgcaattttatagatggagttttaacattgaatgcggagaacactaattatgcctatcaagttccaaacttccataaatgtgaaatctgtctactatcttttccaaaagaatcccagtttcaacgccacatgagggatcacgagcgaaatgacaaggtatgtattttcaaaggtgatgtcaggaatgtgagcgttgaaactggaggtattgtaaaaatgaacaagtaaaatcaaaacttttaatttaggttcctaaatagtagaacattttatattctacaaataaatattttggcctttttaaaagttgtagttgtattcctagctattatttgataaggcgagagagtgagagcttgtcctggtgaatttgtatattgaagttacttatttgtggacaaataattgtttaaaaaatatgactttttaaaagtagtttcaatttcctgtatgactgaacacagaagtggtgtgttttgaagtatttttctccagtggggagttttatctttaagtgatcttgcatttaaaaatggtattctagatgttttaggttgtgtttcaggagggagcaaatattacatactatcttaaatagaaatttgcactcttttttgcagtacctcttgtgggatctgtcaagaattttagtgccttaatggaatgattttcctgatagatggaaagtgacagttaaaactataattaaaaaagtgattgtcaacttttctctaggtaggagcatgtaagctagtgagccatttgagactggaaaaacaccatggacctcctttagagaacaggatgtgaccatctcaggcttgactttcagcacaaatggtgctgctgtagctatgataatataatataaatataatataccagtatgcaccagtattattttctcaggttcgacaatctgaagatactgacttattcctcattaggatcttgttacttcagagataaataccagtgattatctttttacaagtgaatagcagaataccttccattatgggaaaatcttagacctagataagcaaactctgttaaaatctagtaaaattttttatgattattttacctgaagtgtttttgttttttttttgagatggagtttcactctgttgcccagcctggagagtggcaccatcttggctcactgcaacctccttctcccaggttcaagcgaatctcatgcctcagcttcccgagtagctgggattacaggcatgcaccaccatgcctggctcatttttatggttttagtagagatgggctttcgccatgttggccaggctggtctcgaactcctgacctcagggtgatccgcctgcctcagcctcccaaagtgctgggattacaggtgtgagccaccacccccggcctgcttgaagtgattttgtttataatgatggatttggtcagaaatagaagggaaaaatccaacttaatgagttgaaatttttcagagactacaatccaatgaatttatacgcagctttttctttctttttttttttttaaaaaaaagcttcatcataaactctattatttcaatgaatagaagagtttgacagaaaatgtttggaagaaaacattgagaatacattattagaatatgtttctttctctatgtgttcattttacagcggtacccatacacacttacaaacggcaaatgtaagcatgcatacttagacgttcaacacaaacccatgtcatgcaaacacatggagaaagaaaccttttttttttttttttttttgagacagagtctcgccctcttgcccaggctggaatgcagtagtgcaatcttggctcattgcaactttggcctcccaggttcaagtgattctcttgcctcggcctcccaaagtgctgggattacaggcgtgagccaccgtgcctgggcacagaaatatgttttaataacatgttttaaaggttatctttgaaaggtgtttcattgtcaaacacttatactcactgaaagaaaacagcttatatacagcatttcttattagaaatatttcttttgtgtatgtatgtgttttcatccttataatcctttcagtaattctgtcaggtgctttactgtgtttattttggatttattgacttaagagccagaggagacttcagaagtttctgtagattgtctgtacattatggtacttgttaatattttcatttattgaacaagcatctgtgaaaagattgtatttcagtggcttcttcacttttctctccaaatagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagaggtaatcatcatcattttgcatatactttgttaactgattgttaaaatacatctgatcatgagtcaggaggattttagatataaacttgttttgaaagccttttgtgtagatttcaaggagtgaattgtcattagatttgccttgacaccagttgactgataagacattttattttctggccctgtcaatgccttagggtagagacattttaatgtgtagtatatttgaaggatcaaagtatatccacattggctggcagaggctcctcctggcgcctcaccctcctctttgtaaacagaaactaacatttatacgattctgccatggccaaaagtaacttttctgctttgaagatggtagaatctccttgcttgctcctgggtcctctgactgtgagaatctgagggaagagaatcatttcatgatggcccaaagcagcttatacaccaaagtgaccactcctgggagctccacaggcccaatgtctgggacagctttgaggatgacaggccacagtgctgggttgggggctgaatctaaggtgccaatggctattgcttaaaaaatatgctcctccttcgtcaggtgcagtggctcatgcctgttatcccagtgtttgggaagctgagataggaaaattgcttgaggccaggagtttgaaaccagcctggacaacatagtgagaccccatctctaccaaaaaaaaaaaagaaaaagaaaaccttctctgaactccccctttgcattattactgtagaaaattaggaagatacaaaaagttaaaggagaaagtcatctctaattctgagataattactgataactatttggtatattttcttccggagacagaaaaacacagtattgaaattgcatattcagacgatccctgactgaagatggtttagacttaatgttttttgattttacagtggtgtgaaagcaaacacatttcttagaaaccttacttctcttgtgatgttaggcagaggcaatgaactgcaactccctgtcagccacacgcttttggcttgtgatatttccaattcaccatgggtttatcaggatgtaatcccattgtaaatcagggagcacctttataaaatttacattgtgaaagctgacttcacactttctgttttttgtttttttttttgagatggagtttcgcttttgttgcccaggctggagtgcaatggcgccatcttaactcacttcaacctctgcctcctgggttcaagagattctcgtgccatagcctcccgaatagctgggattacaggtgcctgccaccatgcctggctaatttttgtatttttagtagagatagggtttcaccatgttggccaagctggtcttgaactcctgacctcaagtgatccacctgccatggcctcccaaaatgctggcattacaggtgtgagccaccgcgcctggcctgacttcatattttctacgtgattttggatcctgtttttatcaatgtctttactattttaaagtaatttatttttatctcaacatcttataatacaagtaatgcatatttattttggaaaaaaattagttataaaggtaacattaaaaccacccatagtggactttaacaaagctgaacacatagaaacagcaaagtggtggttaccagaggctgggggatagggggattggggagctgttggtcaaaggccacagtatttcagttagacgggaggagtaagttcaagagatctgttgtacatcatggggactaagttaataagaatacattgtatgtttgaaaattgctggctcggcatggtggctcatgtctgtaatcccagcactttgggaggtcaaggcgggcagatcacttgaggtcaggagttcaagaccagcctggccaacatggtgaaaccctgtctctattaaaaatacaaaaattagccaggcatggtggcaggccctataatcccagctactccggaggctaaggcgggagaatcacttgaacccaggaggtggaggttgcaatgagctgagatcatgctattgcactccagcctgggcaacagagcaagactctgtctttaaaaaaaaaaaaagaaaagaaaagaaaaagaaaattgctgtgagagtagattttaagtgttctctccataagaaatatatatgtgagataacgcatgcaaaacaggttgatttagccattcctcagcatataccaaaacatcatgtggtacaccataaatatgtacagttttacttatcaatttaaaaatcaattagttaaaaaaattataagaaagaaaacatactatgtggagagaatgcatttgtggtatttcaaacttttttctatacatgcttttcttaatagtttatgtttaaaatagttttttaaatacaaaaataggattatgtcattatacagactacttttgtaacctacctttttccataatatattgtaaatacctgctccctcttttcactcatcatcaaagttatcactcattatcaaatattaatattttaaattattaaaatctgcagtatctcgggtgggtgtggcagctcatgcttgtaatccgagcactttgggagaccgaggcacttgagctcaggagtttgagactagcctgggcaacatagactgtcactacaaaaaaaaaaaagtctttggcatctggatttagcatagtaaaatttaatagttttcatcattgtttaacatttacattgtttatatttttaaatattgtaagtaatatatctttgcatatgaatcttcttatgcatctttaattatttccttaggatggattcctacagttagattaattgaattaacaaataagacttttttcccccaagttctttatagaatgccatatgacattctagaaagtacatgccaatttaacaccttctcttgcagagtttaggaatgcctgtgtcacttatcaatagtgctattcaaaaatggctatagttatatttatatttttatttatttttggagggagaagagtcatgttctgtcccccaggttgtagtacagtggcatgatctcagctcagtgcagcctctgcctcccaggttcaagtgattctcctgcctcagcctcccaagtagctgggattacaggcgccccaccatatccagctaatttttatatttttagtagagacggggtttcgccatgttggccaggctagtcttgaactcctgacctcgagtgatctgcccacctcagcctcccagagtgctgggattacaggtatgatccactgtgcctggccagttcaatttcttaaaagccgaaaatgtattaaataatggtgtattaatatattttggaataaatcctaggtgcacacggtaagaaatcaaacaatagagaaggctatagagagcaaaaagttacgtctcctttgggttcctaagttccagttttgctcctcagaaacaactttcattagcagtttcttctgtatccttccagggacattctatgcctatacacatctcctctgtacccttattagtcaacccataatattctgtgccttttcatcagttaactatgtgtcttaagtgtaattccacatctgttaatcagagagctgtcactttctttttaacaggtgcatggtattatattgtttaaatgtgtatcataattaggaagtcactgctgttaggcatataggttgtttccagccttttccagacaaagctatggtgatcaaatatttttgtcgatgtttgagttctcaagatgggcagtgtggtatcccagaggacatttggttatcactgttgtggggctgggcgtgggtggggtgcttctgttatcttgtgagtagaggatgctgccgaactccctgcagtgcccagcacagcctccattgctacgagtgacctggcccagaacatcagtagtgtgaggttgaggaaaccctgggttaatagaaatgtgagatatattcctgcaaatggagttgttaggtcaaaggatatgtgaattcaaaattttgatattgtcaaattgttttccaaagagattttgtcagtttatcctccagccaataaatggtgtgtaagattgctcatttcttcataccattttctttctctttaaaaaaattattacttaaaaaaaaatagaaatcaggtctcaccatgttgcccaggctgctcttgaactcctggtctcaagtagtggttggattataggcgtgagccactgtgcccagcccattttcttttctttttttttttttgagacagagttttgctctgttgcccaggctagaggcacaatctcaacccactgcaacctctgcctcccgagttcaagcgattctcctgcctcagcctcctgagtagctggaattgtaggcacctgccaccacgcctggctcatttttgtatttttagtagagttggggctttgccatgttggccaggctggtctcaaactcctcacctcaggtgatccacccgccttggcctcccaaagtgctgagattacaggcatgagccgctgcacctggccagccatcccattttcaatactctgttgtaaaagttgtctcctccaatctggtaatttaaagatagtatgtttttgttttaatttatatttctttaattatgagtgaagtttagcatctttccatgtttattagccatgaataatatttttattttaattaagtaatttttttttgcaaggtggatgtgtggggattattggtcttattcttgcaaacttgtgtaaagtatttacattcctggaaagttaggtttttctgccttgtgtgacaaaattatttcttggtttctggtttcattatttttctcttcctggcagaaatttttaaattgtcatggactcaaattttcagtctgttcatttatggattctggttcttatggcttgattagaaatgcttcccaattctaaaattattttctaaaatattccacacgtctggaacatcccacactgatctgcctggtacagatcctcatacatgcagagcagaactcgcatggaagggatgcatccacactgatgctgcagtgtagcccatccccgcagggcctccctgcctccccctagttcccacgtggaccacttctctcgcagggcttccccatgtccccccagttcctatgtgggctccttctctcgcagggcctccccgcctccccataattcctatgtggggtccttctctcgcagggccttcccccagttcctgtgtgtgctccttctctcccaggacccagcgcctggcagcaccagcattattactcactctctcatcctgaatgctctgaaggagccgtctgctcagccaggacccccatggtcttcctgtccaacagccctcagggttccacatttctcaagccagccccccgaccctacttcagatggcaggcacaattagatatggtcttcctcctctgccgtggttttgtgaagtcagcagggtcacctacttcactttgctgccatgtgggacctctcccttcccattcttatgattccaggccttcagttaaccaccctccttcaggttacattatctgacacaaaagacacagtgcaaagcagaggagagtagaaggctcggggtttagtttttgaatatttggatattaaccaactgttaaaagtcaaagtgacacaggcaggtacacttggaggagagcccatctcctgcacccttgcccgcccactcacctcggcctttcccgggctgccttcctgctcttctagtgtgtctctgctgtgtctctctttgtaatgagaagcaaatgtttgtatgttcttattttctttttctggcttatcataatgtgaaatttagaattttatatagttaattataggctggtatttttattgttctaaatatttagattcaggggagaactgatcatgtttataatgttgaatctttatgagaacacggaatgtgaaaacatcagcgatgtttggttactatggattcagtacactttttacgtttcttaagtattttaagattctaatgatattgtgtagggaggtcttttggccatatgttgtgttacgtgcctgtaggaaagcgatgcatttgtgtgtgttagttttccctgccatcctccctgattctctatgcagcctcatctacacataataatcgggtagtaagtttttggttctgtgttgttgcaactagcatatgcgcagtttttaaaaaaaaatcacccttatatcatttattcgttttcatagtatgtagcgatggcatattcacttaactttttattttgaaaaattccaatcctaagtgaagatttgaaataatagtacaatggatatttgtataaccttttcctggactcaccaattgataaatttgccagatctcacctccccccttctcccttttttgaacaattttcaagtaatctacagatttcacgttattttaccactaaatacttcaggatgtagcccctaaaaacaaagacacttttcttcatttcacaaaacagtgatcacagtttaacattgctgtaatatccattttcagaggtccctatctggaggggaaaagagtgacattttacaaggggagcagttagttttgaacagatgagatacttctcttttgaccctggaagaagtggaagagggctcaggtggaggcgagtgcaggtggaggaggaagggggaaagggctcagctggaggcgggtgcaggtggaggaggaagggggagagggctcagctggaggcaggtgcaggtggaggaggaagggggagagggctcagctggaggcgggtgcaggtggaggagaaagggggagagggctcaggtggaggcaggtgcaggtggaggaggaagggggagagggctcagctggaggcgggtgcaggtggaggaggaagggggagagggctcagctggaggcgggtgcaggtggaggaggaagggggagagggctcaggtggaggcgggtgcaggtggaggaggaagggggagagggctcagctggaggcaggtgcaggtggaggagaaagggggagagggctcaggtggaggcgggtgcaggtggaggaggaagggggagaggactcaggtggaggtggaagtggagcagctcctggtatgtcttgcacgtgttcccagctttcctcagactgtgctttcttagtgtctcatgaagttttttatagactttcaggcagaacccaagggtctgcgtattaaccagttagatctgtatgatctagtaagtatttctgtcttaataacttaatagttatttgaaagaccaacccgggtgtgttgggtactgcacagcgtctgtatccttgcatttcctatttacaatcattcgtacattgattttggagttttctcttccacgtggttcttcacttcatctttgatctttaaccacagcaaccgtggaaacttagcttcacaaagacatgatgttattgaaactgaagtacctcaatctagtttctgggtgttattggtcaagtgtggagcaccgctgtttcccttgaacatgtgacctattcctgggcctcctcataagcttgttatggtgcactgcagtgcctcagttcatgggctggggctgaggccttagagcccacatttctctgggaaatggaaacattactctgtcttcaccaaaaacatggggtggcctgaggcatctagagatctgcatggggtgcctattttgggaaatgagagcagagcctgagtggggcacatctgtgggtagccctgggagctgagagcccatctggttgtggagtctgggctgggcgggggtatggtctgctttccaccgctcagccgctgggaggagtggagatggtggtttgcctggaggtgggggcttctgaagcatgtgctgtggaataacaaaggagtcagggccatgggaatgttggcgggagagctgaaatgttgagccgtgtggtctaggcagagaggtgaaacttgaggggtgtgcgtgaaccctctgttaggatgacacaggtaaaggtggttgaagatgtctgtgcatgccacatgttctgggtggcccaacccgaggacgacatgaagggcaaagattacctctaaggctacacccatctacaggggtcaccagcacagtgagctttaccgttttccattctgaagttccttcagatgtgccttttaatacttcactgtgatttcctccatcactggaaagagaaacaactgttagctgtcattcgcagatgttctaaagtatttataccttattttgaaaaccttcccttcgtcctgttttctcttccacagatgggccaggttctttccagatcacttcccacagtggtgctcacattctttgctgtttgcttcagtccctgcctctgctgttgtgtggttttgttatgccgtggtctcctgggtaggaccacatcatctgaactttgtgcagcctactctcatccaaaccctcagttctgtttgtaaaactccagctcccttcgtctcttgctgttgtggttgtaagaacttacacattccttcgcttctgactcctttttaaatttttttgaaaagtcttttgagaaatatgtgttttctgaaatcgcttgactttacatttctattactactcacccctgcttctggtttctcccttcagcacacagcaggctgtctttgattaataactgctaacaggagaagaaagcggggaagagtcatggaagaggctttgctgaagtctggcgtgaagctggtgagggagctgtgaggatgcttcacagcttccttggcactgtgtgtctgtgctgccggaggaagggttctggaagttgggctgtcacattcagccacctgaacttagcaccctcatactgagctcaagatttacatgagcagaggggaaaaaggcctcattgtgcttgttctgtaataacgtgttggcaatatgttggctctcttttttccaactgttgtgttgatgcttaggtcagagtttgtgactgtgcctccctcacctggcaggctggcgtatgtggtacagagctggtagggcagccgtgccctcaggtttgtccaacatcttcatttgttatctctgagttctttgcttctgaaccatggtttacagtgagaacgggaggaggaaggtgcactgcttctctttaaaggcgttatctggaagatgcatttcagtcctgctcacattcagttgggtagaacgtagtcatcaggccagtgatctagtggttgggcggctgcgaaatagtgttgagttgattagctgtatgctcagccagtaagtctattattgcataagaaaggaagaatcagtattggagcacaattaaaagtcttttccctgtatgtcaaaataatacattccttgctgcctttgcattttgtgtttgatttttcagttaattgatttgaatatggcatattaatagtaactagagggataatttcttacctttaattgtatttaaaaataacctctaaggttccagccacagtggagcagcttccttctcctaggggtcccccgtatcactattgttagagataaccagccaacaggcacagaaggactctgaaaggcatcagaggtggcggacggttggagggacttgaggaataatgtggccgtcagctcccattatttcttttttcttttctttttgagacagagtttcgctcttgtcgcccaggctggagtgcagtggtgcgatccagctcactgcaagctccacctcctgggttcaagccattctcctgcctcagcctcccgagtagctgggacgacaggcgcccgtcaccacgcccggctagttttttgtatttttagtagagatgggatttcactgtgttagccaggatggtctcaatctcctgacctagtgatccgtctgcctcagcctcccaaaatgctgggattacaggcgtgagccaccctgcccggcctgggtttctttttttcttcccagacacctggacacggttttgaagaagcctgcagccttctgccaacaagcggagaagaaaaacactccaagaaaagctggtttcccttagccagtactgggaaaaggttggtccaacagaacagaaaatctttttatggtatttactcaattccaatgaaatgccaactgaaaagctgctcagcggagccgagtacagcattgaacttctatcccattctgcccccgtcccttgggagctggcagcacttcgatttccccggtgcttgggcccaagcagggagctaaccttgcatccaggagggggattctcctggcagagggaggagacacccagaattcccctcccagcgtgttggcagagtctatctttggaagcccggcttccatcctcccttagcagaagcagggagtgttctgattctccctccagagtgtgtcagtgggtccactagggagttgggcctccctccccatcagtgatgagacagaaccatgcaagacagacaagtctgcactgtgctttcctcccactgcggtcagtggggctctgcgaaatgggtctctgctgctgctggtccttacactgcatctgaacagggcagctgctgctcaaaggagagcccaagagctggtcccacagtttaacacccaaagtgtctaggacacagacacgagccagcacagtccctgctggaacaaggaaagagcggtatcaatatgaagagagcctggacattggaattacctgacaagtactttaaagcagctgtcaagaaaatgctttatgagttttgaaacaaatgaaaaaacagaagaaagaaatagaagaaataaccaaagggaaattatagaactgaaaaatcccatgattgaactaaagaactcagcagaagggcttactggtggaccagagaggacagaggagaatcagaggagaacctgaagatagagcagcaggaatgacttaggctgagcaacagagaagaaatagaaaaattaacagggcctcagggaactttgggacaataacagaaaattctacatttgcatcatggtcatcacaaaggataggagaaagagtgtggggctggaaatgtatttgaagaaataatggctgaaaacgacccagacttggtaaaagtcataactcacagattgaagaattccaaacaggataaacccaaagaaatacacaccaagacatatcataatgaaacgtttgaaaactaaacctaagaaaaaaatcttgtgagagactagagagaaatgatctgttgtttgcagaagaacactgattcaggtgacagcgaatttctcatctgcctccatggaagctaaaagaaaatagcacaaaaattttcaattgctgaaagaaaagaattgtcaattacaaattattcttcttcttttttttttttttaaattagagacggagtcttgctgtgttgcccaggctggtctcgaactcatgggctcaagcgatcctcccacctctgcctccaaagtcctgggattacacatgtgagcaaccatgcctggctacaaattctatatgtggtaaatgtccttcaggaacgaaggagaaataaagacattcttagatgaaggaaaacaaactcttgctagcagacttacccttaaagaatcactgaaagatctccaaacagaaaggaaatgacaccagaaggaggcttggaacttcagaaaagaaagaagaatggtgtggtggttaattttctgtgtgaacgtggagagtgtttttggatgagattaacatttaaaccattgagtaagcagattgccctccatgatgtgggtgagcctccttcagtcaaagacctgaatagaatgaaaagactgacttccccaagtgagagggattctcccgcagacggcctttggttgtcacttacattatcagctctcctaggtctccatctgccagcccacgctgcagatttggggcttgtcagcctccataatcatgagacaatttcttacaacaaatatctttttttttttttttttttttaagacagagtctcactttgttgccgaggctggagtgcagtggcactgtgtcggctcactgcaacctccgtctcctggattcaagcaattcttctgcctcagcctccagagtagctgggattacaggcatccaccaccacacccggctagtttttatatttttagtagagatggcgtttcaccttgttggccaggctggtcttgaactcctgacctcaggtgatctgcccgcctcggcctcccaaagttctgggattacaggcgtgagccaccgcacctggccaacaaatatttacacacacatacacacacacgcacatgtgtttgttctgtttctctggaaaaccctaacacaaaaagaataagtaagaatacaaaattggggtgaatataatacactgttcttctccttatgaattcttaaatcatagttgatggtcgaagcagaaattatcatctagtgtgctcagtgtacatggaggaaatactcaggacagtgatatttaaagagggaaaacggtacaagactctgaatggaaataaggttttccgtacttctctcaaggtggtaaaatgtcaatgccagtagattgtgataagttccgtatgtataatcctacctagcacaatctccaagaatgccatacaaagcaatgtactcgaaaatactactaataaatcaaaatgaattctaagaaattctaaaaagtaatccaggaagggaagaagagaagcagaggaaaagaaacagtgagcgatcaacaaataatgacagacttcagccttcagataccaataattactttaaatgtaagtacgtgaattaaaagacattgctggctgggcacggtggctcacgcctgtaatcccagcactttgggaggccgaggcgggcagatcacctgaggtcaggagttcaagaccagcctggccaacatggtgaagccccatctctactaaaaatacaaaaattagctgggtgtggtagcgggtgcctgtagtcccaggtacttgggaggctgaggcaggagaattgcttgaacctgggaggcagaggttgcagtgagctgagatcatgccattgcactccagcctgggccacaagagtgaaactccatcaaaaaacaaaaaacaaaacaaaacaaaaaaaacctctcatatgatctaacaatacattgtctccaagaaacttactccaaacataaaatggcccagcacagttcctggcaggtagagagttcaactagtgacagctgttggaattattgctttttaaactattcaccacttaggacattcagagagccttctgaagaaagccacttcgtttggtagaaagtgcaggtactttgaggtctgggggagctgctgttgctccttcagtgaggttgaagatgaagtgagatgaaagtcagtgaagcacccagcagtttgttgggtgtagacagtattgggggcaccagtgcagggtcccctgaaaccttggaaataggaataaaattgcttcctaagggttaaactctgaaatcatcaacattggattggagtagtaaaaagttacagttaaaatgggtgcatttgttatatgtaaagtatgcctcattaaaattggtttagaaaataacctgtaaacatgtcttcttaaatatacttaggaactaaattaactttttagtttaaggtgttccgtttttaagttttactttcagaacactgaaatctaatttttagttactgctctattgagatttatagtctaaaattcacactggtcactactctgtccaaataaatctcaaacccagaagagtaaaccagaaaaattactgtagtttttaaatcacttaggaatttttcttaaaagtcacataattattgaaggtcacattattttttgagtaaatcacttcccttaaggggtgttacagaatgtttggagaaacaacacatgcatgcccacacacactcaacacaaacaactttcccacggaagacattgttcacatttattgatcatctcagtggcacgtacaaatgaatagtgatggatcaggttctgtaagtgttgagggaagagcagcgttttgtggggtgggtttggggtttattttgtgtgttgagcagtagccgaggtcagcagaggcacactgcattaggaaaagaagcatggcttctgagaaggccaggacaggagacaggatgatgatgggggggatcctggaggggattcggagaaggggaaaatcccaaacactcggagtctggtgaacacacgctgccatccgagggccggggttggacaggagagcagccttgatgcagtcagtacctagcattgcacgctctggtcttttagagatgatcgtatcttcagcaaggtggagacagatgaaaatgccatgcatttctcttgatgatttcccatggccacttagcatcatgagaattaccccaggacagcctctgcctctaggtgagagatgtgatgttaactctgtatggagggtgcagtaagtggaaggcccgttgtcctagtggcctgtgactatacatggggtgttgttcttcttacagaagaacacttcctcaagtgttgccagggcgcgcagggggagggaggagcatcgtggctctttttggcttgcaggagagaaagcagaaagacagtgatgtagccgtctgtaagctggcaggtcttggctgtggcctgggaggtgctggatcctgctcgcaccatctgagcacgtcgtgcataaactggggttgtcactcagacagatccaacaaatgcctgagtaatatccgtgtagatatccctgaaacacatgaatcagatcatttggtaaaagagtaagtgaaaagagggtgggtgtgagccagggcagtatcagtacggagaggagcgggctgcgaggggttttgtgatgtgattttgagacaggaggcatagtggggaatcattggtaatgaaagcagtgcattttgttcagatgcattcaggactgcagaggtttttttttttttttaagagctgcatcaaattatgatttttttttgtggggagtttcctagaacaaattttcttttatcaacaagtcactaaaaatttagtagtttattatttccttaaattattatacaataatactactttaaagttatttaaatgatttttggatttctcaaaacatttcacttttctttgtctttttctgcagtgtagctagaggtagtatcaattaacagcctcattttaatgaggtttacaaacatttatttacaagactagtatatgcagatcagaaaaaagtctgataggaaaaaatcaatgtatttttatttggaaataacagtttatgctcattgacaggtcatgttttttcatgtttgtacagttcattttgaggatcatttaagtaaatactgtaattgtgtgatggaactccaaatgagtgaattaactgaaatttgtactaagtcagcaatggctactgatgaagtaattattgagttctcactctaggccacgcacagtcagcgtcttacaggtgtcattttgtctaacctcgtaacagccctgtgagggcaggggtgattgttatccctgtttcataggctcagggtgggcaacacacccaaactagcagcttagctagtgattggcagccttaaggtgaacctagacccagctgtagaacatctagaccagcatcatctaagtgaaagatgaggaatttaaaattttctagtagccacatttttaaaagaaaaaaaaaacccaaacaggtgaaataaatgttaatatatttattaaaatatgtccaaaatatgaactcaaatatgaaagattactgagctgtcattcttgtatttttgctcggagtctttgaactcctgtgtgtgtgtgtgctgcagttaccccacgccttgcttcagagggtccctggttcacacgctcagtcagccgggccacagcctgcactctgctctgcctctgaaccaagcaagacagtgatgtggtctatctactaaaaacttggaagctggcattttgtttcaaggtcgtctcttaaaccataatcttactttgaattctttcctgaccctttgtagtgctgaggtcatcctacttctctctaaagcgctcacagaataggcggacccagtgccattacccaacaccacttcgaagcagaactcattttgctcaaaaattgtgtcaatctctcacccttttcccaatgtttctgtctttttcttccaataaagaaatgatttttgtatattcaaatacatttttgagaggtgaaagtgatgcttgttccagaggaaagtattagatcaaaatcaagattagagagaccaagtagttttcatttaatttgtgtattaaccgttgatcataccagttctttgaaggagtggttttgaaaggtttgctctgctcaccgatgggttttctcttccagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattaggtatgagtcattacatgggcttggtcaaaaatccatctaatatgttaaaagctggcgcactttggtacgacccactggaaatatttgctgcaagaacccagcaaagtggaaccccacagataatttggtgtcagaacgtcttttataacatgcatggtgcatccctacacattaatgaatagtgtcaggctatgtgagtagaagtgtttacctagtattataatgttgaaagctgtagaacaggatactggcaatacatgtttatgggtaggtaacaaaatatgtcaactagactcacaagggtttaattagtactccttttaataaattagtttgtggtacccaaccgttaaaactcatatgtgcctgacactgttcttagcgtgtatataaacagaacctcatttcatcattacaaacaaccctgttaggccagagtacttttatgttcccattttgcagatgagaaaaccaagattagaggaaccaagtagttctatgagattttgtagcttataagtcaggagtttgaaatttaaaccataagagtctgattttagagctcataatcttaacaactgactatatttgaatgcatttatacatttattcgtagtcaaacttaacatgtttttaaaaattttatattttgcctaattcctgataatatatttttactgatgtttctgtttcttaataaagtgaaataaaatattcttcctggccctttgctcaagttagctaatggtgataatcagttttcacactaatttagctaatttctccaacaaactctaaaaggcaatattgggccaggcacagtagttcacacctgtaatcccagcactttgggaggccagggcaggcggatcacctgaggtcaggagtttgagaccagcctagccaacatggtgaaacccggtccctactaaaaatataaaaattagctgggtgtggtggcacatgcctgtagtcccaggtactcgggaggctgaggcaggagaattgcttgtactcagaaggtggaggttgcagtgagccgagatcgtgccactgcactccagcctgggcgacacagcgagactctgtctccaaaaaaaataaaataaaataaaggcagtatcaattatcattttaactactatattatcagtttagcttgccatccttctaagctgcaatgtttaggaaatatctgtacttcttaacaacaagaagttccgtgccagttgattaccacagtttataaaatgcctgaagactctaatgtttatttagcctcttagacattgcatttgagaaatgtggactggacatctctgtatgatcagctgtctcctgtctttttcattttgcctcttgttgactaatgtggtacgcacctaatgctttatgatttcagtgatttttttttcttttttccccaaccaatttgatggtaatttcagtgatttttaaacccccaaatataatacatggtctctatacactccagatttttattctcatgaggctttaatgcaggcatttttgatgtttccttggaggtttgaaagatgattgaagatgtttaggtgcttgtggcactcagacagtcctggcttctaggtctttccagactgaggagcaaaccagacagacgaagcctcgccctcacagaactgccctttagtgagaagataggtagtgaccaagtgagtgggttagtcggtaccacagtttcagatagtggtgagtgtcaagaaagaaggacagtgggatgggtgtgtgcagtgtggctgagggaggctggggaggcagctgttgtgcgtgggcctttctgagtggggcttttggaaggagactggggtgaggagcagggagccctgcagccttaggggacccacctttcaggctgaaggagtgtgttggtggaagcagtgagcctccctggtctgagaagcaggaaggtggctggggtgaggagagcctgcccggcggggctgcggatgtgcatttcccatgagtgagatgggagtccttggagggttttgcacaaagggaatggtgtgaccagactttcgggtggcactgggcctggtgtgtgggcaggtgtcaaaagcagggagacctttttggaggctatggaagcagtgcactggagagccgaacccgttctgaggccgcaatggtggctagagggtggagagacatgtccacatttgggggtgtttcagagtaagaccagcagcttttggagatggactagaaaaatccagtgtgactcctgagacttaaatttgtgcaagagggagctttcgtgtcttgacatggaaaggagcaggttgggaatcaatgaagagttctgttttggacaccacccatgaggcaatgccaagtgagagttggctgtccagggctggagccagaggaggaggcagagttgctggaggtaggagtttggacatcattggtatgcagatggtgcggagagcaagagactggaggaggtggtgtgggtcaggtgtcagtgtagaaattatacccgtagcatctttgtttctgaccatcacaggtaaagctttgtctagaagagacattttgctccccctgtcccaatttctgtttttgacctggaaaaaacaaattttttttcatcaaaaatagagaaaaatgagttttatgatttttaaaactaacacatatacacacagacacatacatatatgtgattgatttatcattaaaacaggttctgatgactagtcagccaaattttctggtaggattttcattttgaaattatggtacaagggagacatcttactgtgtattttgcccccctttattacactagggtatcaagtacaaggtcttataaccggaatatcgacagaagtggattcacgtattcgtgtccgcactgtggaaagacgtttcaaaagccaagccagttaacgcgacacattaggatacacacaggtatgaaaacactgacttctggatgactgaccgtgtggctggaagggaagaacaggtgcctttttgctagctcgacttggaatctgatcccagctttctcatagtttgctggataatcttgctgaaattagttactctttgtgtgattttatttcctcacttgaaaaatgtggctcttttatctgtatatagctgtcctaaattatacattaacaaatatacttagtgctcattgaaaagtgcttgatacatggtaggctgttaataattgggggttgatgttattactgttattggtatggtatttattccctcatttgttgttactgtgtgtcagatattatactgcactaattagagctaaattaacaaagaccggatgtggtggcttacatccataatcccagcactttgggaagctgaggtgaggggatctcttcaagccaggagttcaagactagcacgggcaacatagcgagatcctgtctttacaaaaaatacaaaacttagccaggcgtggtagcacccacctgtagccctgaagtgggaggattgcttgagcctgagagtttgaggctgcagtgagctatgatcgtgccactgcactccagcctgggtgacagagcaagaaggtcctgactcttaaaaataataaaattaaaaacaaataaaataaaaaacaaggaagcagtggattttcatattcttttataattttgccttcactacgctatgaaacattgaaataataaaactatttctccatgccttatcttgttccttagttttgcttgaatatttgaaagtgagtacagcattcatagctgaatactctttgccatcttgtaaagagcagcctggttataatattgtattagtaacacgcatgatctctagggaaggaaaaaggaaaattgtacgaatatttttagtatttgaggtttgcaattaaaatgatccatgctttgtccttttgttttcttctgtatttcttgatttggttttcttttatagtgataaagtaagaaatctcacagctattttgcttggctgctattgtttgtcaagcagttctattatgttacattgctttttttttatttttcagagttttagtgaatatttctatgtagagtattgtggagtcattcagatgatttcaatgtttatatgtcagcataaagttaatatttttagagcatcagtttttatttattttctagagtaagagagaaagaaaacaatgcctttgtaaatgtgctaatacattgtgtctgtagagtattcagctttaatgtgtagtctttgaagttttaatcaatgaaaaaatagtttaaaaagttataaactttacccaaagtagagataaagtaaaaagtaaagcaaatccttctcgtgttcacttctcagttgtcatttacctttaacagtttgatatctaccccattagatgttttttacgcgtacataaatataccgacatcatgagcatactctcactcctagagagacacatgcgtgtagaatcacatacttaggtgtcattttgggattctgtgatgctactcctcctgcattgaacttgaagcatgtgtcacttgctccaattggcttgtgagctgcctggagagagcagcaggtcccagccccaggagtcacgtaggccggtgtggtttaaacaggaggctggcgggcccgggtggaggtggcagggagtgcctgcttgctgttcaggcaattccgtgttctgggcttggtcttccaatagctgtgcctcacagtgtgtgtgatgatgtgaggggggtgaccagaatcctgctggaccatgcctggattgtgtatgccccagcagggctcctgtccaaaggaggctgagtacattgcagcatcgtcatctagaacaggaagggtatctcttcgcaggcagtgtcgtgactgggccacactctcgccgtgcctcctgcctgcctgccctcctctcctgtctgccctcctctcctgtccccacgtaggcagtgctgtgactgggccacgctgtcaccgtgcctcctgcccccctgtcgtcctctcctgtccccatgcgggcagagccgtgaccgggccacactctcactgtgcctcctgcccgcctgtcctcctctcctgtcgccacacaggcagtgctgtgactgggccacactcaccgtgcctcctgcctgcctgtcctcctctcctgtccccacgcaggcagtcccatgtccaggccacactctcactgtgcctcctgcccgcctgtcctcctctcctgtccccatgcaggcagagccgtgaccgggccacactctcactgtgcctcctgactgtctgtcctcctctttcacacccttgccccctccgagttaaagcagggatttttaccatttgtgtactgtccccaagcttgttatatctcattcacttatttaaccctaaagctgttcagagaagcagggatctgatgttattatgaactcagctgctttctgtttcttagggagtgaaaatttagtaagactagaaatttaagtagccttgcagttaggttctaacctaactcgattttgtctttttgctcattccttcattcatcagatccgtactgcatgctagtgtgcacagggccctgttctaggtgctgaagagccgcagcgcacaagcacttgccttcttggagcgtgcattctagggaggggaggtggacattaagtaaaatgtaaaaggtcaaatgctgagaagtctgcagaaaaatcaagcagagaagggggctaggggttcccagggaggacacaggagattttaatgttaaatggaatggaccggaaagtcctcagtgtaaagacgattttgagcaaaggcctgaagaatctgagagagcaagtcttggggatactggggcaagaaccgcccaggcggcggatttcagaggcccggaagtggaaacctgcctggtgtgtctgagggcggtggcagaagtgggtagagggagcaagagagcaggggcaggggagctgacaacagctggtgtgcgaagcactgcactggcgcctcctctactgagtattagaagaacttcgattttactctaggggggattggaagccattgagggttttcagcagacaagtgacttgctcagacttaaagagggtcattttgtctgttgttttgagagcagcctaggaaggggccagggtggaagcagtgagtcaagctgggggtggtttcaggagctttgagtgataggggagtgccttaccctggggtggtggttgtggacgggaagcagggctgctctgggtgtattttgaagttattattgagtgtgagacgtgagagaaaccaaagataaggatgactccaaggttttttgcctgatcccctggaaggatggcattgcctgatcccctggaaggatggcattgcctggggaagcccacaggtggagcagtttgcgagatggtcaagtgcagttttgacatgttaattttgagatttaaagtagacacttgtatatatgcatctagagttctggggagacattttggctggagggataggtttgggtaacttcagtgttgttcttttcaatccgtaagatgcccatacaatatggaattatattttgatcatttttctcccactctaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtaaacacgggttgggggcataagcggtatttcacaggggacagtaggtatcttttgggttaataaacggacctgagaaattcttttccatttaaaaaaatgcagattgattttgtgccgagcagaccctgttttaaaaaatacatacgtgggaatttttttggtttattacatgtggaagaaatataaactactatcttttttgtcttcttgctgacagcatggctttggggaataaatatttgaaaataatcctaatacctttgttagttatagtctgtcattctaaataatgtatttcatccctttagcaaacttgaaacacaggcaagtgtaagaaattaaaagataagaaataaaattgggaaaaaaaagtgtttttcttactgctaatactacagagctcatatggtacatgtccgttccctcttggacagaggcctgctttgttcatttccttccatgctgcttgtccagtctttcgactaaaatgatgatttcctgtggtaattttctgttgtctacagagcatactgatgtgtagatcctgcaagtatttctgtaaagcaggtcaacctttgctctaactaaccatcgtgacttattgatttatattctaattgtagaatacaaagaaatatttaaacaacacaaatacttttatcatggatcagtatatcctatggaatgattttgcagaatgaaaactatcatattcttgggagcaaatgtgtatctcttaattttttacttagaataataccttaactaacactgaagtgaacttagagttaatactcactatccaaatttaataaaaacaagtagaagctgtctttgatcttagataaacagaatgtctaaaatgaaaaagagaatctaaaatgagaaaaaaaccctgcacatctcacgtagttttatgaacagattcacagttccatgttcaatgagttaatctttttagtatctaagacccagagacattaggaaggcatgtcagtgttagtgaggtactgaggttacctttagatttcggaagaataaatttgggctgttgtaagtcattcttgtggtgttgcctctgggtgaagatgattgcataggaaggatcgtctatttgtgtagcacacagaaatgcctcactggaaccttagaggagccttgtgaggtacttgtcagtactcctgagtttagaaaactccccctatgctaaagggcccagagactcacctgttgccactgagaagtgctctcggacctgcactagaatgggttgttccagaaagagcctctaaagattggttcataaatattatccaattttgtaagaatctaaatttggttcttagagaggcaccagaaacagaatggaagtcttactcaagttcggaaggggccaatgggttttcaagctagccttcatagttctacagtaactaacactgggttttagtaatagagaaagaatattttaggtattttctctgttcacagctgttcttactcattttactggtttccatggtttctggatttatcatagctttaaaaattagttgttaggccaggtgtggtggctcacgtctgtaatcccagcactttgggaggctgaggtgggtggatcacctgaggtcaggagttcgagaccagcctggccaacatggcaaaaccccatctctactaaaatacaaaaattagctgggcacgatggcaggcgcctgtaatcccagctacttgggaggctgaggcaggagaatcacttgacctgggaggtagaggttgcagtgagccgagatcacgctgttgcactccagcctgggcaacagagcatctcaaaaaaaaaaaagaaaaaaagaaaattagttgttgatacagaatatcaaaattgatgaaaagttcatatatcattatgaccatctttcctaacctctgtggttttggccatctgaaagcatatttggtgtaatatgtatttatatataactgtctggcctttgctattgaacattgtattcaactgtttaaaaaactgagaatatcttatgcctgacagtttgtttttgttaaattacaataattgaaaaatgtgttttctcactcttgaataatttctattttatagaaaagactgaaatttcaattcatcttataccggcaatattgtttaaagagtagggtcattgattctagaactatctaatttaaaagaaaaaaggtaatgttgaagggttagattatttctgtcattttgaatggaatggtaaattatgatttgccataatttagatgtttaaatttaacaattaattgtaaaacatcatttttttcctttttattctttaaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggtaagtttagtaatttggaagaacttctttttaaactaaaatctgtcattttaaatatgacctttacaattgaatatttagtagcaaaaaggtgctatgaaaattttttatatggagaaaaggtgctactttttaaagaattaaagtcaatcttttaaaatttgagaataataattagatgactgattcagactgtcatctgaacctgtgaaaataagacaaactgtaatcattaatttgtgaaatgatgatttctacagtgttattgatgattattgaatattctttaaattataatttaagaattaattatcctttgtaggtaatatttctcttttcttatgtgacagtgataatttttcctaagtctttggacttttgaaactaaattatatttttcagtacatgtagttaaaaattgtatgactctaaatacatatgcctacacacagagagacacaggtgcgcacacacacacacacacacacagggacatacacccactcttattttttctgtaggcgtctttagctcagtctcatttagttactcgtactgcactaccctctcaacagattaataaatggtaaaatttaagcatcaactataggtatcttaacagtagtagacattaaatacgaaagtgtcggaagttttaatgtatgcttatgaatgcagttacttggttgtattatgtcaacagctgcctcctaccagtatggaaaataagtctaattaatacttagtttttaaacattaggtttacctttagtgtttgttttttcttttcttttttcataatatttgcagtgtgggatggttcctcaatatattcttgaccaggtagaatgttgtaaaatgaattataaagctggagaatagagtccaataattatgtcttcaaaattctattttggtctgaatttttttaaatacaatttttaacgttgtgtaaatcaaccgagtattagttttcatcatttcctttggcaatatgcaaatcaaaacatagatgtagtgaataatctagaaaaatagtccagatcattttaaacatttatattctcaataaaaagaaatgtaattatagggatttagaaacctggaatctcccttatactcttacttgggcaggtaagaacatagcagtttttacagacaatttgggcagaaagtacagagagctaccatatactcctcttctcttgtgctcagtttcccacatttctgacatggtgcatcggtcgggtacatttgttacaactggtgaacgaatgtggatatattattattagtaaccaaagtccatagtttttgtcagggttcactctcagagttgtccattcaacgggttttgacaaaggtagagtgtcctgtccacaccctcacagtgtcgtatgggtagtttccctgccatccgttttcttctggatgggacatttcggattcccgagccctgcaggggtgggactggctctctctcccatcacagccctttcctctgacttaggttttcttggctgtagcattacagcgcctttattcctccagtctccttgcaggaagaattttttcacaaatgtgttgaattattttgactgcagtggtttctttcctactttttaaatttgtgtaacttgatattttaaaaattccttcacttcaattttatgggctaacaggaaggtgagggttcacgtgctcaatctgccatcttgagtctctatgctcactggaaaaaactgtacaaaattgcattagaacaatgtattgagtatattaagagccaatatcgtgccaaacaccagaatcagtgaggcattatatttaaaatttatgtttaggatactcttagattttaacacccttaaggagggtattgcctgttttttttttttttaattttcctttttaaattgaagagcaaaattgtatttttaatgaaaatgtttctgtgtttcaggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacaggtgaagcacgcttccctgcggtgtgaggcttacgtgctcgtgctgggtcagaaaccagggatgataattgagaataaatctgcagggcttgtcaaagtcagggtatcctcatgaaaaatgtgcctgaaccgaaagaaattaatatgcctacttaattgcttatggacggcgcaacattcaaatgatttattcatctatacattaaaaaaaaaatcacaaacttttattttttttccataagtgaactttacttgaaaagaacaggcttttccgaagttgtatctatttatgttgacagaggtggaaaaagcgttttattctttcttgaggttctggtttatgatttggagacagtcatgggtgttgacaattctgagagcgttcatactgcctggccttctctcgtgggtgtgtgggcagcacctgcacgtgtgggagaggaggggggcaggagcgcagagcccccagctttctagtccaccgtgacttcacactaactcttcactcctcctgtctctctgttacttgtttaaccttcctcctgtaccttcatggggaagagctggccaggggtatgaggaatctcagggtgtcgttctacagccgatacctgaaagttaaacccagtgtaactcaaaagccttaaaatagggattcccaagactatttagagacaaccaaagttgtgtgaggtaagatttctgaaagtcaaataaattttaattccctttaatttagaaatgtaaatgcttatattattttgggtgggagcaagatgtcatatcatcagaaaggacgttacagcctcaaagggttggaagcctcacttataagtgatgacttggaattgtagattcttatttcttggagtggaattagaattctataggtaaagcttttgactgattttggtaggcagagttgggccatcgttaccttctaaccttttagttttgttctgtcttagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggtaattttcctaaactttaaagtttggacatttgggatagcatattgctggtttttaagaaatgtgcccttcttttttcctctgaaggtgataggatatgtttgttgaatgttttgtagctagctgtagttggttggtatttaaaattaaaaagaatgacagccataaaatgcctgaaacttatcacttttctttaacctggcttctttcctgtattcagtttctcctgactcctcgccagggcttgaaagcttcttgtctctgtctgttctcttgaaagcttgttgtctccgactgttctctctctgccctgcttaggcgcctcctctccactcagatccatggctttgcttcagttcttctcacccttggtgcttctggcatccagccatgtgattttagtagcctctgactagtcctttcctcttcatcatcaaaggacccctgcagcacagctccctcctccacacctcaccatttcccattacacaccaagatccatttcttggctcctgagtatcctgtcacctgtcccctgcatttccatccgccctccctctgtgcttctaggcacaaacttattagacatcatactgaaactggattcctgctgtttctaggcatccctgtgtttctgcacatcatgctttctgcaggctttctgcagcaaggatgccttccttctacctcttcctctggtctctgtcaaatcttggccgtcattcaagcatcttcagtgctccgtcattcaagcatcttcagtgctcctcctcgtggatggactctgaggggtgcttttccttgtcctacctcccacagcacttagagtgtttaggattcctgcgttctctcatgttaattgtgcacagatgcagtctaatatcccttctaggtaataagctctttctggccaggaatacagccttctcatttctgaacaccccacagtgctcaatatggctctttctacaggagcaggaatttactacatctttcttgaaaaagacagattcctgtgtttttggcaaaactgttctgtgaaaacctttcccagttgtcttggggaacaagtgcattcttgctacaaagcatggaataacattgccatttctgttaacacttctttcctagaatacattttctcatgtataacatgattctgaagttcttgtttctcaaaccacactagtcaggctcttcttccccttgatctggacttcttctccccaaggaaagacaggatgctggaatctaagcagtttctcccgcacagtttcctggtatctggcagggcaggaaaggaaaacaggagccatttccgtatatttcgattagctgtgtggtagtcttccaggttacaggtgtgttttgtattcctgagaatctgatgcagatttattacctctgtgcgagtgcccgcctgagccccacgggctactgtctctagtcattgtgctaaatcggatgctttcacatgggcagcaagccactgagtgaggagccacgtcagaccttctccttcctgagagtacacatagccatggtccttagaccgagaaggtgagcaccaccccgtgctgctccttccagaccttcacccgcatgtgctggtgaagcagctttctccctgcaccaagtactagccagggaattccacatggaattgcaagaaaccttcctgtacggtattctagtttggggtgctgtgtttacagagttggtaacaattaggtactttctggactacttgaatcaatcaaatacacatgtagagtactgagcaagtgcatgcagttctaataatttcccattacattcatgggatccctagtacaagttggagccagtgctttttttttttttttttttttttaagtgacctctctaatatggtgatgagaaaaccattggggatttttattttttttgagactgggtcttgctgtgttgtccaggctagagtacagtggtgcaattatagctcactgtagccttgaactcctgggctcaagcaatcctcctccctcgacctcctgagtagctgggactgcaggcatgtgccaccacatatggctagtgaaaaacacttctttttgtagagctgaggtcttgctatgttgcccaggctggtcttaaattcctggcctcaagtgatcctcttgccccagcctcccaaaatgctgggattacaggcatgagctaccacacttagcctggggacacgtttctatataaagatgttccttttaattaaaacttttcaattactagtgtacttttaacatagtgattatatctgaaaatacctctccaaggatggagtatcatttgatatcttagaaagaccatgaggaaaactattcttgtctcgtaagtcataacattaattgcttataactaaccttcattacgttcctaagttaagcatactccgccatgtaaaattattgcttttgatttattcacttttatcagagtgaatgttttcggcgggatttgcttggtttgaagaagttatattaaaaatttaacaaatgcttttatagttatcatgcaacttgtgacacataaatcattgtgaatttttagtaaagtttgaaatttatgaccaggtgcagtggctcgtgcctgtaatcccagcactttgggaggccgaggtgggtggatcatgaggtcaggagtttgagaccagcctggacaacatggtgaaaccccgtctctattaaaaatacaaaaaattagctgggtgtggtagcgggcacctgtaatcccagctactcaggaggctgaggcaggataatcgcttgaacccgggaagtggagtttgcagtgagccgagatcatgccattggactccagccccggcgacagtgtgagactccatctcaaaaaaaaaaaaaaagaaatttatcgtggtgaaatattgcctatctagaaatcatggtgaatggtgttttggaaagctgatgattgactcctttaaggatgaaaatggtatggtatagtgaaactattgtgtgtggaaacttttctaaaagtccttgcatactttaccttcttagatcagagtgtggtcttgttaacttagccacttcttgatgacctggggtcactgccgtgaacttcggtgtactctactgggctgtaattggctggcatcctactgtcctatttcagtccacgggctccaggatggtgtggctcttagactcatctgctttttgaaattattatctctgcaagtgtgctttttaaacattcactgtaacaaacctcccacgttcttcttttgttgtttgtggtctgccaagttcttacagctcagataaatttgatttttataattgcgtaaaagctaagtgcaggtagcctttctccttctccgtggggtctgcatccatgagtgcaaccgacctcatatcagaaaatcctcagtaagtgtactgcagtaagcccaaagcagtgttaaaaatactagtgtgaatggcacacaaaaattgcttttttcccccctaaattattaactggaattctcattgtgaagtagacccagggagatgcagtccttagggttcccgccctggaagagtacctttaaagaattctcataaaactttagcctcaggctgctgaagcacttgacaaaagtcctaaatcattcctggggcggcgtgcgaggagggcaggtttccttggtgaagatgctcagtgcatcctgggctgcatcggagatgcactgttctcagtgtcactgtgtaaccacataaggcagtactgtttgtgcatctgccaggacagagatttgttttcaaggttctgggaaccacatgggggcaatgcacttataaacaggagcaagaaatcccacagtccctccaaacctccctgaggttctcaactttgaaggacaaaacccgtttctgtgcacttggatctggatattcagctgctcctgtgagacagtaaccagcactcattctctgttctctgtaccttcactcattccactgcctgtgactgacagaagggaggcaaagtaactcctcggcagcatctgcctttctcagcagcagactggttgttttcttctgctggtcagagcaattcttcaacaactgcatgagcagaggcatgaacatctgtcgtaaaatggggatacctgtgtcttaggcttggctgtaatctgcttgataaaaggaatgagttcctgggggtctcttccttcatagtctttgagcacatgtctgagcagacaagaggaacagaaggacttcttcctccaggcaagtaatcatgcaatgaggaagaacatgggacctctgcttctgagcatatccttctgtaaggcacagctgagggctgatgagaatatctgtaaacagttcagagcctctgaacagccacgccattccccagtctgctcgctgctctggcaagtccagcaccatggttgaagcagtctgttatagatgcctgcctttcttcccctgcggtcagcatcagtgttcctaacagaagtttaaacttttccatcagtggagtctacagattcctcaattaatgcttgcttcctttttgatgggtgtttactgtcaataattggtattccggctgtcttgtaaacaaatagttgattattgttcttcagtaaggactgctaaccattctcagtggagaaagccctgataagtcttctattctattgagaatatcctcagtgaaaggattcattgtttcttgagagatctgacaaatctaaagaactgccaagcagttccgctgcacgcttttgcgctacagtgttgcagaccccctgtgatctaagaaagccattaatacccacggaatgtgttgagattcagcagtaaagaactttcctgtctgacaagttccgaaaaactcatgtcacacataagagctaactcctgacattaccaacggctgtgtcatatttgcagagcactagccattgaaccagcacctgagaagggggcaccatgagatcctggaagagcttctgtcaatttctatagcaagcctgctgctcctgcagcttctgtaaaccgtgtagcctaccagtgctgtggtgtcgaaatataaactgcgcaggagtcagcagtaccttggtgaagcttgagctagccggtccaacagtaacttctgttgttttttatagttgacaaacatggcttcatcgttactctcgttttcaaagatagggtcttcatcataagttcctttgtggcaactgacatgattgccgctgcaccggctttctgctgatctaagatgtttcaaaatctgaacataatcacagcaaaagccagtatcttagaggaggtcccgtcatcaggagctagtcaccgcagcgtcagtgccatccttgtttcagcagcttctagtgcctcttgagcattcttgatatccccattctgaattcacgtagtccagctaactatcagtgactgtctctctcctgtgaccagctgagaaaacctggccaggaaatcaacatcatcttcgtggtcaatgctgaaaaacccagcagactgtagtacttgttaaaaagattctactggctgggcgcggtggctcacaactgtaatccccgcactttgggaggccgaggtgggtggatctcctgaggtcaggagttcgagaccagcctggccaacatggtgaaacctgtctctactaaaaatacgaaaattagctgggcatgatgatgcgcacctgtagtcccacctactcgggaagctgaggaaggagaatggcttgaacccaggaggcagaggttgcagtgagccgagatcacactactgcactccagcctgggtgacagagtgagactccatgtctaaataaataaataaataaataaataaaaagattctactagctccatttcatcagcagggtccgttcctcgatttacagtttcagatatccagtcacgtgcttctgttaacccagtcctagcagcatatctataaacctatcattggttgagggccaggtttatgtaagaggctgtattagtctgttctcatgcttataataatgacataccagagactgggtaatttataaaggaaagaggtttaattgactcatagttccacatggctggggaggcctcacaatgatggcagaaggtgaataaggagcaaagtcacatcttacatggctacaggcaagagagacatgtacagggcaactgccctttataaaaccattaggccccgtgagacttattcagtgtcaagagaacagcacaggagaaacacacccgcatgattcagttacctcccaccaggtccctcccacgacatgtggggattattagcattcaaggtgagatttgggtggggacacagagccaaaccatatcagaggcttttgtgtgaagccccaagacccagcactgacctgttgcttctgatttgtataatgattatttggtaagatttgctgccgtggttccaccaggtttgaatgcactgttcccagtgttctagtaggtctgctactgagagagtgtttagaaaaaaaaaaaaaaaaagcataaaaaacaaatgccgggcacagtggctcacgcctgtaatccagcactttgggaggccgaggcaggtggatcacaagatcaggagatcgagaccatcctggctaaaatggtgtaaccccatctctgcaaaaaaattagccgggcatggtggcgggtgcctgtagtcccagctactcaggaggctgaggcaggagaatggcatgaacccgggaggcggagcttgcagtgagccgagatcatgccactgcactccagcctgggcgacagagcgagactccgtctcaaaaaccaaacaaacaaacacttaggctgtgcagtgagatattctgtaacagaagtcaagaaggtgagtcaagctgttgtatttcacgtgaaggtctcctgtggctgaggagtctgcatttgtgcgtgacgctgagatatcagtccctctctaattagatgttggacagtagttacttctgaatatttgatgttctggtccttgaaagcagaaagactttgtgtcaccctgactgtcgtctgggctagaacttctgtgtgtacctgtcaggcgtctgggggaatcttttgatgttcccagcaggccagggtcctttgttggaaccagcatttggattttgtcccaaaagagcaggctatccatcccaggtgctctacttggagttttctgattacagtaggtgctctccgatcccacagaagaacccacagatgtttctctggtcactgcattccccctgtctgtctcccctacccatgtctggccagtggtcttcctctttggtcgtccttgtcctcctgacggcccagctaatgctggagataaagctggctgggtggtctatggcaccttctcttgcatgggagctaattgaagactgaagagaacacgtctaggcttttttcctctcctgccaagaaactttctgcagcatgtaaggctttctgtaatttagccctgcctgcacttctgactcttgctagtcccaccaggcatcctgtaccccagccatattgaactggaggtttctgggactcaccttcacacctggcttttgctgctgcttttatctgataaatatacctcaggccgtgtccttcttggcaaatatctgccttcgaagctcaccggcagggccaccttatttctgcagaagtttctgagcctcctcctatggaagtaatcagcattgtctttgcattcctggtgtgcatccatgcacacatctgtcttggcacctctgatgctctgccatacatgcttggttacgccatacatgcttggttacactgccctacccgcttctcccctagaccacagtcctttccagggcagataccttttgatgcctggcatggtgcttggcacttgtcatgctgtgcttgaagtagcactgggaagacagacctccttgagaaaactgcacttaggcgctaggatcacgtggacctcactggccatctggtcctgggcaagtcagttaagatgtcaacttctcatctgtaaggtgggactaaggatagaataaatggaagataaacgaatgggaggatccatgtaaagtggatagcatggtggtagctgaccaataataagtgtttaatgaatatatatgtttttaaattatttttaaataggtgaaacatgcccatgccacacaattcaaaagacacagtggtgtccacagaacttctgtgaggggtcttctgccacccctccccagggaagcgcaccactactgtcttctgtgtcttttaaacaagcacaggcatctgtgtgattgttttctaggaggatgagtggcttcctgctagaggtataatataatgtgatgttattttttaggttacttttttccacttgatatcttatttttcaaaatgcttgaatagtgtttcattttatgaatgtatcataatctaaccaatctgcagccatttgctaacatgaatgatgctgcagtggccgtgtgtgtagctgcatcatttcacacatgtacgtttatctgtaaggacatttcagtttaaaataatttcagtcttagtggaaatgtttcaaaacaatacaaggaattcccatatacccttcatccatattcccccaaatgttaacattttactacatttgatttcgctgtttagctatttttttcctgaattttctgagagtgacttgtagatataatgcccttttaactgtaaatattttttagtgtgtatttcctaaaatcaaggacatccttgtacataatcatagtaaagtcatcaatatcaggaaattaaaattgacccagtactattgtccactgtaccgaccttattgaaattttatcattggtgtcagtaacatacttgataacaaatgaaaaggattttgtcaacagttacactttcctttggtaaaaaggaataagttttgataaacagttatactttcatgtagtcatgtagatttacccttctaggagcaattattggagcacctgtttcctcacagccttttcaagaaattatcaaaatttggggattttttttactcatccaatgggttagaaaatggtgtcttattgtacgtttaatttgcatttttcttacaaggagtaaggttgaaagcttttcaaaagagtacctatattttcctataagactaattcttgacttcttttgtccatatggtattaaagatgatagcattttgtgagctatatttgtgggatacagtttactcctagacaacacaaatttgaactgcaaaggtccacttatatgcaggttttatcctgcctctgccaccccaagagagcaagacccccgacttcctcagcctactcaacatgtagacaaagagaggaaaaccacttccacttaatgaataggagatatattttctcttctttatgcttttcttaataacattttttctctagctttattgtaagattatagtgtataatacatgtacaaaatatgtgttacctgttgatgttattggcaagtcttctggtcaacaggaggctattgacagttaagtttttggggtatcttataggcagatttttaactgcatcggggtcagtgcctctaacctccgagttgttcaagggtcagttgtacatttttttctaatttgtttgcctttttgagctgaaaaacttttttaactggggaaatatttatttatatgtatagctaagtttgtcaatgtttaatgactttaggcttgggtgatatttagacttcatcactgacattatggaaagataacctcttctcttatatctgacttttataatttaataggttttttttttcgagacagggtctctgttgcccaggctgcagtgtggtgccacgatcatagctcactgcagcctcgacctcccaggctcaagtgatcctactgcttcagcctcctcagtagttaggactatacgtgtgcaccaccacacctagttaattttgttatttttatttttgtagagacagagtcttgctctgttgcccagggtggtcttgaactcctggcctggagcaatcctcctgccttggcctcccaaagtgctggtattacagtcatgagccactatgcttgtccataatttaatgttttaaactaaatctttgatttaattttttttttttcaggtggccacccagatgtgcaaacatcatttgtcaaataagtcatgttttcccaattgaaatgtaatgccaccttgatcacactcccaaatcgatatatgtcttttctggactgttctactcctctaatctgtctttttattcaagtgttctgagtgtactttgataactagaaagccagtcttctcttgatactcctttttaaaagtgtatttttcactattttcacatatttatttttcagatgcactttagaatcttctgctaaagttccaaaaactttagttccaaaaaacaatcttattggtatttgtatacagatgataaattaaaccagggagaattgatgtctttgtaacttacagtctttgtcccaaagaatagggtatgcatttccattaatttatcttttttttttttttctttttgaaattttcttctgggttttttttttttttttttttttttgtaaataggaagcgtattgattttcttgtattaaaacttgggtatctttctgagttctaggtttgttagattatatggtaatatcatttgaaaataatgactgatgcttcatttctagtgtatactgtatatttctttatcttgactaatgtcattgactagtatctctagatcacaataaattaatggcagtgatagtggacttttctccctgactttaatatatttttctattaagttgaatgttatattgagatatgttttattcaccttttcctgtttttagaccttttttaagactagatgttgagttttagcaaatgtcttttcatgttgaagatgagtatatatcctttacttttctatatttactaatatatatatataaacttattgagacggaatttcgctcttgttgcccaggctggagtgcaatggtgcagtcttggctcaccataacctctgcctcccgggttcaagtgattctcctgcctcagcctcctgagtagctgggattacaggcatgtgccaccacgcccagcaaattttgtatttttagtagagacggggtttctccatgttggtcaggctggttttgaactgctgacttcaggtgatccgcccgcctcggcctcccaaagtgctgggattacaggcgtgagccaccgcacctggacttactatttgaagaggaaagctactgcccaactccaggaaagcttgccatgtgggattgcagatctagctttccggatctttccatttgtcagagttggaaatctggattccattttcttttttaacattgtgtgggtgaaacaaaacatatgcaggccagatttggagacagcttcaggacttccagttcgtagtctctgttctagtctattcacagatattagaacctggtggcagatttagattatgtcatcctgcgtaacttgagatatagttttattttggtttggaaaaaaatctgatttctggggaatggtgtcctaatttttactagtagatattatagtctctcataccctttttataccttgcatttttgatttgtcatgataaagcctttaggtaattatgcacatttgtgaattaatttttacctgttaattttaagcagtcttaaattttagatgtctttatgcactatcaccacaaaacaaatgtctcaccttttaaaaccagttcccttatttccttctccatttttacccccgtgatttgtgtctgtacctttctttgtttttatttacattctgtcactgtgtttaaaaaatatattatttttcattctttttttctacctttctttcctttttttctttttgagacagggtctggctctgtcgcccaggctggagtgcagtggcacagttatagcacactgcaactcctatgtcctgggctcaagccatccttctacctcagcctcctgagtagctggaaccacaggcatgcaccaccgcacctggctaattgttttaaaattttttctcaagagatggaattttgccatgttgcccaggctgatctcaaactactgagctcaagctatctgtccgccttggcctctcagagtgttgggattacaggcgtgagccactgcgcccggcccacctttcttttttatgtgaattattcttgcaaagaatattgtatttgagaaaatggtttctatctttacagatttacttgcatatatggataattccttatgtttagtgataagagagaaggaaacagaaggttttctttttccctaagaaaactatgttggtacagacacagttaaataaattttagttaaaagtgttctggtgaaatttcattaatgtgggaaatctttctgatttcatgtggattctttatgtgagttatctatatagtcactgtagatgctaccttaatttcagatgaataaatctaatcaaaaattttaaaaataaggtgattctaagttttagttacctgcattcaaccaaattcccaaaaatattaaatggaaaattccagaaataaacaattcataagctgtaaatttcttaccatttcaccttccactgtcctgctccatcctgagaggggtgagggagacacgggtcatccctttgtcccacgcactcacgctgctgcattcaccactcagtagctggcttggttctcagatggaaccactcgggtcttggcagtatttcctgctgaaaacagagggacaggtgtacttactatatttccatcaatttgtgattttttttctattagaaatagttttaaacttgattcaaaattgagtaataatatgagacagatccacttatattttatcatgaattgatatatactatttgtcttaactgtttaccaatttccttttatagcatatagatttactgtttcttaattatttgcatttatatttttttaattggtgatatccagtaggcccaataaatacttattccagtgtcattccttctcttctcgttccctgcattaagcatgaggtcattcgatcccatctgcttttgttctcattgagagggagccagctgtgtcctggtgccgctggacctaccgaatcaatcaccctgtcagtgggcgctctttttcagagactgaattgtgttttccccgactgttaggggtttcagcgagattaactcctagccctcgataatgtcagtgatcctgggaattccaagctttcccataactgatcatgcgtgcagctttctgtggggaccacagggggtcctggacctgaccctaggcggggtgtccaggccaagcgggacgtgtcctctcccttcacaggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggtatggcctcagggctgggcccacacgggcactggccacgggggccacacacattactgcgcacatataccaaacacaggtatggcacacagtaggcacacaggtactgcacacaagtactgctcacagggactgcacaaagtatcacacacagtactgcacgtaagtgtggcccgcaatgcagcacccacaccggtactgcccacagggactgcacaaaggtctcaaacacagataccgcacacagtacccaacacagcaatgtgcacaggtactgcacacgagtactgcccacagggactgcacacagtactgcacacaggtactgcacacagtatgcaacagggcactgtgcacaggtactgcacacaagtactgcccacagggactgcacacagtaccccacatagtactgaacacagtactgctcacgggtatggcccacagtgctgcacccacacaggcattgcccaaaagtaccaaacacatagtactgcacatagtacccagcacagcactttgcacaggtactactgctcacaaatactgccctcagggactgcacacagtatcacacacaggtatggcccacagtgctgtacccacactggtactgcccacagaaactgcacacaagtatcaaaggcaggtaccagacacagtaccacacacaagtatggcccgcagtgctgcagccacgtgggcactggccacagggaccgtacacagtaccaaacacaggtactgcacatgggtactaaactcagtatcaagcacagtaccaaacacagtactaaatacaggtaccgcacacagttaccaaacactataccacacgcaagtacagcttgcagtgctgcacccacacaggcattgcccacagggaccacacgtggtaccaaacacaggtactacacacaggcaccaaattcagtatcaaacacagtaccaaacacagtactaaatacaggtactgcacacaggtaccaaacatagtaccacacacaggtacagcctgccgtgctgcacacacacaggcattgcccacagggaccgcacacagtaccaaacacaggtactgcacacaggtaccaaactcagtatcgaacacagtaccaaacacagtactacacacaagtaccaaacacaatactaaatacaggtaccacacacaggtaccacagtaccacacacaagtacagcctcagtgctgtacccacacaggcactgcccacagggaccacacacagtgccaaacacaggtactgcacacaggtaccaagcacagtactgcacacaagtactgcacacagtacgaaacagtactgcacacaggtgtcatgcacagtgccaaacacagtactgcacacagtacacaaacagagtactgcacacaggtacagcctgcagagctgcactcacacaggcactgcccacagggaccacacacagtaccaaacacaggtaccaaacacagtacagcacacaggtactgcatacaggtatggcctgcagtgctgcacacaggtactggccacagggaccacacagtactgtgcataggtactgcacacagctactgcacatactaccaaacacagtactgcatacagtacccaacacagtacacacaagtactgcccacagggactgtatacagcatcacatacagtactgcacacagtacaacatacacagtactgcacttaggcatcaaacacagtactgcacacaggtaccaaacagtactgcccacaggtactgcacacaatacccaacatggtgctgcagacaggtactgcccatagggactgcacacagtactacacacagtactgcacttaggtaccaaacacagtaccaaacatagtactgcacacaggtaccaaacagtactgcccactggtaccgcataaagtaccaaacatagtactgcacacaggtaccaaacagtactgcccactggtacctcatatagtaccaaacacagtactgcacacaggtaccacatacagtaccaaacagtactgcacacaggcatcatgcatgctaccaaacacagtaataaacagtactgcacacaagtagtacatagagtaccaaacacagtactgcgctcaggtactgcatacagtactaaacacagtactacacacaagtactgcccacagggactgcataccgtaccacacatagtactgtacatagtaccacacacacagtattgcacttaggtaccaaacacagtgctgcacacagggaccagtgctgcccacaggtactgcacacaggtgccacacacagtaccaaacagtactgcacacaggcatcatgcacagtaccaaacacagtactgtacataggcactgcccatagtaccaaacacagtactgcacacaagtactacatatagtaacaaacacagtactaaacacagtaccacacatggtaccaaacacagtgccacacacaggaactgccaataggtactgcacacagtactgcacacaggtgctgagaagggattgagtcacagcacctgggggagcaataattgactacttggaggatatatttctgtcttttcatcagcacttgttgagtctcttctataggctgggcatgaagtatctacaggtaaagaaaacagatgcaaccttgatctccatggagctaaggatatgctgggggaggcattaaaaacaagtaacacttataaatgaacgtagaattgcagagggtgaaaagagacttctgtccggatcagatttggatttagactgagtgagcctttctgagaatacaacatgtaatctgcatttgatctgagaagacctgaaggctttagctgggccaggaggaggaccggggacctgtttgtactgaggcatgaaatctttcattacggagctccattttttttaatgacatatttattgagatgtaatttacatataatatttaccattttaatgtgtacacttctgaattgtgcactctacaccactgtctgattttggaacatttttatcaccctgcaaagaaaccctgtactcattggcaatatcccccaaattccctcagggatcctcctctgggctgacaatgtggatgagtatttgacaaagctgaagttactcaattttgttgtatgtgtttctttggaatttacattttcatttgctgataaaattgtaaaacaaggaaatattctttagaagtggggcacagtagtaagaggatcattaagaagatattagtactattatcatcatcatttacaatcagtgacaactaccatttactgtttatttgcaaaatgtgagacattgctaagtgctgtttaaatgttagcttacgtaatctcagcagcagccctggaggcaggtgtctttaagccactttacaggtggtgacttaagagagagagcatccttacatactgtaaagttctgaagaactactgtccatattttacaatgtaagactttgtcctaaaaatactaaatgttctttttttacttaaaatgctcttataacatgccttaatatctataatatgcactgtatacaaacaagggaaaataatttacaatatccattaaattataagcatggcctaataaattgaaggttcaaatcagtattggaaataataacattttatgttagcatttgctgttgagatgtaatttctggaaataattctaaaatgtgatttcatttttattaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatgttccagtccctgatattcctttgcaggaaccaatcctcataactgacttaggtaagatggattgtagggcgtctttataatttattgagtactattttctttgacattttgtgaattgtgtacacacattatggtctctgtagttaaatagttttttaggcatagtattaatgaagtctgtgttaagccttgttttgctttatggactagtatgttttacagtcaagattaaaatctaagttgtatccaaactactgctcaaattgttttctcggattagagacaaataatgtgtaagtgaaaacagtagcgtgtaagtcctcattgaagaaacattgctacctcagtggaaccatcaaaagtgagaaggggtttttatgtgaaacacacagtgcacgttgttgttttcatctttaggttctttgtactgtgttacagattatttgggctactttaatctttggattaaaaaggaaaagaaaaatctgcctgcttttctttttaggttcagtgttactataaccaacccaaactatgattttgttgatgatctagaaagaaaacactgcttgttagaatctttagaaaaattatatttgttagtactagaacaaaatttaagaaacctcattgtcttagtttgtttgagctcctgaatcaaaaataccactaactgtgtagcttgtaaatactaggagtttacttctcacagttctagaggctgggaagtccaagatcatggtgctggcagattgagtgtctagtgaggtctctcttcctcatagatagtgccttctggctatgtcctcccaaaggtcctacctcttactacatgaattttggaggaccacaaacatttagaccacatcacttactaatgtgtgaatttacatttttatgcagtttctgtatttcactactttcctaggaaagataattcaatctataagcaaaattaatattaaaatataattccttaattccaaagcataacctttatttacaataattgtaaattattgtatagagagattttagattgttataaattgggggccaccagtaagatgatcaacagccataaacttgtgtgaatctgagagtttaacatcaaaatatttaaactaaaaaaattcaaagaaaggaaatactcaaattctcaagtgcagtgaaagatcctcaattagacaggtcaacttaaacaccttaaaacggaagatttgagcacacaaataaaaagagttacttaatagctttatagaatcttttgccttaaattacatacttttaaatatgcatgaaacagaagttgatcacattctaggatacagaaaaatttcaataaattttcagaagttgattttgtataggatacaatctttgattacagttcactgaaaaacttataaaatagccatccaaaatttcattacatgaaaagaaggactcgaaacagatactgcatactacacatgtgagtattatgtaaacagattggatggaccaaagccgtcctaggaaaaattaagacttttgagtattattagaaaataagacagattgaaaataagtaaaatatttaactaaaaaaactaggaaaattaaaagaaagtagcagaaaggaattaatatagcagttcccaacctttttgtcatcagggattggttttgcagaagacagtttttccacagattgggggtcgggtgggaggactggtttcagggtaaaactgttccactcagatgtcagagaatcagacattagattctcggaaggagtgcgcagcctagatccctcacatgcacagtgcacaatagggttcgcactcctgtgagaatctaacactcttcggatctgacaggaggcggagctcagatggtaaagcttactcacctgctattcgcctcctgctgcgtggcccggttcctaacaggcagcctggggcttgaggaccccttaattaatacatataatggaattggagatagaagacaaaactgtagtgaactgaagttttacaaaacttataaaaatgaacagaaaatatagatgacttgtcactaataaagaaacatgagaaaacataggaatgagaaagaagttgtaagcacagatacaaatgaggtaacaattgtttgcaaatactctacaactttttcctaatatatttgaaaattttgatgaaatgaatcttttctaaaataatatgcttggcagaattgactgtagaagaaatagaaaactccaaaatacacaacaaattgacaagatagtaaaagatcatcttctccaaaacaccagtctggttgggcgcggtggctcacgcctgtgaccctagcactttggaaggccgaggtgggcgatcactcaaggtcaggagtttgagaccagcctggccaacatggcaaaaccccatctctactagaaatacataaattagccgggcgtggtggcaggcaccaataatcccagctactcaggaggctgaggcaggagaatggcttgaacccaggaggcagaggttgcagtaagccaagattgcaccactggactccagcctggggaacaacagtgaaactctgtctcaaaaaaaaaaaagtctgataatttaatatacgaattgtactaagcttcctaggaactataattgttatgctatttaactgtttttgagcatagaatgggatcaaaacccccatggtagcgtagaatactttgatatccttgtccagttttggctgctcacaaaatgaagcaacagaccggtttcttctttcaggttgccgtaaatcaagttgtacacccatgggtttctggacttcaagtttttgaatcttcagttgagttaggttcttgactcttcagcaatttttcagggttaaaatgggatatattttgcttgttggcttcgcagatacttgtatcttagaccagataggggaacctgaattctttggtttaggctgaggaagacacatgagggaaatgattgctagagggagcttcacactgtaaattgtaaaatattgtaactatgtcttgtgcttaattttgttatttgtatttgtgttcatctcttctctcagactctgggctccttagaggctatagaaaagacttggctgtcataatctttgggggacagagtttgataaaaacatggtaaggagaggattagcatagaatagtgttatgagagtaagtgaaagtagaatgctcattgaggaagctagcggtagtccaggggagtccttgaccgagagcaatgtggaagaggaaacctgcatccagggttctgccatcactgtttttgagaaccaggcatggcattcagtctgcatgtctcagcatgtgtagggaaggtggtaggcacggactggatgcctgcatttttctttcttttttctttcctttcttgagacagagtctcactctgtcacccaggctggagtgcaatggtacgatctcggctcactgcaacctctgcctcccgggttcaagcgattctcctgcctcagcttcctgagtagctaggactacaggcatgtgccaccatgcctggtaatttttgtattttttgtatttttatttttttttaagtagagacggggtttctgcatgttggccaggctgatctcaaactcccgacctcaggtgatccacccaccttggcctcccaaagtgctgggattacaggcctgagccactgtgcccagcctgcatttttctcttttgagcaggatgagttgttaggaaaaagtgaggctgtgctgtcaagcacagggtggtgtcagagctgcctggagcgaggtctttgatacagctctgattgtccagaaggcttgtgagatgagaaaaggcttggtagtcttaggagttgtgctgtgtgggttatatcacaagggagggttctgaatactttttgaaaaataaggttctgatgcaagcttcaggaagcataggtgaatttccttaaatctaataatgagctaggtgaaattggttgggctgtcaaattccctccagctttgtaattgtttcactgctatttgagattggtggcagtggaaaaagaagagaagatgcaagtttaagagacattggagtggtgttgatcatcaggactggcaaatgccgagtacaggacagggaagggaactctcagaggtccggggctccccagccttagggaccagaagactgttccaggcatgcagctaggaaagctgggagaagtgggctttaggggaagaaattgaaacggaatctgtatttttatggaaagtccggaaaaaccgagtgtgttcagaggtgcatcatgctaatcattgtatagcagttaaggtacaaatgagggaggagagaggaccgggaatggagagctgtgggcagaggacaaaatcttggccaatgcctccttgtcttggcaggaggagcagcccaaggctgattagaggactgactgcgtgtgtcaccctcttaacgttccaaatgactcttaaggaattcgaaagtttacccccaagcttgtcctgaattgctgaaataatgcagtagcttgatcaattcatatttattacatggtcaacctgaaggaattcttaatttagtaaatgtatataaaatgaaatatttaaattactaattttgttatttgtagatatccctttagtgatatctgtgaaaatgctaacctttttagaacaaaagatcatgttagagtcacttttgttttcagtttattatagtatctagtgtgcagtattcatactgaataaacaaggtattaaaatcttgcttatcctgaattttggacatagttatgtagactccatgtcaacaaatgcccatatagaaagtaaatgtagaaattcattagaaattggccgtggaatcaagggaagtaattgtgactagatatttctcatgtttaaaaaatgagcaacattaatatatattaatttataatgtttgttaatttataaattaatttgtaatgttatattataaatatattaatttataatgtttccccataggtattctttgaatagccagttcctaacacaattaaaataacatagttgcaacattagaatctaacttaccagaattttcatcttctgggtaaaacatgtgccttgtgacatttaattgtattactagcattgacagtgaattacatctgcttttcttttgctttgtaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcaggtaaggtaacggattcacagatggaaatttagtataattaaactgacttagtgacctgatgacgtctagaagtatttaggatggtagcattagcttttggtattaaagatgtcacatttgactccaaaacatttattggtaattaatatttttattctttaatgtcttgactaaaatattttatccagaaattgctactggagtttatgtatatgctcattaaatttcagtgtttgcaatttccaagaaatgtcaaagaagtttattttattagacttccttttgtgtttttcagatgtatttatcagtttagattaattcttagtgctagccacagtgaaaaggaagtcgaaccttgatcatgagagacagtgtgatgtcatgaaaaaagtatagaacttagaaaaagacatggcttctagcttcatctcagtcgtgtgacttgaggcaggtcgcttaagcactctgagtctcaggcttcctcccttgtgaaatgtggagagctccggcattgctgcttagctttaaaaaatgtgatgatgaagtgaagcgaaatgcaagagtgcattctagtcacaaagcattataaaagtataagaaacatattcattaaaatgtgtatttttttttaagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacaggtgggtgtaattctggtggtcactttttatcatctttataatttccagtagatggtggggagtgtttttaggaaataattgtctttgattcttacattattatttctagctcatactatatgggctcaagaaatgtaagtattagtgtctaaggatctaatgggagccatagactgaagcattagcattttcatttttaatttaataatgaagtagtttatattctgtaagctgtcttttaaagctgttagttggtaattagatgaaatgctggactgtgtctagtatagtcagatagtgaatatttcagaaaagagaatcttaaagaccctgtgatttctaggcctgtcatcagcaaatctgaatggtaattattctatgttgttgactttaaagaatacatattttagatattccataaacttttcattcagcctagcttatattttcacatgattggaaggctagctcgtctctatgtggatgtaatccggaagagatgcatttctgactagtgctggggcctattcgatgagtatttctgtgaagccacagaattctgtgtggtactgtaacacctgggtagggtgaccacagcttaggagatgtgaaagggagagtcactaggcctaaagctgctgccctggaacatttgctttgagacagcattttaacccagatatgtctgcctggatgtcgtctacaaagcaaaaccttaaatattagaataagttacctgtgatagtgttgttttgatattattgatctgactgcctaagcaccctcaacagaattgacgtttttgatttcagtatcgttgattgcttagctgagaaatttacctgctgcttgagaccacccagggagtgtggtattggcggtgttatatgtggactcctgttaattacatatccacttacacttcactgcattttgtggagggaatcctgtgcagggcactgcatgtgtttgggaactggggaactcgggggcacatggatgttgaggatgcttgtgttcctgctcgctgtagcaggatgacgggtccccagttggcccaagagcttaccgtgctaagaagaatggagcttgggcgcttgcttgctcagtggaatgttaaaccaaatctttttcagtcaggaagccagcctcttccagtgtcctttcgtagtagtattgggaatatgggtgttcaggcccttgtttccggacccagtgaccaatgctgtaattgcggggtcacctttattaagtggtatattgtgcgaccattgtttgtcatcaatttcgagggacacatgtaggagatgaatgtagagctttgagaggacactaagcagatcagcctgttgttgcagagctgcagtgctttgcttttacagattgtgtgcacttggaatctgcctacaaggagagcatccagccagggtttcattcctttgaattgttggaaattcccaaaataccacatatactcatgctaaagataggtaaagaaggttactgtagtaaaatttattggaaaaaacaaagaaccaaggaaacaaacagaaaacaagcctccatcagttagcgtgagacacacatgtgcttaggttagagtggcttttacaggcccctgcgtgccactgcgctgctgtgtggaagcatcacagtggaggtgcaggcgtgcattttctaactcttctctattatgcgacacatttttgttctcccttccacagtaaaagtagttatgaattgtctattttggatattagaaaacgaagagggaaaattttgtttggaactgagaatgaaattctgagtaggcagattcctaagacactggaatagagcccatgatgcagcttgtatggtctgtgtgtgcagaggcagaagaggggaccaggcggctcttttttgtgtgtgtgggtgtttttgtttgtttgagacggagtctcgctctgttgcccaggctggagtgccgtggtgcaattttggctcactgcaacctcctgcctcagcctcccaagtagctgggattacaggcgtgcacccctgcacctggctaatttttgtatttgtagtagagatggggtttcaccatgttggccaggctggccttgaactcctgacctcaggtgatcctccagccttggcctcccaaagtgctgggattacaggtgtgagctgcgcgcctggccggctctttgtcttagatattcttcgtactagccagcctgttagtcagataattgtgtgagatttttttcttttttttttttttcaagttctcagttcattgctgaattcattgttcatcttttcctttgaaagagaaatcgttgactttgatgaatgctggatacactttgtgtatgtaaatgttgctgaaagcaacatttggatcgttggtccaataaagggcctgaggcccaggctgtgagagacagtaggtgatgaggctggaggctctctgcgcaccacgtgttgtcagatttagatcagtctataaaggtgtcgtctcatttagtacaattatttttctgaatacttagactcattgcagaacttgagttgggagagttttacttttaaacacgagacatctttttaatgtttttaaactattaggcattcgggtgtgtgttgtccttcatcctccgttcgtgccttgtgtcttgtagccggtggaagcacttaaagataaggcaaacgagctctcttcagagttactaatgtgttcagtttttacctgaattgccatcatgacttcaaaatgaaatcattaataaaaaatgttatttaatcaatgacaactctttcactgtagtatcccaggcaagtaacctttgacagcatctaacctgatgaactgttgttaatttttctgaagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaaggtaaatgtttcaggatatttaactttgagtgatcccagcagagttttgcagcctttcccactcattgcagtccattggtgtctcccatcactgacttttaaaacaatttgtgctgtatgtgaaagagattgaattgagtatttgatatcattccatgtcctcttaaattagatttttacttttcaattttattagatttcttaggggaagttcttttttgaaaaaacaaaaacaaagtgatcagacttcttgttaggaaatattcgaaatcttgttaagaagtagttgaaattttaggactgcagcaaaatctaccgtccttattttgatataggtgctaccaatttttttccatacaaatatgcaggggtgtgtgtgtatgtgtgtgtctgtgtgtgtgtgtgtgtgtgtgtgtgtgtttggtatgcgtatataattatacaaataaggctgggtgtggtggctcacgcctgtaatcccagcactttgggaggctgaggcaggtggatcacttgaggtcagcaattcaagaccagcctggctatggtgaaaccgtatctctactaaaaatacgaaacttagctgggtgtggtggtgcatacctgtaatctcagctacataggaggctgaggcaggagaattgcttgaacctgggaggcggaggttgcagtgagccgagatggcgccattgcactccagcctggacaacggagtgagtgagactctgtctcaaaaaaaaaaaaaaaaaaaattatacaaataggaccttgcagtgcatactattttgtgaccttttatccccggtatattgagaacatctttcaagtgtacatctgtatgatctttagtattctataaagtacactcagtgtagattcaaagatgaatgtaggtcagtgaactgtgggtgactggtctgcggtgagatgaggctcctgaaccagaatataaagcagcactttgcttccttcatcagtaaagtttggctacaaaacacaatgtcaggtcaactgtagactgtgtgattagtgacatagctggctgcgtctggcacaggcttcttatctcacacaggcatgtcagcaaacagtgtgctgaccagtttactgttttgttttatggatgtctcaaatgtattccgtctttggggaggattatacacttacccctatggtgcctgcaaccatgcacacgcagaaaggttttaaacaattatggaatgtaatagcattttagaatattgtttaatggaacaatgtctgagttttcagacagacgctaaaggctttcagggatggtattctagaaatgcaaagagaatgctttaagcatatgtatgtattaaattatctccctgttttcttttcaaaataaggtgtctgatatttgaaaactcgccgaagtgtacttttggacagatttgcagttgtgaaataacttccaaatgtatgcgtcccccttttttacatctcatcctcagatgggtttgtggctccacaggaccctctgcgagggcacgtagaccagtttgaagagcagagccctgcgcaacagtccttcgaaccagcagggctaccccaaggtcagtggtgggttttcaatgaaatttgtaagtgagctatacttcagttgaatttaatctcatgacaaccttacatgttttctcttaaggcccttctaaagtgtatggtttcaaaccaaataactttttgcatgcattgtagatttttttttattgatgcatactattttgtggtctgcttaggtcttctggaaagtgacctttgcagccattctacacgtagtttccagtcaagaaaaggtggctgagtagaaattggaacttcgtggtggctggtcctgtaaagcctccggtgctgtaatgtctgctgagcacagcctcctgcctgttagcaaacagtgttaaagcttgctaatagcagctagtcctaattctaattcagaaaatagaaatgcccctttagacattttaaatttataaaccttttcttagaacattttaatgtaactttaatatttttgtagaactcctcttttctaatttattttaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtagtgagtatggacagaggggtgcatacatggcagtatttagcaggtgctatgttattcttcactgtcattattaaaaatttccttaagggaaattttaagaggcatgctcacttcttgtagcattaaggttactgcattacctgggaaatcctcagtgtttagtacacagggctttctttttccttaaaacattttaattttgcttaaaggtttcactgccatggtgtggccttgcatttgtgattaaaaaccaaaaattgactagagtgctatgtaataacacgttgaaaggtactatgttgctttaggcacaaagcctcaacatttttatttgtggacttttaaacatgttagaaggaaaatataatgaatgctgacgttaaaaaatatttaaatgcatcatttaaaattttatctcttactcctggttggagacattttaattttggttttggttttcattttcctgcttttggaaatttcttaatagtgatgagaaatgattgaccaattgttatccctctttaaaatccaccgcgggtagctttgcccaagtggtagggctggaccctcccgtgaaaatttcagaacatttttctcataggtagaaactacataattggcagcagatgctgaatctgggaagtggagaacgtacttcttagcagctgactttactccagagctctctaaataaaactgtgcaaatccagttctgttgttgtggtttatctaagttggttttggaagtcaggtaaacaaatgcgacacaggcccttgcttatagcaacgtgcacttgctgcccaggggtggatgactctactgttcgcagtctgtcctgtgactccaggccttctgaaggtcagtggagcttatcctctactcagtgtgagcatggatctattatagagtggttagaaaacattgaccagatttttgttttgtccttgctgtggtagcatgggttgtaatgccgctgtcaggaagggatggggtcagtgtgactgccctatatgtgcgtggtaccgttcttggggatggagagcatgtctttctcaccctctggtttgtgtgacaagaggagacataatattatactctctgaaggtgggattttattcactgtcagtaagagtagagcagatgaaagaggaatctcttattaagatatataaaataatcagttttatggttgattaagctttgtattaaggtagggtaatagaaaataaataggtcttcatttaataaaatctgtataagtgatctttattattgctctggcctaaatgattacagtgaactatttggggtttctctctcttagatccacattttatgaatgttcttatccttagttcttagctgctcagttgttttatgtttattcacagatattcaagtagtttgctttatacttctcttaaattttagacaactcgcttgattcaggagtcatcccaagaggaactggacctgcaggcacaaggttcccagtttctggaggacaacgaggaccagagcaggcgctcttacaggtagttgtctgcacagaccagctcatggtattgccggctcccaggaacggatgctgctgtgtgtttgccccgctccaagggctctgcgatttcattctctcaaaactgttcaaaacagttccattgtcatccatattctgtaaataaacaatctgagacaaaagagattaacttgctaaactttttacagcagataagtgagcgggccaggatttggatacggcagtcttcagtttgtctgtttgaagtactctgctgcagcttcccgtcactgttttaagtcattattattccattttcgaaattagttaaatttatattatgccttttagttcaagactcttcatgtgctttacatataacaatctgtgtaccaggatacagcacaattagaaagacagctttttagatgtgtccgtccactggctcagcagtacatactgagcaccctctgtgcacaatgtacaagtaatttttgtatttttagtagagatggggtttcaccacattggccaggctggtctcaaactcctgacctcaggtgatccacctgcatcggcctcccaaagtgctgggattacaggcgtgagccaccgccaaaccagatttacaagagtgaattttcaaaatgtattcagacacttccagcttttagtttaatttggacttgagaggaaagttagttgcctctacgtgggcacccagtcttgacttaggttatagtgtagggacgtcactaacctcttgctggagattaaaacttgagaatggacaaaagagacatactaatggaataagcttttaataatatgtgagtaggagttttgaaatttataattattttaatccttaagataacattagtctattcagtaacaactgaaggggaaataatactgcatatttatatattattcagcataactccagtatactctgttttgtattttgtaaaccaaaggagtacatggattggcatttccaagtgactagatacaggagtgattctgcttctgaggcaatggaaggattcatagtgtctaacgacttaataaagaaaagagtgcatacattttcttcctattatgcttagagagagtttctaattaatcaaatattatgtctgctggggagttataggatttactgttttttaagtaatacatttaagactgtaaatactctaagcagaatttggtctaacaaatgattgttggcaatattttatactttataatttcttcaatgttggagagcacacctaggttctataacagttgtgcctaaatgtttcatggttgttggtgaagcttgtttgcttttcttcccttttcaggtgctgtatttgtaattgtgctatgaattaacgtggtctgagttctgtatgtttgctttgtaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggtcactgtctgccttatacttggagattagtcctttaaagaaaaaagctttattgagatataatccatataccattcagttcacccacttaaagtgtacaattcagtgatttttagtatgttcatagagttctgcaaccatcaaaactgtaattttaggacatttttattacacataaaagaaactctgtacccattaacagtcactccccatttcccctcaatgcccagaacctcaggcacccagtatctacctctgtctttatagatttgcctgtcctgggtattttatagaagtacgtggcattttgtgtctgcttctttcacagcacagtgtgctcaagtttcacctatgctgtatgggtggatcagaacctcattcctttccattgtaggatatgccacgtcttattgatccattcatcgggtgatggacattggagttatttccatattttgtttattatgagtaatcctgctatgcacatttgtatttaagtgtttgtgtggacatgggctcattgctctacctaggagtggaattgtttggtcatatgttaactctgttaaaacatttgttttccattgtggctgtcggatttgacagcccaccgtagcgtgggagggctctggtttccccacatccttgccaatggctattattgcttctcttatgaccggccttgtggatggtcatgagccttcccacgtgccattgtggttttgctttgatttgcatttcttcgatggctaatcatgttaaacatctttcacagacgctgagaaatgtctgttctaatcctatgcccattttaaaattggattatttgccttattgagttgtaagaggtttttatattctggctactggacctttatcagatgcatggtgtacagttaaaaatatttttaacatattctgttatctgttacatatactcagtatattcattataagtttaatatcaatgtatattttgtataaggctttatttgaaaatgaagatatactgcttagaaacatagagccaagcaaaataaggaaaagttttattgactggtccataggttgatgattgaggagtggttttagtggatactggaaagattgctggcagtagtttatatggtactttgaaggacatgctacggaggcagagagcagcaatatatgacttttataaggaacggtggaagaaagacagaaataggaggaaaatagctagttacttggttctgtgtcattggtccagaggagagagggccttctgtatgggactttatttgaaagtaaagctgtatagaaaatttatagactagttcttaatgcctaatctacctcatgtgctatgggagtgatgaaaagatggattggagaaaacatttctggggtagaatccacatgttgccagtttaaatgtaaaagaccaaggagagaggggacttgatttgttttgaagactgtgacttcacagagcctgctgatttcagtagagaaggcagtaagatgtcctatgtcaacttccatgttcttaaaacaatcccatttctaaaaattggaaacccacaccaaataaactgtctataattttgtaatttacttttttttttttttaaccaaagtctgttaagcctcaggataatgttgtaacttattaaacatatctttgtttggttttgactgcttctggttttaaggtagtgaaataggattggttccagccgttttttctgtttctgtgcttgcaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggaggtattttccatttgttgattcaaggtgtattaacccgatgctaatttaggaataaatccattcacaaatcaccgtgagtattttgacgtggctatatatagattagttcagtagcaccctgagtttttaataattttattttctgattatgaaagccatacatgctcttggaagaaaaattcagaggtgcaatgaagaaaacatctgctcttacaaatcaccacgcgctgaattggcattcactctcacactgtgttcttcctttcatgcttgggcgcgcatgttgctagagacttgaatgtttttaacaaatatggtatcttgctctatatagtgtagtatgcttaattttttgtctactgaagtttattacaggcatatttaatttattgaacacaggcctacatcagttcagatgactccgtggaattccatcatattttattatataattttctgttgatgggttgatggatgtgcagctagtatctggtctttcactgaaatggtaatggtagcagttatggactgctgtaacccttggtaaaacctgtgcttgccattacgttgtctcatgtaatagacacaaaacaccgcatagttggagggattaatctcattttgtacgctagccagctaaacattagacacgttaattcgcccaagtcccataccaagtgggagatcctgagtattatttttgtgcttatactttttgtacttataagacaacttctttttaggaagttccacgatgaaattatacagttacgaatagagcacattttatattttgacacgttgcgccagcacacagattgcagtttttaaatccgtgtgtgttctgacactcttggaggtcacggctggtctgagtgtatgtgttggcctgggctcttgcctgtgccgcggccatcctgtcctggcacagttggtgcgcagtgttgtcagtgaattttgtgtcagtggctgtgtggagacaggggtgctaaatggggactgtcatcggaggtcagacctgctggtggcccatcatcctctctcaaggtactgccccctctgtctgctttgccaccatctgaccgaaagaccacagtgagaccatctggggtccccggtgggttatggcagtctacctttctctgctgttttgaggaataagtctgtaaaacttgcctaaactccctcaaagtaacaaaaactgcgacttaaccattgccagagccattgtgcacctcatttctttagtagataattctggaataaaagtttctgacctgttaaactgagatagttcaaactctttaatctgatgatacttagtaaagccttcatttccatttttaaaattctgtcatgagatttcataaagtataaaaagaaaatgaccctttccttcaaatgagttaaaggctataggacatccaggcattatttctagaaccccgtcatttggagagtgttaatttatcagccaaatacaaataatctctaagccgctttacatattctttcctgtcaattaataaagcttctaatgctactgaattctagcatcgatttgggagttctgtttgggcttcatctcactgctacatatttatttagattcaccttgtatgccttgttttccttggatcattgtgggggaaactgcagatgaactcttgtccataggagaaaagtcacgtgttaaattgcgttgttttgcccaaacctagagacttggataggggttaaattccctcacatttattgtgacgttagcctgcttggcctaacacttgccgactgtttcatgctgtctgtctgtcgtgcttaattttgttgttctctgtctccagtctgtgctatactgattgtgttctcagttcgttaaagaatgttaacagagttacctccttatttcctcatgtgtgttggtggggccgctatctataagctgccctcaaatcattccaagctttattggtataatgcggactttcagtttgctgtatctttttctggaatttctacgagatggacattgaatccactggctttatcctccatgactttctccctcaacccacaccctcgctgtcctttgctcccctctctttcttcttccctccccaatcccctcccatctctcatcttttttcccttttatgtgctaagaaaaattatccagtttgtttttaaatttacttatttggtgaattaaccactgtccactttgcaatttagtgtttctgttgagttgtaagtttttttcagtcagtcatacaataatgacctccctgctcccagccaaactttttttccttctctagtattcttttttaatcaattggaatgcgtccttatttttcatttaggaatgaatacttatgcatatagttctctctcagtatcagctgaggattggttcctggactcctgaggacaccaaaatctgcagatgctgaagttcctgatatcaaacagcatagtatctgcatgtaacctacacgcatccacttgtatactttaagccatctctagatcacttataatacctaatataaatgctatgtaaatagtttggggttcttttgagaaacagggtctcactctgtcacccaggcaggagtacactggcacaatcataattcactgcagccttgaactcctgggatcaagcaatcctcccacctcaggctcctgagtagcaggggctacaggctcaccaccacgcctggctgatttaaaaaaatttttttttgtagagacggggtcttgctctgttgcctaggaggtcttgaacttccctgccaagccccaccttggcctcccaatatgctgggattacaggcgcgcgcccccatgcctggttaatttttaaatttttggtaaagatggactcttgctgtgtggcccaggctggtctcacactcctggcctgaagcaatctttccatctcagcttcccaaagcggtgggattacaggtgtgagccactgcacctagttgtaaatagccagtatagtgtatcgtttattgaataataacaagaaaaaaaggatctgtattttctaactgcagtcggttgaatctatggatgtggaaggcacagatacagagggccaaccacatatatttttaaagttttattttcttctttatagtaattgtttttagttgggggctgtttgctaatttattaatttggtctcccatttttgggcttctggttttaaaaaatctgatggtaattcattttttgcccttattaataaatgaatatctatatttatgaataccggtagcttgtgtggacactgtcagcctcaaagcttactcctgaattttcagggaggtgtagaagcaggtctttaatctgagcgtcttcctaatgttggtcatcactctcctaaaggatgcccttcacttggcttttttttggttacataatatttctacatatttatgacgcacatgtgatattttgtttcatgtatagaatgtggaatgatcaaatcagagtacttggggtattcatcaccttaagtatttagcagtttctaagtatgggaacatttcaagttctctcctgtagctactttgaaatatacattgttgttaactagtcaccctactctgctatcaaacattagagcttattccttctatctaagcggatgttttcaccccttcaccaacctctgttcatcccccgccccccactttccagtacacttggctgttttctttccatgacctaagtttctcaatagaggtgggaaaatatagcaactctctaccatcataaaaatagcttggttgagttattaattttcattacatacatacctatttagttttaattgttttgctaaaaacctaggttttcttcattacgattttgatcccttttccttgattttgtgtagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggtgagggcatggctacgccgcgcgggttccgctctgaagactggaggtgcaggcagctgctcctttggtgattttcactgcagcagggccattagtttctgaacctggtgtcacctgagtgatggcagcttacttacttgaatgtatggttttaagcttgaattagttctctgtagtaaactcattcagaatattaattagtctgttttcggctgtgcatggtggctcacacctgtaatcccagcactttgggaggctgaggcgggaggatcacctgaggttgggagtttgagaccagcctgaccaacatggagaaacctggtctctactaaaaaatacaaaattaggtgggtgtagtggtgggtgcctgtaatcccagctactcgggagcctgagacaggagaatcgcttgaacctgagaggtggaggttatggtgagctgagatcatgccattgcactccagcctgggcaacaagaatgaaactccgtctcaaaaaaaaaaaaaaagtctgttttctctatagattgcttatgcttatttctgtatggttgtcatagtagtaaacaatgaaaacaaatgtatccattgaggaaggcagggctctaagctttgtggacaggcagaagagcagcaggcgccctcctgcctctgaggcctgccagtcagtgtgaggagtgggacacaagcgtgtgacaggagggagactaattggcaatcggccaaacagcagtggctgatacatgagatcgagttgagcagaaccatgaagaatctggaaaccaagacccatggtaaagaacagaaggggctctcagaatgtccttcctttctggagaaaggaagaccaaagtatcagcgttctcctgaagaatcagaagtgtttctgtatataacagggatgcttatgttttgctctaggagatagaactaattattcagcaacttaataaaacaaaccgtgaagattttaatattgcaggatgtttcagaaaaccaaagggtgtgttccttgtactctgttctacagaggacagcagcaggtgctgcagggaaagggtaggtggtttcaaggagctgttgggttggcagtgccaccctagtgagcacacaccttgactgctggccttcatgtttcgaccacagcaggaaggggaggtgtgttcagctagagagtgacaatgagggaggtcactggagaagagagagagcccaggtcccactgggtggtgtggccacaggacccttcaacagcgagctctcgttgagccatgcagtgaagttccggggtaggatctaagttgatggtgtgatctgaggttgggcataagacatagaaagttaaactaaggagaggaggagctaaggggttgtgatggaaaacttgagatgtttataagaaggagtccagtctggccagcagttgtgtgtggcctggaggaactcatgaactaactgatagggtgagatagttttccagtaggggttagtggtggagtcatagatgagaaagtcaggcctggcaagggtgtcacatggaggtgttgagacagcagtttgtgacctgcctgtgggtggggcgtgccagccaattagcagagacaaaatgctaccaaggcgacataaagtgctaaacatgtctccatcgactgtacctgaagaccagaagagtgggagtgttctttttttttttttttttttttttgagttggagtctcgctctgtcgcccaggctggagtgcagtggcgtggtctcggctcagtgcaaactccgagaacgggacgttcttatagctgtgttttcttcttcttgtcctatccttcattttaaaaaagttcaaggttcagactcccagtgagtaagtgtgatgagaaacaaaaaatggtactgaagggtgtcctgctccccagagataagcactgttaacagttttttgagtatttttttcggaaatgtctagacatataccaatgttaagttgtacgattctggttttcaaatttttacatatcaatgagtcataggtatttttcttcgtcagtatctataaacctattttattctttttaatggcagtgtagggttctgttgcatggggataccaaattaatcttaccagacccctcccgacgaacactgagtttccacgcttggtgactggcagggcgctgtggtgactcttccgtgagcctgtgtgcctctgatggctcagtgagggtagagtctggcaaaggccaccagagggccgtgtgcctctgtctttcagagactccgagtgcctgttttacagctgcagccaacaggatgggggaaatgatatctcgtcgttttcatctgttcttctttgattctaagtgtgattgaacagctttgcatatggtttttggctgtttgtatttcttctgtaaactctctgtgcattgccaacttttctactctgatatcgtttgggttttcctgctgatttgatttgtcagagttcttgggttttttaaggaaattgtcttttttttttttttgagacagagtctgactttgtcacccaggctggagtgcagtggtgtgatcacggctcactgcaacctctgcctcctgggttcaagcgattctcctgtctcagcctcctaagtagctgggattacaggcgcctgccaccactccctgttaatttttgtattttcagtagagacagggttttaccatgttggccagtctggtctcgaaatcctgacctcaggtgatctccctgcctcagcctcccacagtgctgggattacaggcgtgagccaccgctcctggccctaaggaaattatctctattattatttgtcctgcaaatattttcgttgttatttggatttgtttatggtattttttgtatggagtgaagcttaaagtttttcttggccaaacttaagcagaacgtagtaacacctaattttaatttatatagttataaatttcaaatcatgaagtcgtttgtcaatatgtctataattaatgctttttggataggcatgttcgaatccatactggagaaaagccatacaaatgtgatgaatgtggaaagagttttactgtgaaatccactctcgattgtcatgtgaagactcacacaggtaaggaaaacatgcctgcgtcattggtagaggtcttaggatagcatttcgtatgttttgttcctatatattttgtgtacataaatactttccaaattatagaacgcttaaaaatgaggcaccaagaaggaagtgatataaaagatttttttattcctgacacagggaaaactgtccaaatgacactaagaaaaaaaaggattaggtctcaaaagttgaatttttcttaaaaattgtcacgtattcttactcatgcttaaataactttgttaaaaagattacctcttagtctcatttaagccaaagaggtttagtttgttgaggttttgtaaaacctggcacttagcaaatctgatggcagttatcatttcataattatttttatatggggagaaactcttgcaaaggcagaaatgaatgtccaagtttcctggcctttttctcatcttcatcttgtctgtgcctttgcttctggaattctgcacagtgcctcctagcggtggggaggctgcctctgcctctgcctgcttgggaatcctgtagtcctcctgtgagctctgtggtcctagacaaggttctcctctcagccacaagtttcttctgcagaagatggggctaatagttgtacctccgtctttgggagttcagacatttaaatagctttaagcattaagacatttaaatagcttggaaaagtgtttggcctttggtaaacacttaggaatggattggcctgtggtaaacgcacagtgaatgcagagctgttgttataatgattcatagaattatgattatgagactaatttacattcttcattgttggttataagcagaattcaacagacaagaacaaatggactttcacacatttacctgaagccctgtgattcttttctgatgggttaatatttgtaactagataaacagatccctgagcttgtttatatgactgtcctgtgtgcagtttttctgttgtttcattaggctccctgtatttatctcttttgtgtaatgcagtgaactttttgtggatatggagggcccggcatcacttatctttgtgcccccaggcctagggcacggcctctcatgcagcaggtgcccagtgacgtccacgatgacttggtgcacgctgcttcatcatttccttggttttggagttcagcgtaggccacgtggataaggactagaaatggaagtctctggataaataccttttggtgcctctttctccattctgaagtagaggtgtgatttctgaggaacccagggcggcgttgggatagcaggttgcactagtccctcggtggatcctagtgtgcaccatcctgtaaaaattagcatttgttcctggacagtagaggggaaaagccagccaggaagtttttcagctcccagaggctcttggagggtggagcctatgctcatggtgctccgagccttcgtggcctttgatatacccagtaatcatgaaaagagcctaaggaactaggtacatgacactaggcacacagccctttgaccctagcatagaactttcctttgcatattctcccagtgtgatgcctacctgtgctggcattgtggttgcacctgtttggcagaagagaagatagagagatgctgagatgttaaagtaccacttgtaaaattaaagaaaagtgacaagtaattcacgatgctcgggctgttaagctcataccacccagtataacttactgatagaatataaatacaactagctccaagtcaagggttcaccaatacatagcagtggatttaagacaacactgctaacaccgtcaacaggcgttgatgcaagaatgcataagattcaccattgctaaacgaactacactgttaaatttacaatactgcagcaattgcctgtgacgtccgtaacatcgttataggtgaaagggattctcattaaagtacttccatccactgattcaacatatttacatccatagtgacagctgagtggggtgggggtgagtgtcgcgactgccatcgcctctgttgattcttggctgggcttttcacaggtcagaagctcttcagctgtcacgtctgcagcaacgccttctccacgaagggaagtctgaaggtccacatgcgcctgcacacgggagccaagcccttcaaatgcccgcattgtgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcaggtaaacgctgagccgagggaatgagagcagcacagtgattgaactgttctgtgctgcttctgtctgttcccacgacagaagagatgttgtttaccgtagcaccacgtttcccttctttgagccttttccttataaggcattcggaaaaattggaattccgtcttgcagacattgctcctttccatttcgcattctgtcttccatgccagctgcttttttacactaagcactttgtttagcttttgtttttagtgggtgtaaacctgtttttactcagttggcattctcataaatttagtagtgagaagtgtaatttataaatactcaatagcattgtttttgatatagtgcagttttccagttgttcttgcgtctcatagtgcttgagaagtgttacattttagctagttgtgttgatttgtgtgcctgtgagtaaatgcagccgttgtacatggcagtcagatgtcctgtgtgcccttctttctgtttctgtgactcgtggcaggattgcagcctgaccaccactcagtagtagtggttgttttgaacctttggctaatcagtagaatctttttgagctacttttctgatacgtttaaagtgggcaatatgagtatccatttcacagagttctggggtgattagacagtgtgtgtgtatggtataaagtgtatctgtttcacagagttgctctgcggtgattagactgtatgtggatatagtaaaaagtaggtttctgaggtgatgagacagtgtatgtgtatatggtataaatgagatttcgcgggtgattagacagtgtatgcgtatggcataaaggagtatctgttttacagagttgttctggggtgattagacagtgtatttgtgtatggtataaagtaggtttctggggtgattagacattgtgtgtatatatggtataatgggtgattagacagtatatgtgcgtatatggtagaaagtaggtttctggggtaattagactgtgtgtgtatatatggtataaagggtgattagacagtgtgtatgattagacagtgtgtgtatatatggtataaagggtgattagacagtgtgtgtatatatggtataaagggtgattagactgtgtgtgtatatatggtataaagagtgattagactgtgtgtatggtataaagggtgattagaccatgtgtgtgtatggtataaagggtgattagacagtgtgtgtgtgtatggtataaagggtgattagacagtgtgtgtgtatatagtataaagggtgattacacagtgtgtgtgtgtgtatggtataaagggtgattagacagtgtatatgtgtgtgtgtatggtataaagggtgattagactgtgtgtatggtataaacggtgattagactgtgtgtatgatataaagggtgattagacagtgtgtgtatatggtataaagggtgattagacagtgtgtgtgtgtatggtataaagggtgattagggccgggtgtggtggctcatgcctgtaatcccagcactttgggaggccgagatcgacggatcacgaggtcaggagatcgagatcatcctggctaacatggtgaaaccccgtctctactaaaaatacaaaaaaaaattacccaggtgtggtggctggcgcctgtagtcccagctactcaggagggtgagggaggagaatggtgtgaacctgggaggcggagcttgcagtgagctgagatggcaccactgcactctagtctgggcgactgagcgagagactgtctcaaaaaaaaaaaaggggtgattagacagtgtgtgtgtatggtataaagggtgattagacagtatgtgtgtgtatggtataaataaagggtgattagacagtgtgtgtatatggtataaagggtgattaaacagcatatatgtgtatatggtataaagtaggtgttcgtattccacaacaacattgtattgacataatgtgtacaacttatgtatttaaaaatccctatgtaaaaaatgaattactttagttttaagaagcattcataatatttgatcattctctttctctttctctggccagctgggggtgacctgaccgtgtctctgacagatgggagcctggctaccctagaaggcatccagttacagttggctgctaacttggttggaccaaatgtacagatttctggaatcgatgctgccagcattaataacattacgttgcaggtatgacaccttccatggtctcctgtgctgtaattctcttggcatcacagagaagcatgaagttttcattacaagtacctgtgctgcttttcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtggtaagagccactcacttttgcttattttgacagctggagtttcagtttcttgcttgtgattacatatttgaatttaggatgttatgatgtcattttcttctctttgtagaagagaataaatcaaatgtcctgagaataaaataagcttttcttacaattaatgatatgtatttaatatatgctcttagattattactaccttcatttaattactcttttcatcctggcttcatttcctcacaaggctttcttcttagacgaaggaattagagatgactgatgctttgttttaaatctttgtcttattgaaatatgtaataacagtttaattaaaatatttttaatataaaaacaggggaaattggttattttgaatctcaactttgttttgctttgtaatgacaatcagggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccggttagtaagttataattttaaacatcttttcaccctgcaatttaagtactgtatatcttactatctcttttcctacaatactctgctgtgcataaagcccgtgctcaatatgtatttataatttatgggagaaattgaagtttagtgaaaataatgtattctaattcagatctggcaccagaaatgaaaaattatagtttctcatgtcacttccagtttgagtacagtcagttatttaattatttcattcattgactcatttttagagaataagttatttttgtttagcaaacagcagaaagcgtagctttgtggttctcactcatgctccatgaaactggtataaactgtttacattagggcattttagatccgcatggcactctctttaccgtatgtcttcagaattctattaggattatataggaaaattgaaacataggagaacattgaaaagtagataaacgggtaggaaataccctttggcagtaaagcccacctaaaactggcaatctaattctctctgccagtcaccaggctgactcattccctgtcttagggctatgctgctcgcattctgacttttctccttgtgtgccttccttggtccttacgtatcattaattcccatagtgtgttcggatctcagtgagcattgaacatattttcctggtgtgctttgctcacgtgactcttaactataaactctttgtattactaagagtcatttgttaattcagcaatttttagagcccttactatgtgcttgatattattctagtaacttccacagatattaactcattcaatattagttcatttaagactcgtaacctgatgatgatgttaacaaagacattttgctaggaatcaaaacacgctccgtggagatctgatgtgacagagggaagcagccccacttccctgaaacacacctgtggagaaggacagcattctagatggactcaaccatgaagggcaggatttctgctgtttcagagatatttctgcagaaattaatttcagaactgaaagaaaaggtattcataagaaaaccagaagctttctttttcaggaaggtgtctttatttcttttaatacattagtgagaaatttgaggaactgtttttaggtacagctttgcttttaaatgagatgcagtggtttttagatgctgttggacagcaaaaattaacattgaattttatataattcagtaaccttcctccttttaaaattatatttatatctgaattttaatgttggaaatacagaagagttacaatattttaggaaagctatttggttgatccaattaactttctcgagtacacttaatataagaagtattgtgctaggtcctatcaaaactacatagtgcatggttcttgctcagagttaagaaaatgtattcttcagtttgtggattgtgcctctgttcttcctgtgtgttattattggccatttggttattttgttagtatatttgaaagtgtagatgaatataactaatattttaagaatttggcttcagctgttctaggagaaaaccttaaatgagttaatgaaataagtttggtttcaactttgggcttcagattgttttttctcacttattatgatggataatgagaattggctatacagttccttatcccattttgaaagggctgcaaaaagcatttaatttatggtaacctgttaaaagcatctagatattccatagaaattttcaaagatttcatagtgtgttcttttttccattaacacataggattataaatgcatgcaagtactagagaatgcacaaatcacttcagctaagttttgcagactttaggcagttcatgagtcctagcattcagaaaaaggttacacgttgagtgaaaagcaaagacagtcctttgcctcccggaattaccctgtccagatacaatgaaagtccttttacctgatgttttcagcccagttattaataaaaaggtatataaaattgggaaccaaacaagtgacatctgcatactttggagattcatccacggatcttttgaatatgggtctgctcaggtgataatacattttctactttttaaaatttttgcctgtactcatgttcatcatgcagtttcatctcctgtttctctttctttagcattgcatgagaatgtaggtcactataaagcaatcatagtgcagcatacttttgtcttttgaatctttttctctctgattttgtgtagttgtcttgcctacacctattttgacagcagaatgtttaaagtatcttgtctttaccaagtttttccaaggcattcaatttggtttccattggatgtccaacagattttttattctcatattcatttctagttgccatactatttgatttcattatatcattacagtagctgatgaagctggcataaacgggttttgaatcaagcaaatgtgttttagtaggaatgtattgcaggcatgttagtgtgtacttgagagcattcagaacacataggataggaacacagcacacgggaaaccgcagcatcgtgggctcggcaagcctgcccagtggagggcagggaggggaggttctgttatcgcctggtgatgcccctcagatccttttaacatgcttttgctatacctggcagtgcactatatttggaaatattttcaattcattgacagtttcattccacacagtgtgtgatttttagggcctaaatactgagttaaagtaaaactcataagaagtatttttaaaatacttcacagcttaaaaagtgtgaacaaatactgtcatttagggaaatgcattttgtggtctcattttcatttttccataaattgtactgaaatgacaatgaaaactttgaggatagaattatatgtttaacacacttgccaatacgcatcttagaatgttgttttcagataccacaatattaatttccatttaggtcaagaacttattcaacacaattctaatggaaatagtgaactattaataaacgggagcataagattgttagcgcctgaaatcaataatcaatctacaggtgccaccctaacaataagcaatgatcagcttctctcccagagcacagcattgagctcttcaggcacacagcacacgagttagccaagaaagacattataagaggtcggagctaaagagctctgcccacagtcaatgaggagttaaactgtccttagcatgacaggtgtgtcagcgtcatgctttgtcacatggattatcattctgtaaggattactggcttatgtctaattctaggatacaaaattctctctaatgttaccaaccaatcgatgatgttactttttaagccatgaaagtaaataattttattcaactgtacaaagcatcgtatatttatacaagttagcatgttaataactccatgtacaaagctgtccctttctaacccagcgctggaagactcttacttagctcattacttctgccctccagtgagaattttctgacaccagctgaaaatagaatagaaaaatggaaaggaggcagctttctaagattttaaagcatagaattttatgaaaaataaacatattaatattggcagaaactgcaattacttttgcaccaacgtaataaatgagctcatgtaagataaatgacagtttcataagtaaccattaacagtttaggataacatacctatctcgttctcttcaccttgtagagattgcattcacttcttagccttgttattttccaactatgtatatcactttgtgaggaaaaaaaaactaatcttcagatatgtttgtacccaaaagctagacctcttttcatgcttcattcttaattgaaacgacctcttgtcccgtagttcatttattccataaaagattatagtgtctgctgtgtgctaagaattgtgcaaaatctgggactgtgactctgggcaggtcagagctggccctgtgttctggatctcagaataaatggagtgcagacattttttgaagaatccacaagtgactataaaattacagctgtaaccatatataaaggagaggtgatggcacagagagcacatgtcacagggggtggctctgtggcttctttgaggacatcctggctgagctgagagaggggcttgggagtgtggtggcttttctcccaacgccagccactcagctttgcatggcccatggtggcctttagctgaagcaaggaggtgtggatattttaatgggtggaaggtccaaaatatatgatgtattgttgaagttaacatagcaaatgtttttctccaaacgttttctaaaactcatagtttgtggtttttaaaggatcaggcagtgtgttcttctcatctctagaattctaatcttaggctgtgagttcatcatctttcccccgctgcatggttcatgttgcaatgtgaagacgtgctgtttgtgtgtgggccgaagcgagtggtagtcgctcgtggtgcagggctctgggtgagatgtctggattcatgccctgctggccggcctcactgagcaggaaactggccgtcagcagtgcagcctcatgtcttcctggaaactctgctgaacatccttagtgagcccctggcacattgatggagagacaagttgggttgtagaggtttcagtttgagtggagtggtgtttgtgcctcttggtgatcctggatgtttgtaggcgcagcagattgcttgattcgaaattggggatgttctgaccgaagggagaagttggatggaatgagggcgcacgcactccagggctctgctctagctgcccgcgtttctttaaactcctgtgatctggctagttcggtagtaagtgctgtacctataaattcacctccacagacgcatgttggaagtgtcacaccagcatctcacactcaggtgagggtcctttcagggcaggcgagctgtcctcagtcagtgggtgcaaggctcccacatgttatgcagctgacatttctgtataaacagcaacatacccactttgctgatttgcattttttaaattattattcttttagacctttttttaaagagccagccgaggccgggcatggtgggtcacgcctgtaatcccagcacttagggaggccgaggcgggcggatcacctgaggtcaggagtttgagaccagcctggccatcatggtgaaaccccgtctccattaaaaatacaacaaattagctgggcttggtggcgggtgcctgtaatcccagctactcgggaggctgaggcaggagaatcgcctgaacctgggaggtggaggttgcagtgagccgagattgtgccactccagcctgggtgacgagcaaaactccgtctcaagaagaaaaaaaaaaagagtcagctgagaaaatcagtctctctctctcactctctctctctctcttaggctactttagcttatatcccacttgttaaattaaaaaaaaaaaagcttttcaagggattgggtgacattataaaataaaagatgaacgcataattaaagaatatttgtgtattaatgtgatatcggctattcttaaatacaggcttagttttatgtgatcaagtaagttgtcttatgttcttgaatacctttggcatctttgaataatcctgggtataggaagcaattgttcatatattgacccactcaatccttgatattaagcagatgtttttagagtggcttgcacatcccatttgtcctagttataattatgtagtggatctcaactgtatagtagtagttaggagattgcctcttagtgagcaatatttatctagagtcaaagtcagtttcagatctagcttgaggccacaccactaataattgaaattaaaatgacattattttgaaattaaacatgactcttctaaggtaaacactcaaaaacctctaatgcccatacaaaacttatgttgagcataatgaatatgtatatggctattattattttttgattctctatgcaagcaaggtttggttaagactcatcagcttctaggttaactctggctgtttcatcttaatcgaaggcattgaaagaagtgtatcaccacttagggatttgcgatgaatccaggcgagacaattagtcagaatttcacatgcaggacaaaagcacatgcttttgttgagattcgtgatgcaggagttgaagactatttcagagtttcatcccaacatccattcccaaatctgacacaaagagttttccttaaaaagtgatcccatagaatgtaagtactgtctcagaagcagatcgtagtcttgatagaggcttgagaaatttagcacaactttttaaggaattcatctcaaatgagtattatctttttgttcttaccttcgtccacttttaaatttaagataattttgatgaataaattgagttctgcttttgatgaaagaagcaaagaccagtatttgttttctatttatttgtagggttattctagccttagtttcttctagatttaagtataatcacttattttatttttaaatagttcaacaatttaacatttcccattccccggtgtatattaaaactgaagaggacgttctcatcctcacgagttgtccctttgagtgacctggatgcttgggaacgaggggctaccccgatgcttctctcctgttctgccgcccccacctcctgtcttcccacatttcagttaatcgcaagaaaaaactgatatcatatcttttaaattatttttagaaccttacaaaattatgttttcttagaagctatgaggtgatatcccaagagatttaagacaatgttgggtttgatgagcgtacagtttattaatctttttaacttatttttgagtcggaatcataaagtcagacttgtattgctctatacatgctggaggaacagtggtttcagaaaaataagtgaagaataaaagtaagagtctacaatcttcacttcagcatgggatcttcattttcatgctaagagtatttaatttgaatataagattgtagcttttaacaaatggatagttaagagctatttgtagcttgtaatttaactgcatgcttaagaaaatttcagcttttttctgctctagtcatgtgttcttttcaatcatattgaggacagttctactggaaccggtatcatcctctttgtggaaaatccattgaattaggacattattaaaggttcactgtttgagttgaaatacgaaatttggccctgtctgaagttgtttattattttcattgaactttgtgtcaggtttcactttaatcaaacacaagccttctctatctttttacatttttcatgctgcacagtcccggaacctctgataccttaataatcactagaaagtcaggattagttgactggtgggagtggggagaagatctttggttcctttatttcagcagttggggtgaggtttgaatttttgctgtgcgctggcttcgccttggctctaagtgtgatcctgggcgagattcacaggcacatgcatctcttccccgtcttccctctgtgcaagctcattggcagctgccacctgcccgcccgccccagtctctatggttttgaccactcatgttaaaaacgtacccgcaggctagtgtgcggtaagggtgtgtggagggaattttaggaggacagctattaggtcagctgctgtactggtcactggaacgcttagtgcatgcagacgtcctccacaaggccacactcctcgggctcccaccagcactctgtgcggatgctggagcaggcgggagggtctgacctagctatctgtggagccccggcggctgcttcagcgctcgagcctcccagcctgctaatggttctactgcttttgaaggttccaggtctgtgcagcacagtgtgggaccccaggagtgtggatctgtggaggcattgtatttggagaactccagcgacaagtaagtaacctagttttcctgttggcccctgactcctaggagagcgctggactgatgtgacccaagtcacagcaaagtgctgacaggcgcgtgtttcttttgttttgaaacctggttaggcaatagctttttgaactttcctttggtcgtcatcttggcatccttagcaactggcacagtggctggcacaagtggatgaggaatacatgtttcaaatgaatggatggctcgactgtgggataaagtgagtgtgcgtgtgtgtgcccatgtgtttatactttcaacgttgtgttcactggtgcccactacaggactttgataatcccatgctgaacccgtctcatctgccagcaaggtacatgagtgtctgttttgtaaaagaaaagccctttcttcaccagatactttcgtttctcttagtatcggctgcaaggggagatatttcagttttgttgtcttttctgaagaaaattaagatgtcatgcaggataaatgaatatttaaaggatttatgagatttattttgacctcctgtcttttagaataagaatcagtcagggtgatgaaagtgagaaaatgagcagagatggtcagatttatcccgtaagctcaggagctagttattcctcagtggatcacacttgcttcctttcttcagctggtctcttcagttgtggatgggtaagctccggaagtagctattcctcagtggatcacacttgcttcctttcttcagctggtctctttggttgtggatggggacaatgcactggaaattcttgtctgagttttcattctacagtagtagctgtgactgagactatggggtcacattttcactctttgtttactggtttttctctgtgtgtgttatacttaagaagcacagtatattcatatgtaaagatgtttaaaaactaagaaaagccttatcctaaaattagaattgaagaccctgtgatttctttggtgcagcttggagacctcgggcatgaatgctgcttcctgcaggtgggagcatcgctctccctatgcccttacacctggacttgtctggccttcccattgatctacttactttgcctcttttgtagaacttaacactacaagcggaagccttccttcaacaacaccgatgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcaggcaagtgctcctcagagagggatgcgaaggtcctttcaaaaagtgatctttgaaaacattattcattgactccttcctaaataaatagtctgagcattttttttccccaaaatcgaagcattttttttctgattaaaaaatacggtaaatataaaaggggataaaaattcagataatgtagaagaacataaaaaataaggtaaaacataaaacccaaagctgtaatcccaccacccaaatggaaccacagttaacattttaatgtatatatccttctacacctttatatgaatgtataaggtacatagttataaatttctgcagaaatttataaaatgatgtacacatcatgtagatgagctttattgaagggcattatgttgtattcatggtttcaataagtagtatggaatttttcatgcccttagtcactgagattcttagatgaattcctaccagtagaagtgctgtgccaaaggggtgtacatttttaaatgattcgttgagctaagatgctgaaaaacctttcagactttaattaggaaaatcataatgatacattatgattagttataatgaaggtgaattataacaaagctatgccagcattttgatagttgaagactaattataataaggctgtgtcagaattttcatagttgactgtaaaaaagtctattcttagttgatgtaaattgtgatttctatgtgtctgttcctggctgtaatagaagcaaaatatgcagcagaattagaaagctgaggctggacacaggtggctcctgcctgtaatcccagcactttgggaggctgaggtgggaggattgcttgagtgcaggagtttgagaccagtcagggcaacgtggcaaaactctgtctctacaaaaaataaaaaatttggccaggcgtggcagtacacacctgtagtactaggtactccgggggctgaggtgggaggattgggtgagcctgggaagtcgatgctgcagtgagccatgattgcaccactgcactccagcctgaacgacagagtgagacctctctctcaaaaaaaagctgaggttgttttcaccaaaacacattccttgattgtcctgtctctgctttttaggctcactgtacaagaaaaacagatgttggcatctagagcaggattggccctaacactattacaaccacttgctgaagaaatggcctcttctgagctctagtccctcgcattggtgaaatagcagcatttcctctgcatcgcttcaaggcagagttcagtcagtctcccttggttgtgggatgctcacatgttgttggcaaataggctttgcctagagctcctcaccgaggccccctgcacagccactaccctcttctgaggtgacccaggcgcaccgcacgccagggttcctgctcactggacacaggggctcccctttggctgacctgcctgtagccaagcagccctgcctacgtcgtgcccccagggacctgtcgggcagcccctgtcagccacatgtggtgctgggaagcagagcttgcatctcactcagaggcattcctcctgagctgtgcggagcgcgtgactgcttatggagtttaacacaccttcttcacctgcccttacgcaccatcaactcctgcttgtcacataattaaccttctaaatgttagcaattcgtatcatgttttaaaattgtagttggaacaaaagtaaccgactggctgggcgtggtggctcacacctgtaatcccagcactttggcaagccgagatgggcttgaggtgaggagtttgagaccggcctggccaacatggggaaactccgtcgctactaaaaatacaaaaattagccaggcatggtggtgggtgcctgtgattccagctacttgggagtctgaggcaagagaatcacttgaacctgggaggcagagattgctgtgagctgagatcgcacctctgtactccagcctgggcaacagagtgagagtccatctcaaaaacaaaaacaaacaaacaaacaaaatacccatcctaaggtgtaaatgactggggtgtgctttcctagatgcaagaagcatgatgattatggtggaccagccaggtctcctttcctacctgtcatcttggtcactgtatctcagggcctagtgaagccccctgaggtctggggcaggcagtgggcagggggaggctggatgggagagcacttttccttatttaccattcaaggaacacacttcaaatccaggtacaggagtctgtacactaactcagagtcatttgtctttcccacgtttttatttgctgctaagatgttgtttttatatttaaatgatgacggctgtaaatatgaccttacacttccggttgtcttgtaaagccttaagggtgtaatgtgcattgggctttgggaactcggtgggcgaccctagcactgcatttgggaacacggtgggcgaccctagcactgcatttggtaacacagtgggctaccctagcactgcatttgggaacacagtgggctaccctagcactgcatttgggaacatggtgggctgccctagcactgcatttgggaacacggtgggcgaccctagcactgcatttgggaacatggtgggccaccctagcactgcatttgggaacacggtgggctaccctagcactgcatttgggaacacggtgggctaccctagcattgcgtttgggaacacggtgggcgaccctagcactgtgtttgggaacacggtgggcgaccctagcactgcatttgggaacacggtgggctaccctagcactgcatttgggaacacagtgggctaccctagcactccatttgggaacacagtgggctaccctagcactgcatttgggaacatggtgggctgccctagcactgcatttgggaacacggtgggcgaccctagcactgcatttgggaacacggtgggctgccctagcactgcatttgggaacatggtgggctaccctagcattgcgtttgggaacacggtgggcgaccctagcattgcgtttggcaacacggtgggcgaccctagcattgcatttgggaacacaatgactgtcctgttatatgtgtgagtcagctcccagggtccctggtgtgtttcttattgtagacttttaactatcataattaaagacatagtaaagaagtaaaaattatttaaaatataaattttaattagttaaatgcctttgaataacttttggagtgtgggattgagtttgatgagaaaaacccagaaaggcatttatttcagtgattatgagagcgtattttctgtatgttaagttttatcactttgagaattatccactacaattaaagtgaaagttcagtaagtagttctcagtattgtctaggttgtatttttaaagtctgcaaatatttgccaggatgtcccatgccttttttgtagaacaggggtccccaactcccaggttgtggactggtacctgtccatggtctgttagcatccaggccgcacagcaggggtgagcgtgggccagagagcattactgcctgagctccacctcctgtcagatgaactggggcattacattctcaaaggagcatgaatcctattgtgaactacacatgtgagggatctaggttgtgtgatccttatgagaatctagctaatgcctgatgatctgatgtggaaaagtttcatcccgaaaccatctccccaacatcccctacctcaaatccgtggaaaaattttcttccatgaaaccagtcttcctggttccaaaaagggtggggactgctggtgtagtgcacaagggtcacccaggagccttgtgagcgggcaggtggttctccaagcaggttcttgaggaagggctgtagagtgaagctttggtggcagtgatgaccctgggatgcgctgtggcccatttcggggcctgctgtcctcaccagctggcagctcaggctccctggcttcacaccagtggggtcactttctcatttaggatgctgcttttggacaaaagtcctgtgggtcctcagcgcctcaggacaaactccatcagctgcccctctggctcctgcctggcccctgctacgccacgtggacttgggctctgctggctgagctgccagtacctcgtttgccacgccctctccctcccacccactgcacaggtggctcctgtgcctggcatccaggatgtgcctgcagccacacaccctgccattagcgcttccctgctgcccccctcagcccttccactctggcctgcggacatgggagcaggaggctttgtgagcagcacgagccgggtgggtcttctggagcctgtgtctatccagatacattagtgtttctgttaagctttggtgggttaagttcattctgtatattcttttctgtactttaaaaaaaattatcaaatacaaaatttttaaaccaaattgattaattagcatgcattgtccaacaagtaatttaaaaatatccaatagaaattgtgtagctttatttgaatcttttttctattagctggcaaacttagacttgtgctgatttaatactctgaaaacttgcaaaaaccagatgaaaactttcttagctttttgaatggtatttttctaaacataatgaatccttggtagcaataaaaccaccattttattgtcaagagattaatgaacctacaagaaaatggctgtaaatatgtaaattaaatttgacctgaaaattagaaggtggtcaagagaaattaaccggtgtctaatgatgattgttcagttaagagttattcactaggggataaatgtcgaatgatttaatattacttccttaaaatgacatgtgctccttgaatttaatgaggaaacggactaatagcacggggaagagatccaatgtgaagaaatcaagttgttcagcattataccaccctgaacactgcactctgtgcatggaaaaataagaatctccctaaatggactgaaggaaacagtaatataaacatagaaattactgtacatatttaaaagataggaaagtcatgtaaacttattatgtattattttttgtttctttgtaaaatccatgaaagaagatgttcctaaaaacagagaaaggtggtcttactttacttaaatagtattctattttataatttttttaattttttatttttttattattttttttgagacggagtctcgctctgtcgcccaggctggagtgcagtggcacgatctccgctcagtgcaagctccgcttcccgggttcacagcattctcctgcctcagcctcctgagtagctgggaccacaggcgcccgccaccatgcccggctaccttttttgttattttttagtagagacggggtttcaccatgtcagccaggatggtcttgatctcctgacctcgtgatccgcccgnnnnnnnnnnnnnnnnnnnncgcccgccactacgcccggctaattttttgtatttttttttttagtagagacggggtttcaccgtgttagccaggatggtgtcgatctcctgacctcgtgttccgcccgcctcggcctcccaaagtgctgggattacaggcgtgagccaccacgcccagcctagtattcttaaataatgggcaaatttggctgggtgcagtggctcacgcctgtaaaacctaggactttgggaggccgaggcgggcggatcacgaggtcaggagatccagaccatcctggctgacacggtgaaaccccgtctctactaaaaatacaaaaaattagccaggcgtggtggcgggcacctgtggtcccagctacttgggaggctgaggcaggagaatggcgtgaacccgggaagtggaggttgtagtaagccgagatcgtgccactgcactccagcctgggcgacagagtgagactccgtctcaaaaaaaaaaaaaaaaaaaagaagagcaaatttgagttcataatagcaaaaaatttggaatatatatgtttttataagtccataattctaatttaaaacttgaaaagggcccaattttggaagaatattgtgggagtaagtgataattttaattcagagaaaattggctaattttgaaatgtaattctgatttatttgttccaaactttagactcttcaggggtgaggaggagcaggccggtggtagttgtgtgtcctgcttgcccactgaagtctgacagttttatcaggaggtgtaaacgtgcatgcagaaaatctattcaagaaagcaaaatgatttttagttcttattctgaatacaagaagaagcaatttacttattcatgaagggaattctcttttatactaattcttgtcataaaaaaacaaacttattattacagataattggtcaggtgcaaaacatttaaaactttgtatttaggtatataaatgtggctttttaagtctaaatttgactgtggagtgacccagaaattggcaaatcttattacagactcctgatgggaaaagaagccaattctgaagtaacaagttagttgtaagtttaacactgagagtcatctggcccatgctgtttaaagctttcttaattttgtgcctttcttagccttgatcttctacaagtcgttcatatttactcttgtacttgtaaatatcttgacatttttattgaggcacaatgttttgttttaagtttattaagagttgtgtataggccggtaaaattatgaactgctaagaaaaatatttctaatgaaattgtacatgtgagcagtaagtgaggttgatttatgggtacttgacaatggtatagtgaagtttgttattgcatagaatgcctttcatcagtatccagcccttgctcatattttacagcatttcccagattcagtcgaacattgacattcctgggtctcagcaggcccaagttaattcagtagtcatgggtggggctggcgtctgtgctgttcattacccaccttccctgtgactctgacgcagctgccccagctgccagggccaacagctgttgcgccattcctctctgctggggcttggtgcttgctgttacattctcatgttgcaaaattcatgtgctccagggaaatgcaaattcctgtaatctttacctcagtgtaaaccaaatatagtaaagaaaccaactgcaaataataatacaaaccaaaagtaaataacctttagattatattgttttagctgatttgtgtatcacttccataagtatagctaatcgttgagtatagcttttattggacactgatttttaaatcagggtatttgcattaagaatacttaaggttggctgggggtgtggtggctcatgcctgtaatcgcaggccgaggcgggtggatcacctgaggtcaggagatcgagaccagcttggccaacacggtgaaaccccgtctctcctaaaattacaacaaattagctgggtgtggtggcatgtgcctgtaatcccagctacttgggagtctgaggcaggagaatcgcttgaactcaggaggtggaggttgcagtgagctgagattgtgccattgcactgtagcctgggtaacagagcacgactctgtctcaaaaaaaaagaatacttaattaaggtttgcaattgaaacacaaatgataagctaataaattacattgtattcaagtttttttaatttaagtttttattttgagataattgtagactcatgggcaatttttaaaaaatagtacagagagattccacatacacttacccagttttgcccaacaggagcatgttgcagaactgtagtataatatcacaaacagttgttatcattgataagccaagatacagaatatttccatcatctcaaggacccctcatgttgctttttataatgacttcaagaccctcttaaccctgacatctgccactctgttctttatttctgtaattttgctatttcaaaacaacaagaagttgtaatttttcccttgatatacctatacaagctaagactctcaaatatcttacctttagtttgggaatatattaatttattgagccaattggttcttatgtgcatcagaatttctgaccagcagtttttttggtctttgattaataaaacaaatgtgaattaataagtccaggttgattaatacagtttttcaaattgggtagtctgataagggtggtggcagcagctgtcaacagacatgtcacaaaaaagtatagcattcaccggtatttgaaaatagcaatattcaatcaacttctctatgtagggaggtagggaacatgaagctttgttagtataggtaggaacttcaggtgcagtggctcacacctgtaatcccaccactttgggaggccaaggttggtggatctcctgaggtcaggagttccagactagcctggcgaacatagtgaaacccccatctctactgagaatacaaaaattagccacacgtggcgcatgcctgtaatcccagctacttgggaggctgaggcacaagaatcacttgaacccgggaggcagaggttgcagtgagctgagattaagccactgcactccagcctgggtgacagcgcaagactttatctccaaaaaaagaaaaagaacttttcaatttagatcatgtttatgtaaaaaattaggctgatatatggagatacctaaaatagcctaattttgcttttttaaaaagctgcatatgggaagtaaggaacccaaatcaagttagaagctctctttctctggaatccctgatgatgactgtatgtttttggcttctattttgccacctgccactctttcccttaagaagtgaacctaaaattctctgatggaggaagtttttaaaaatgccatctcagtcctatttttcctccactgtgtctgatatagtttggccgtgtccccacccagatctcatcttgaattcccatgtgttgtgggagaaacctggtgggaggtaattcattcatgggggcaagtctttcccttgctgttctcatgatagtgaataagtctcatgagatctgatggttataaaaaggggagtttccctgcacaagctctcctctctttgctgccatccatgtaagatgtgatttgctccttcatgccttccaccatgatcatgaggcttccccagccacatggaactgtcagtccaattaaacctctttcttttgtaaattgcccagtcaagggcatgtctttatcagcagcgtgaaaacggactaatatagcatcccctcctcaattcttaatttccttttgggggctcagcttgtgtagttccctaaaacattgagaaacacccctcaccttaaagcacaggagccaagaacatcagccatgcttcctgtggtcagccacggttttaactgtgtgtaaaatatgtttagaatcagtgctgattacagcagttcaagttgcatgctgaattatttctataaatttgcagtagatattcagaccttttaagctgcagcttcctctctgctcttgtgccccataccaccctacctttctcattctctcgtattctctcagatctgctctcatagctagaggtgtgctgggctggtaagaagacttacagtagttttctatagcatagcaaaattgtatatgtgtttctaagcaaataagtgttttttaaatatacacacatgtagagactctgagatgtaatttatataagttcacctaattatttaaagtatacaattgaatggttttcagtgtatttacagagttgtacaaccatcaccatggtctaattttagaacgtttcatcaccccttaaagaaacgtggagccatgagccatcactccatgttcccccgacccccggcccaccctcaccgctgcccctggcaactgccagtccactttctgtctccgtagatgcatccgttctgggtatttcatagaaatgtgatcatccgtgtggtcttttgtgactggcttttttcattccttagagtatttccaaggctcctccatgctgtagcatgtaccagaactttgtaccttcttattactgaacaatattcccttataccacattttcatttgtgcatttatcggttgatgggcatttgggctgtttccattttttggctatgggtaattctcctgtggacatttctgtacaaggcttctgttttcacttctcttgggttgctgggttacatggtgactccacggttcactttttgaggagctaccagcttgttttccaaggtagctgcaccataaaagatcttttaaattattgcttgttttgctaaagttacaacttctgaaatagtactaatcttttgccagggtcagcagttcccagcgctcctcacggatccctctctctcgggccagggtggagcaggctcgccgcaagtcatactagtgagccacacgccacagtcagcgtctgctgcttgtgaagaaatagcctaccaggtacaggatattccttcattcacagagcttttgtcgcttttaaaaacatacagattcagaagggatggtggtagagggttatgggcgtgctgtgtgacccaggtggctggggctgacttctgaggtgtccccggctgaatcctgagtggacataggccctgcgggggcgtgtgttgaatgacaggtacgatatctcattcgttttgtgatttgtttcctagggagtgaggttttaataccacagaattagatgtagccacagtgatacgtaaatctaattttaaatttattaatatcttattatatttgcctgctgatcagacttcacatatccagccacttgcacttagttcttctgcagattttctagtaacacctttgcagattctgttaagtgtcatacacattttcatatacgtgtgtgtgcgcgcgcgtgtgttcaagatctgtcatttggctagtcttttttcttaaaatacatgtttttgggagccaaaatatttagtaagcaatagtctaaatatggaagagtctaaaatctctttccttaaaagtttccagggtcagaattaaagcacagatgatgaataatctctgaatttaggaagcattaaacatttttagcaaatgagttttcaaaataatgacttaccggtttttctgtagaacaagggctttttcacaaagagatgagatataacgagcactggggatgtcctgcagtttgacctgagtaaccagagctgtctcactgaatttcagtttgtataactttagcacatttgtgtctggggtccccaagactgccttcaggtttgacgattcactacaaggtctcactggattcagaaaaatctgatctactggtggttgtggtttatacttgtggttacaatggaagggtgcaggtgagaaccagcggaaggaaaaggcacgtggggtggagtccagagaacccaggcacgagcttcccagtgtctgctccagtgaggtcacacggacactgctgattctcccaggaaagttgtgtgacaccgcctgccaagtgtcgcccacttgggaagctcagctaagctctggtatccagaattgttttacaatcagtcatgtggccatggaatgcccgcgtggttgggcttagctatgcggtctccaggcccctgcccctccaggtcaaacggatgcagtggtccaggtccccagatgaaacaaaaacaggccttcaccataagtcacatcatcagcacaaactatgtggcattgcccaaggttctgggtatgaaatacactcttacctactaatagcaggatgttccaggggcttatgggtgatgctcgggagctgatcaggggcactgtggagtgtgcagggtttgagcacctcaggcctggtgaggtaactgttgaccacacacattcattgagacagaaaaagcattggcagcttggtcatatttttaagctctctttctcatgatgcttttgtagtgaaaccttattagtctggtatgtttcagagttcctaaatcagttccaaggcacaccttacctaattcctatattttatgtgactagtaaatgaaactactttgctattttttaacattatgattttagcatttggtttaatataggtagaagaataatgtttgtagagtaatcctatgttaagattagtttgaaatgtctccactgaagtgatatattccgttttaacttccatattccattagatggaaatgagagaaaccaaatattaaaacttggtctagcttgtaatttttttcaaaatttgacagattaaatataaaaatgaggtagataaccaatctgtatgagtgaatacaggcatacctcagagataacatgcattcagttctagagcactgcaataaagcgattatcacaacaaagtcatacattaacattatgatttagttttctggtttcccagggcatatgatgtttatactatactgtaataatagtgttcagcagcattatttctctttttttttttttttgagacagagtcttgctctgttgcccaggctagagtgccagtggtgcaatctcagctcactgcaacctccgcctcctgggttcaagtgattctcctgcctcagcctcccaagtagctggaatcacaggtgtgcaccaccacacctggctaatttttgtatttttagtagagatgggattttgccatgttgccaggctggtctcaaactcctgagctcaagtgatcgcccacctcagcctcccacagtgctgggattacaggcatgagccactgtgcctgaccagcattacgtttttttttaaatgtacataccttaatttaaaaataccttattgctaaaaatgctaacgatcacctgagccttcagtgagttgtaatctttttgctggttgagggtcttgccttgatgttgatggctgctgactgatcaaggtggtggttgttgaagtttggggtggccgtgacgatttcttaaaataagacaacagtgaagtttgctgcgttgattcttcctttcatgaaagatttccccatagcatgcaatgatgtttgatagcattttacgcaaagtagaacctctttcaaaattggagtccatctctcaaagcccactgctgctttactaagtttctgtaatcttttaaatcttttgttgtaatttcaacaatgttcaccgcatcatcaccaggagtagattccgtctcaagtaactgctttctttgctcatccataagaagcaactccttgtctgctcaagttatatatacctttagatccctatctgctcagttatatataccatgagatccttatctgctcagttatatataccatgagatccttatctgctgagttatatataccatgagattgcagcaattcagtcatcttcaggctccatttctaattctgttgcccattcctccacatctgtagttacttcttctgctgaagtcttgaacctctcaaagtcatccatgagggctggaatcaacttcttccaaactcctgttaatgttgatattttgacttcctcccatgaatcacaaatgttcttaatggcatatagagtggtgaatcctttccacagattttcactttactttgcccagatccatcataggaatcactatctatgtcggctacagccttatgagatgtatttcttagtaagacttgaaagttgaaattactccttcatccatgggctacagtgtggatgtcatgttagcagacatgaaagcaacattcatctctttgtacatctccatcacagctcttgggtgaccaggtgcattgtcaatgagcaggaatattttgaaaggaatcattttttctgaccagtaggtctcagcagtgggcttaaaatattcagtaaatcatgctgtaaacagacgtgctgtcattcaggctttattgtttcatttgtagagcacagaaagaatggatttagcatcattcttaagggccttaggatttttggaatggtaaatgagcattggcttcaacttaaagtcactagctgcactagcccctcacaagagagtcagcctgtcctttgaagccagacactgacttttctgtagctatgaaagtcctagagccatcttcttccactataaagctgttctgtttacactgaaaatctgttgtttaatggagtgaccttcatcgatgctcttggctagatgttctggagaacttgctgcagcttctccagcaacacttgctgcttcaccttgcactgctatgttatggagggtggcttctttccttagttctcatggattgacctctgctagtttccagcttttcttctgcagctccctcacctctcggccttcataacatggaagagagttagagtcttgctctggattaggctttggcttaagcgaggattgtggctgttttgatctgtctaggccattaaaactttctgcttatcagcaacagtgcagtttcactttcttatcattcatgggctcactggataacacttttaatttccttcaagaacctttccttcatttcacaagttggctaatagtttgacacaagaggctgagctttcagcctgtctcagctctctgcgtgccttcctcattaagcttaatcatttctaggttttgaagtgagggatgtgtgactcttcgtttcacttgaacacttacaggcattgtgggatcattaattggcctcattttagtattgttgtgtctcagagaatagggaggcccaaggagaggtgggatggccagttggtgaagcagtcagacacaaacatttataggttaagtttgccattttatgtgggtggggtttgtggtgcctcaacacaattacaatagtaacatcaaagatcgctaatcacagatcactgtaatagatacgctgtaatgaaaaagtttgaaatattgcgagaattaccaaaatgtgacacacacacgaactgagcatgtgccgttggaaaaatggcaccagtagacttgctcgaagcagcctcgccacaaactttcaatttgtaaaaacgacaggatatctatggaggacaaaaaaagcaaagttcaatgaaaacaaggtatgcctataattagtaagagaaattctcttagatgttttctgtaaatttcccttgttaggttgtagcactgtttgccaacattaattggttttaatcatggtctaatttcatcctaatgctttcttgtcacagatggaatgcacattgacgcttccaggctctgacctgggctctgaccagggacttgagacacatgcctgggtctgcctctggcctgtgcttctgggaggaagctgggaccatttgaagcaccctgggtttatctgaacccacgacagagtggctgggagtgctggctgtagcctctggtgatgtctgtgcatccctgctcccatgctttctggccaggagccctcaggcaatcctacatctgtgtgatggcctgtttttaagacagaggtggccaggcacagtagctcacacctgtaatcccagcattttgggaggctgaggcaggaggactgcttgagcccaggagttcgagactgctgtgagctatgatcaccactgtactccaacctgggtaacagagcaagttggtgtttcaaagaaaacaaaaaaacaaaacaaaacccaaacccccaaacaggggtgtagttaggactacctcatagtggtcagagattgggcatgtaatgttccctggcacagagcacaggtcctggtccaaagtaagcactcaggtaaggaccctgctggtggcgttggagcagctactacggcctggggctcacttcgctctctggtgaagtccctagagcaacagcctttgctttttaaaaatccttttcttcatggttcatctgaagagaaatccatactgatctgacaagatgtgtactcacaatggaaaaacgtctttatcctaagagagccattgacagactgcccccttactcagcctgtctttactaaaacgaatgaactaatttctgcctgacccttcccataaggatcaagagacctgacctaactttgttagcaacttcaagctattaaatcagaggggagccgctgcagcaaactgcctttcttccttcactcactgcttaaggggccatggccttcttttgaaactggttttgcaggagaaaagagccgacacttgctggccaggtgcctaaggccaggctcccactaggcatgtggtcttatgtagccgagcccttcccacagcctgtgaggtgtctaagtgtcacggccccgttttactcacaaggattctatcatttaagggtagctttgaataacttaaagtcaccctgccaatagagacagagctggcatttgaatccagatctgtcttatctcactcttcatgtctgaatagaagaatatcgttctgagcatttacacctggatttcctgttacttgagatcagctggtctcagctgggaactttttagtaaggggcaggtttttagagggaggtttggggtcagaagggtgatcatgtgcccaggtgtgtgttgtgggcagcatttctttgaaatattgaccttgtttcagttcagcaaacatttaagttcctgccagtgccggccgctggacgcagaggatgttggatccgcgcccgttctttccgggctcattaggaggtggatggagaggccgctttcctccttctgctttccaacagccacactcctcatgcttgggagggggtggacatacacgctcctaccctcccacccccatgcagaataacctgctgtgggaagcacattatttctagctgtggccaagtttatgcctcaggcttaaaaatcatctcacactcattctgtaaccgatttccccttctcctttgggcaagtatgattttagcaagattctattaatataattcagtctctagatatgtagttatgaaattcagcagaacattggagatttgtttcacagtagtagcaataattcagaagctttgcttctgatgcgattatgctgaaaaatattttacagaaatagtttttaaagtttcgtgtgtttgtttgtctttccttgaatgatgtggaccagatattgaattctcacatctcatgagtaaaatgtttggttcagaaacaattttctgtgtgttcattgccatgactactggtagatgcttcgtaatactgatggaggacattaggtcgctccataactacaggtttttgtttgagttgatgttcttcagcatgcatttatctgcagttacacaaccagcctttagtgtcatttattcctgtgcttttcagacttttttgactcacatggaatatattttatgcagtgacctcaacaggcatgtgtttctgtcatttttctttacactcacagatattcacatgtagacacacacctgacacaggtgtcattttctagaataacacctatagatactcacctgtagacacacacccgacacaggtgtcctattgtagaataacacctgcagatactcacgtgtaaactcacacacctgacacaggtatcatattatagaataacacctacagatatgtgtagacagacacctgacacacaggtgtcatattctagaatgacaccagtccctgcacatctcacgaggctgcaatgtcttttctgatcttttcctttgttcctttttttccccattccattttttaaattatagcacagattaataatatagcaccctgtataaatcttttttgttgtttaagtatttttctttaatgtttacttatttcttatattccagaattaatgaaaaagtatttgataaattaggaataataaaaatgtggacagatctcattaattttcattataattgttttgttaagccatcacatagaaatttgcaaaactggaatctgttgtttataaaagctgagtcagccaggtacagtgtctcacactgtaatcccagcacttgggagactgaggcaggaggatcctttgagttcaggagttctaagaccaacctaggcaacatagggagaccctgtctctacaaaaaataaaaaagttagctgggcatgatggtgaggtggtgcgtacctgtggacgcaggcgtgcgggagggctggggtgggaggattgcttgagcccaggagtttgaggctgtcctgagctgcgattgtgccactgaactccagcctgggcaagagagcaagacttcatctcaaaaaattttttcaaaaattttaaaaatgattttttcaagtggtggtggcatcccattaagatgatttgaaaaccgaattggttgtgatccacggtttggaaaaaatggtttaattccattaaaagctagaaacactttttgttgttacgaattgtttatctaaagctactaccagtagcgagcatttagtgaaagcttgccgtatgcagcccttggtaggcaggtgttctcccatgaggacgcgaccacggactggttaagtacttagcccagagtagcccggatagtcacattggagctggaatttgcacctggtcagtgcggcgccagagctcattccttagctgctgttgtgtggtctcaatcttgcaggacacagtgtgcattctggtctcatattgtgtggaaggcgcctctggctaaattatcctgatgataggacatgcagtgtgggcttggcgtgtccgtgctaggaatgtccctcttatcaccacggtgtgtgtcagttcacaaactgcacaaatcaagccaagtgagtggaaagtcacaatttctggctctttccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggtaggcccactgtgccagggcacagctgtgtgccccccaggcggctagagatgcggagtccaagatttaacactggccgggaatctggcatgtgtttttgaggaaaaggccggtttttgaggaaaaggtcactagatgtagatgtattgttccggttgtaagaggtctgcttgctgtacagatgaattgcatgttcacctgcaactcacaatcaatttgcaagacaaactgaaataacattgaaatgccctctctcccttgtcagactggcaaaaatgtaaaagtctgtcagcacctgttgttgaggctgtggggaaacagaggctcgctcacgtaattgctagtgagactgtgacttggttggactttctgtaggggcattgggcagccctaacaaatgcatgtgtgctcaccctggggaccagccctgaagatgcccctccagcctcccaaggtttagctgcccacgctttccactgcagcagagccatcattgcacagtggagacctgagtgcccgcatgtgggaagcagaggatgagttctgggacatccccacagagggtgctgtgctacagtgggcaggaggcagaattccagcagggtgctctgatatccagcccagggcgccgtcttccgtgtgaagggaatggggtgtggaaggggtggaacacagaggagcgtgcagcacggatgcctagccagcaccactccagcccagcggccgtgggcagcatcagcacccacacatcaagactgcttctgtccttggcagtgtgggatgaaagtggcacttttcccaaaaaccccgtaacatgagaaaaacagacaaattccaagtgagggatagcctgcgaaatttctgaccagccatggccaggccacgcagagggcagaggcgtgccacgctggccgggaaggaaagctgcactaagatggctggacccttggggttcctgtgtatgttgggggggtggggattgtttttggcctttgtgtgtctgttgtcttttaatgagtgtaggactagaagaagggagagtcctactcaaggaggaattcctgtcccagaaactggaatccttggatccctgtgaccaggatggcttttttggagtgtggagtagagcacatgggctttggatgtattgcaggccagtggtgtcagcagtgacggccctgtccgggccaggaagcccagggccccacctgtggtgcttgcggtggctcctctcccaggtccctccaggggctggtgagccccgagaccctcagtcctccctctctgtcctgaagggagcctgtcgcttggctgcttgggttctttttcatttttaaatttcttttactttcactttaggttcggaggtgcatgtgcagggtttgttatacaggtaaactcaggtcacaggggattgttgtacagattatttcatcaccctggtactaagctaagtagccaataatttttcctgctcctctccctcctccctcaaggaggccccagtgtgtgtgatttgctcctctctacgggtccatgtgttctcaccatttagctcccacttatcagtgagaacatgtggtatttggttttctgtttcaagatggattgaagactgaaatgtaaaacccacaactctaaaaaccctggaagacaacctagacaataccattctggacagaggaacagcaaagatgtcatgacgaagacgccaaaagcaattgcaacacaagccaaagttgataaatgggatccagttaaacttaagagcttctgcacagcaaaataaactatcagcaggattctttcttttgaaaccttctgatgaatctccctgccccagggctgcattagcgtcctctggtgcagtgagctgacggccatgttggggggctctgctgagtccccaccaacttcagggcacaacaccgccccttcttagaaattcacacctcacttgtcgcttgtagcagagccaggccgacaggtgtgttgcagtaagaacggtattaactacagctgatcgcaaacttatttgatgatgaaattctttcttgaggaacatttgccattgtctcagagagcactttctagggagaactaggtttacgtaacctctgccacagggtaagcctaactgcacccttcgaggagtgcagctcgtcggtatttcttttaaagtcatcagcatagagtggcagctgcgtgcactgttcccaccgcaggagatttctctggaggtcagagaaacagaagccaaggttataaaagctttcctttcagcccactggacagtctgttcccccgtggactctctgtcctcctttcagcttagcaaacagtgagtgcctgctgtatgcacagaaggtggtcccagaaacaggcggctccatcctcaggaagcttagcactcagtgtgaccgcagttacatccaacacagaccgggtgggaaccccagacggagtgggggaggaatgcactctagctgttgatggtgattggtgtcatcaggagtggtggtgtcactggtcaggcctcacctgcagtcctggctctgcctggtctgcagtgctgggaaggctcccccactcacctcccgagtttgtttttcccaccctgctgctttcattacacccacctcccagactgtgctgggccttgagcagtgcgacatacgcagctggaacacaggcggtcacatggaacacacacaggaaacgtgtacttttccctgactcctgccttacagggtagaggttagctctaaagactgagattctattaggataattattatgcttctgcaattttggaaaataaccacattgcacatcctcaggtgcctgcaagggcagcagctatcagatctttgagaaatttgcagtcacgtgaatgcagtatctctggcaagttgccaatcacaacaggagaagggaacagtttcctcttggctttaaaagcctctgtcgtatcaccgggagaacgcacttcagaatcatgggcattccgtgaggacttgtgggtgagagtcactgaacgggtcccagctgggtgccgcagggcctcaggccacaacctatgggtggcctcaggccacgacatatgggtggactcgtgtgtgaaacggggacaggatcccccacagccaacggagagagctcacctggactcctgcactaggctcatggcatgacgcccttggtctcggttaaagctgatgaaggagatatttctacccctatttgggacacagatgtggccaagccatatagctagcaggcagtaaagctcagatggggaccggagtctccccgagaagccccagtgttgtcactctgttgtcactaccgatgcattgaagtccttaagaacacaaatcacagattagcctttgattttgtccttgccactgacttgaactttgcagtgatttgcttcctcttgtttctagtctcgaaagctgttttgatcttgtttcttggtttctgtgtgttgtctcccaggagcacatgcagacacaccaggccggcccctctttgagctcccagaagccaagagtgtttaaatgtgacacttgtgagaaggcatttgccaaaccaagccagctggagcgccacagccgcatacatacaggtaacggggaaggacgtgcttttgtttccttactctttgaagtagacatcatgggtgagaaaacataattccacctgtgcaatattcacgagcgatggaatgctttatttataaagcaaggtccacatgttccatttctcctgagttttgacctatttatcgtcataactaacttttcacatggaagattttgctgcttacattatgaccatatgaaacagaagcatcaggcaagcctcccgtgccgtgtctgggatgttgaccatgtcacgtccctccttcccttctgctggagcaaacaggcggcccccagtgcctgggtcccatgtcctcaatgtcaccggggaacttaatttttaatcttcctcttctgtcttaaaactttttttctctgctggcttttcctacaccacctaaatctgctcaaaccttttgtcttagagaaaaaaaacacacggaacaaagaaacaagctcttccatcttctgcctcttgactgtacacgatagctcgtgtcagcccttccgtctccgccctgccctaacaggacatcatcccgggctcatttctgttgtgatcatctgacgactcactgtgggcctggggttccgcaggctgcatccaccgtggcccttccatggctctctgatccctccgccccatctgctgggggtcgttaggacctggccaggctccctctggtctccctatggctcctccagccctttgttcagatgacagccaggctgaaagcctaaaagaaaagaggaacattcagtccctcttgttcatacctcagggtagagcccaggcatccactatacttttcttagagacattgacatatgccattttctgtacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggtgagaatgctgcacccgggagtgcgtgctgttcggtggcctgcgaggcaccctgtgtttcgcatacattgtttcctttagttcacacagtgattttgcattgcacgtggtacagcctcagttgtgtggactggaagcttgtgctttattttattttttgatttccataggttattggggaacagatagtgtttggttacatgagtaagttctgtagtggtgatttgtgagattttcgtgcacccatcacctgagcagtgtacactgcaccctatttatagtcttttatccctcacccccttcccattctttccccccgagtccccaaagtccattgtgtcattcttatgcctttgtatcctcatagcttagctcccacttatgagtgagaacatgcgatgtttggttttccattcctgtgttacttcacttagaataatggccttcaatttcatccaggtggttgcagatgctattaattcattcctttttatggctgagtagtattccattgtgtgtgtgtgtgtgtgtgtgtgtgtgtgtgtgtatttatgtatataaataccacagtttctttatccactcgtcgatttatggacatttggtttggttccctgtttttgcagttgcgaattgtgctgccataaacatgcgtgtgcaagtgtctttttcatacaatgaaaaagattctacttattttcctctgggtagagatacccagtagtgggactgctggatcaaatggtagttctatttttagttctttaaggaatctctacactgttttccatagtggctgtactagtttacattcccactagcagtgtggaagtattccctgttcaccacatccatgctagcatgtactattttttttttattttttgattatggccattcttgcgtgagtaaaatggtatcacattgtggttttgatttgcattttcctgatcattagtgatgttgagcattttttcatacgtttgctggccatttatatatcttcttttgagaattgtctgttcatgtccttagctcactttttgatgggattgtttgttttttttcttactgattagtttgaattcgttgtagattctggatattagtccttttcagatgtatagatagtgaagattttctcccactctgtgggttgtctgtttagtctgctgactgttccttttgccattaaaaagctctttagtgtaatgaagtcccagctatttatctttgtttttattgcattcacttttgtgctcttggtcctcgccgaagccaatgtctagaagggtttttccaattttatcttctagaatttttatagtttcaggtcttagtttttttaatccatcttgagttgatttttgtatgagatgagatatgaagatccagtttcattctcctaacgtgtggctagccaattatcccagcactgtttgttgaaaagggtgtcctttccccattttatgtttttgttttccttattgaggatcagttggctataagtatttgggtttatttctgggttctctattcagttccattggtctgtatgcctatttttataccagtaccatgctgttttggtgactatgaccttatagtatagtttgaaatcaggtaatgtgatgcctccagatttgttctttttgcttagtcttactttggctatgtgagctcttttttgattccatatcaattttagaattgttttttctaattctgtgaagaatgatgttggtattttgatgggaattgcgatgaatttgtagattgcttttggcagtatggccattttcacaatattgattctacccaaccatgagcatgggatgtgtttccatttgtttgggtcatctgtgatttctttcagcagtgttttgtagttttccttgtggaggtcttttacctccttggttaggtgtattcctaagtttttttttgtttgtttgtttttgttttgttttttccagctattgtaaaaggggttgactccttgatttgattctcagcttggttgctgttggtgtatagaagagctactgatttctttacatcaattttttatctggaaactgctgaattctttcatcagttctaggagctttctggaagagtcttttgggttttctaggtaaacaatcatatcatcagcaaacagtgatagtttgacttcctctttactgatttggatgctcttgattttcttctcttttctgattgctctggctaggactgccactgctatgttgaagaggagtagtgagagtgggcatctttgtcttgtttcagttctcagagggaaagcttttaacttttcatcattcgatattatgttggctgtgggtttgtcatagatggcttttattattgaggtatgtcccttgtatgccgattttcctgggagttttaatcataaagtgatgctggattttgtctgatgttttttctgcatctgtagaaatgatcatgtggtttttgtttttaattctgtttatgtggtgtatcacatttatcgacttgcatatgttaaaccattcctgcatccctggtatgaaacccacttgatcatatggtggagtatctttttgatatgtgctggattcggttagctagtattttgttaaggattttagcatctatgttcatcagggataatggtctgtagttttgtttttggttatgtcctgtcttggttttggttttgggtgatactggctccatagaatgatttagggagggttctctttttctctgtcttgtggaatagtgtcaaaaggattggtaccaattctcctttgaatgcctggtagaattctgctgtgaatccatctggttgtggactttgttttgttggtaatttttaaattactatttcaatcttgctgcttgttattggtctgatcagggtatctaattcttcctgatttaagctaggagggttgtatctttccaggaatttatccatctttctaggttttctagtttatatgtgtaaaggtgttcatagtagccttgaatgatcttttatatttctgtggtgtcagttgtgatagctcccatttcgcttcttattgagcttatttggatttcctctcttcttggttaatcttgctagtagtctatcaattttatttatgttttcagagaaccagctttttgtttcagttatcttttgtttgtttgtttcaatttcatttagttctgctctaatcttggttatttcctttcttctgctgagtttggttttggtttgttcttgtttctctagttccttgaggtgtgaccttagattgtctgtgtgtgctctttcaggcttgatgtagacatttagggctacgaactttcctcctagcactgcctttgctgtatcccagaggttatgataggttatgtcactattgttgttcagttcgaataattttttaatttctatcttgatttcatttttcacccaatgatcattcaggagcaggttattgaattttcatgtatttgcatggttttgaaggttccttttggaatttatttgcagttttattccactgtggtctgagagagagcttgatataatttcaattttcttaaatttattgaggctcattttgtgacctatcatatggtctgtcttggagaaagttccatctgctgttaaatataatgtatattctgcagttgttggatggaatgttaggtatatatctattaagtccttttgttccaaggtatagtttaaatccattttttcttttttgactttctgtcttgatgacctgtctagtgctgtcagtggagtattgaagtctcccactattattatgttgctgtctatctcattttttagatctattagtaattgttttataaatttgggagctccagtgttaggtgcatgtatgtttaggattgtggtattttcctgttggacaacgccttttatcattatataatgcccctctgtcttttttagctgctgttgctgatgacaatgcgactaagcaatgatatttttgcagtgaatttcccaggtgttctttgtgcttcttgtatttggatgtctaggtctctagcaaggccagggaagttttcctcgattattcccccagatatgttttccaaacttttagatttctcttcttcctcaggaatgccgattattcttaggtttggtcgtttaacataatccccagacttcttggaggctttgttcatattttcttattcttttttctttgcctttgttagattgggttaattcgaagaccttgtcttcgagctctgaatttctttcttgtacttgttctattctattgctgagacttttcagagcattttgcatttctataagtatgtctattgtttcctgaagttttccttgttttttatttatgctatcaatttcattgaatatttctcccttcacttcttatatcatttttttgatttccttacctttggctacacctttctctggtaccttcctgattagcttaataactaacttcctgaattctttttcaggtaaatcagggacttcttctgggtttggatccattgctggtgagcttgtgtgatttttgggagctgttaaagagccttgttttgtcatattaccagagttggtttttctggttccttttcatttgagtaggctctgtcagagggaaggtctagggccgaaggctgttgttcagattctttggtcctacggggttctcttgatatagtactccccgccttttcctatggctgtggctccctgagaacagagctatagtgattgttacctttattcttggtctagccgcccagcaagtccacctggctccgggctggtactaggggttgtctgcacagagtcctgtgatgtgaaccattcatggtctctcagccatgggtaccggtgcctgttccggtggagatggcaggggggtgaaatggactctgtgaaggttcttagctttggtggtttaatgctctatttttgtgctggttggcctcctgccgggaggtggtgctttccagagagcatcagctgtggtagtatagggaggaacaggtggtgggcggggccctagacctcccaagagtatatgccctttgtcttccgcttccagggtgggtagagaaggagcattgggtgggggctgggctaggcgtgtctgagctcagactctccttgggcgggtcttgctgtggctgagtatttggggtgtctcctgggtcctgcaggagcaatccacttccttcagagagtctgtgggtcctctcaggtttcctgatttattcccctagttgtttgggagcaaaaattcacaatgtgagcctcctcatgctgctctgtccctttgagtcggaggtgcagtctagtcctgcctcccatccgccatgatctctggaagcctgtgcttttgttactttaatagttagtgtttgcagttgttgaagttggctatggactgccccccttcacacacacacacacacacacacagagacacacacacagaatttgattagattaaatttatattttggcaagggcacagaaatttattggagtaaaatggcagcccagaacctgagcaagcgcagcatttctgagcagctcgtttctcactggacagagctttctgtaggggccttcagcacctggccagtcagaggcccagaatagcatctctgtctgtcttcacatcatgtctggaagccccttttcctgcagcatgcagttcaggtgctgtctcggtgctcaggggcacagagcaaacagaatctgcaccaactgctcctgtctgcatcctgttgacctggcacagacaacacgtgggccttggtttctctcttgattcgctaacgttcatgcccttcagagtatggatattggggtgtgatcctactgcttgtctgtcccttgttcacctttgtttcctacacagaatctagcagtggcatccatctctgaggaaggaatgataatagatggcctagactaggtttcagagggtggcagtagctatgcaaggaactagaaatgttaaagtctgagtagaccccttggtgtgctccatgcattttgcgggtgtgatttgattgttcgaggtggtatgctctgtgagatctgtggtttgtttggttgttggaggtgatgtgattcgtgaaatgtgttatttggttgttggaggtgatgtgattcgtgagatgtgttatttggttgttggaggtgatgtgattcgtgagatgtgttatttggttgttggaggtgatgtgattcgtgggatgtgttatttggttgttggaggtggtgtgatctgtgacatttgtgatttgttgttggaggtggtgtgatctgtgagactttgtgactttggttgttggaggtggtgtgatctgtgacatttgtgatttgttgttggaggtggtgtgatctgtgagatttctgatttggttgttggaggtggtgtgatctgtaagatttctgatttggttgttggaggtggtgtgctctgagttatgtgacttggttgttgaaagtggtgtgatctgtgacatttgtgatttggttgttggaggtggtgtgatctgtgagatttgtgatttagttgttggaggtgatgtgatctgtgaggtttgtgatttgttgttggaggtggtgtgctctgagttatgtgattttgtggttggaggtggtgtgctctgtgagatttgtgatttggtgttggaggtggtggtgtgatctgtgagatttgtgatctggtgttacggttggtgatgtgatctgtgagatttgtgatttgttgttggaggtggtgtgattcatgacatttgtgatttgttgttggaggtggtgtgatctgtgagatttgtgatttggttgttggaggtggtgtgatctgtgaggtttgtgatttgttgttggaggtggtgtgctctgtgagatttgtgatttggtgttaggggtggtgatgtgatctgtgagatttgtgatttggtgttggaggtggtggtgtgatctgtgagatttgtgatttggtgttcgaggtcggtgtgatctgtgagatttgtgactttggttgtcggaggtggtgtgatctgtgaggttcgtgactttgttgttggaggtggtgtgactctctgagatttgtgactttggtgttggaggtggtgtgatctgtgagatttgtgatttggtgttggaggtggtggtgtgctctgtgaggcttgcaggtgttctttggttgtttgaggtgcggtactttgtgaggggagctcgacggctttcagtgtagggaacccgagggcagaacactatattgtggggagtttttgaggaaggaaaaaggggtaattttttctctttaacgtctacactgtagtgcttcctgctttcctttttattatggaaatcatgtgtgttggttattgctcattcctgatgctgtgttaatgtagctgtcataggagtgcactcatatcaccagtgctgtgtgtgcgttcatactcctaacagtaactactgtcctgccggcagaggtgtttcacctgcagctcaaattactcttttttcactggaatgaaaagcaaattactttagaaattccttgtctctttctaccagaaagtctttatttaaataggaatcattttgtgctctggaaggtctgaggctgcttgtgttttctttgtctgcataacaggagctctgcaggagtctgcaggtcacccggagcaggacggggaggagctgagccggaccctccacctggaggaggtggtgcaggaggctgccggcgagtggcaggccctcacccacgtcttctgatgcgagttggaagtacacctttaagaatgtttctgaagttacgttttgtgaagagcaaagcacttggaatctctgttttaaagcttcaagtgttaaaaatgctacaatagttttttatctataaaattatctaaagaatcattgtctttcagagactcataggaaaaaaaaactgggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacatggaaaaagtatgtcagattttccttcatgtttctggttataagaagcatagcttacaaagcaagcgtaagattgaggcatgaagttcagaaaaaaaagtgttataacacacagggaagttttttccactcttttctctgtgcattttgaaaattagtcaaaatggactcttttcagtctaccataagttaatataactgataccttgagagatggctggaccaattctctccatgacaaatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggacatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttaggaaatgtgattaatttttttcgtttgaaaatatttaagataaaacagtttggcatgtaaattaatttcaagttcagatatttttaagagaaaactttagtggtattttcctttacctctgtgaagttcagaggcgtttacccctgcagtgtccactggaaaggcttcagactttcaaaatcagggcatggctccgcgacagcgagccgtgggcgtcagcacagtgccctgtgcatgtgtcagaactgttcctgttccctttcatttgctgctttattcaacggcacccagtcattgaggaaccttttgaaagttcctaagtgttttgatcctgcttgtgtgctcaagtaaccatgaagcactgaagctgaaagaatgaattgcctttgcaaagataccaaacgtgaaggtggggtgcaggtactgaggaagcaggaggcatgtagcatgtgtggagtcccacctgctagataatgcccaagcggctgcgtttccatagaatggcaatagatgaaaatgaagacatgttttcaaacatgcagattgaaatgctaccccacccccatcaagctctactttttcccctttgaaaaacttgaggcacttagaaagtatctaaatagaggaaatgctatgacatggcatctgacagcttgcagccaggtcagtgggaggctcatcaaatgccactctcctcttcctgacagtgttctgctggtgggacatgaacatcagtgcttgtctggcacttaactaggggatgtttccttcgtgcatattttctactcccctgttgtaatattttaaggaaacttgatctttgaaattatagctagtgttctgtgtcttcctttgaactcatatcacatttattacaagagacgcatgtgttagcacagctacacaatttttagaagtagaagtggatttcttgtcttgctgtgggttttcctcattttagaagaatatttgtaactcattaagatacacattttaacatgaaatgaccatcacacagatttatgtttggaaatattcaagataaaatagtttggcatgtaaatcaatttcaagatttatgtacataagatttttaaaggaaataggtaagatatatagaactgctttctagtgtatattaaggctatctcatgcctgcttcttacatttttttctgaagcttatttcagaattaataccgtgcccttccctgactaaaaaaagttaatccaaggattgatcgttgcgaatgtatcccttttccaagacctactgcataggaagtaagtgaggcagagatgagattatgcggcggatacttctgaaggaagcgttctttttgtgtcacttaatctgtgttcacgtaacttaggcactttggattttttagaatgaaatttcaaaagcgcctacacgcaccacccaatttaatgtcgtatctgtacttggggcctctacacctttcccatattctaatgaaaagatcgtacgccaaaggccactgagctggcatcttcttcattgtggagaaagtgggaaccacagagcttttcgtgggccagatgcccacatattcctagcagagacatgttctttgtcatggtgtggcttgccacaacatgtcctgtttggtggctggccctctccgaacggattcccctcctcagacccccatgcacggatgagcacatagctcaccctcaccctcacacactcacccacacactcaccctcacactcacccacacaccctcacactcaccctccctacacaggcatcggggcagttctttatatggatgactaacaactaagaaaaaatgaagattagtatgaatggcaggagcaacaggcagtcagaagagatttttctatttaatcttttatgtgtaacactttacagcatgaagacgtattctatcaatatttgtatcataattgacaaattctcaagtgacatagggatttgttcttgattcaccactaaagaaaatttttaaag

SEQ ID NO: 12675 - DNA, 197131 bp, Human
  misc_feature (1)...(197131): n = A,T,C or G
ctcaaaaaaaaaaaaaaaaaaaaaaagagggagagagagagagaaattgagattcattcaaggaaataccatgggtagatccttaatatccaataagaaaaatgatttggagaacattaaagtttacatacattaaaaaaacccaaatgacactaaatgcatgtgtctataaacatgtttaagcaccgtaaaactaaaaataaaagtggactagaattacacttttatttttataaaataaaattttatacccataaaattcatggtagaagtggcctacgccaagggaggaaaatgaagcagggaggaaagaggaattcaattctgtagtatttaatttcttatgaaaaatctgggacaaaaatgaaaaatgttaaatttttaaattcttggtgataggtcacaaatgtttgtttcataattacttgcactttttgaataaaaataaaatcttttggaaattaaaaaaattggcgatttgtcatggtgattttcttaaaagactaaggtgtctagtgggatacagaagactcgatgattttattttattttaggttttttttttttttttttttttgagacgcagtctcgcaatgtcgaccaggctggtgtgcagtggtgcgatctccgctcgctgcaacctctgcctcccgcgttcatgcgattctcctgcctcagcctcccgagtagctgggattacagctacttgcccgccaccacgcctggctaactttttgtatttttagtggagacagggtttcactatgttggccaggctggtctcgaactcctgacctcgtgatccgcccgcctcggcctcccaaagtgctgggattacaggcgtgagccaccgcgcccggccttattttagttttttatgtcaatttttgaatttgtaattgggtgagaattaaagtgttataaatttcaccttaagtgaaaatttattagttttctaatgacaaaagtagttacatctgacgtaaggggatttaattatctttttctgggcttgcgtcccggaacgctgctgcattatgtaatctgtagtaatatacccacgagcagtttggagggttctgggaagcacatttgttttgcttacctaccatgggaaagattccacgtggtcctagaagcatacgtattcgtcggttacagtattttaaatattcactggccgctgaaatttaaaatggatgaaaaagaaattctcttaagtagcgttcttgaaactgctttatcaaactcagttcatattttcagttggagttcgtgatgtatgtgaatttcctttaaataaaacccgaatctttagtaatacaaatattgggaacttcgattactgtaggtcttagggtagactcgcttggactttgactaaatactatgctttagaaatttatctttaggagataaatttggggggtttatctttttatatttgctttgtttcaatttatttaaataaaagtagtctttctagaagtatgttttatagtaccacttacctcggttactgtcccagttaagcagttttcacgaatgtggaaaaatagtagtgtttttctttcatacacgcgtatatgaaaaatttttacattgatagagaattattcgtaaaaattaaagtaaatttactgttagtctctaattttgttctgagatagccacgctgtggcattaagaaggataatcaaggaataagccataatgttcagaaaggggctttactttttatttttaatattattgataaactttgtttagtcgaattgatgtctgcgtgtcttcccccgccttccccataaaacagcgggacagaaagtcctgaaaactccaaaagggaaatatttactcagaggtctattcaaatttgcttagtctctgacgttttcctgtgtcgtacaaatccctcgtgcggcaaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattggggtgagtgggatctgagaatgtaccagggtggctcgggttcgcgtctaaaggtttcttcctccctacttccgcccactcgtggtgacaggtgtggaccaaccctgcctggggagtgaggcccctcgtcactcctgttcgtgcccctggaagagtctgggagtatcgttcggcttctgtcctggccacagggagagtagaatattgtctaactggagttaactgtcgtttttcactattcccactggggaagtaccgggtgatctttttgtgtggctaacactggacgtctttaggaggtttagagcaaaatggctgggaccgccaaaaaggctacaagctatttcctgagtgtgaaatgtgggcggtgagcacaatggagtgggtttttgtgtgtttggtgtatatgagagaatgtggttatatacaagaaattctaatcttacagcttttactattggtttaagcctgatgtccgtcttggcagaaaagcaaaacacccaagcacctgacctcgggtccctgcttagctacacctaatacttatggtgtaatcctgactgctctccagatacagctcttaattttcttgttaatggatattttgtttggttttggtggtcaggaagggtggaatgggatgaagtggaaatgagaatgaagaaactttgttatctaagtatttagaggagacttttattctcctcttgattgcaagatataatagtaatattgttcttaggttccaatatgaatttgggattgtgtaggttcccaaatgggcccgctagtgagcctacaccactcatcagccttggaactggggggaacccagtttatctttctcccttggatcagcattctcaatagcaggagtggaaggaatctcaactttttattgaacaaagtcatttaattgtttcaaggacagatgttctctaaaactatattctattggagatttattttaatccttgggtagattttttaagagttgctggaaaacttaagattttttattcccattttcccaagccaaatgcattagtgacagtaaccatttatttagctctttgtgtcagggaccctgttaaactcttgacatgaagtattttgtttaatcctaccaacagtccaatgaggtactgtttattttagagatgaggaaactgaggctaacagaatttgtgctcagattcttagagctagttagtggcagaagaaggatcagaccaggtttttctacctccaaagtctgtacccctagcatctattctataatgctttcctaactcatgtctacagattttattcttcctaagatccctggttattaataagactacttgaatatattgggtagttatgatttattttgtcagctagtcagctattatattttcatgacatttcttttctttacctctttttttgagatggagtttcgcttttgttgcccaggctagagtgtaatggcgcaatcttggctcaccgcaacctccgccactcgggtttgagcgattctcctgcctcagcctcccgagtagctgggattacaggcatgcaccaccacgcccggctaattttgtatttttagtagagacgaggtttctccatgttggttaggctggtctggagctctggacctcaggtgatccgcccacctcggcctcccaaagtgctgggattacgggtgtgagccactgtgcccggccagtgacatttcttaaagtataactgtgggacacttcctggtagcataattttatgtcgtcttctgatacccaggctgcattttccagacttatctgatcacttgacttaatgttctctaacagagcattcagttctttgtagtcagttcaccgactcacttctatcgggtatcctgccctgtccctccctgaatgtgcccatttccattgttttccaggtttcccttttcaaactgttaacagtcttctcttctttgaagactttaatttaattccttaggtgttcagtaagtaggatagattttgttggcaatagagtgaaacactactgtctgatagtgtttcgttctgtgacagttgctgttttggatgttcaagtacttcactgatttacttgattttgttgttgttgttgttgtttcttttagagacagggtcttgctctgtcgcccaggctggagtgcggtgatgcaatcatagttcactgtgacctggaactcctgggctcaagtgatccttccatctgagcctcctgagtcgctaggactacaggtgcacaccgctaccatgcctggttaatttttaatttttgaattttttgtagagacaggggtcttgctgtgttgcccagactggtctccaactggcctcagtcatcctgcctcaacctcccaggtgatgggattacaggctcaagccactgtgtctagccttgatttttttttaatattagacactatctagttaaaatttaaaaatcagattatgtaattagtatgtcctgtgattttaacaactctaaataatttaaataaagtgattaactcagaacagcctgtgagggatgtgctttcctttttctttttaacttaggtaatgaaatttagagcaagagtcttcaaacattttctgtaaaggttcagatagtaaatattttaggctttgtgattacatggtcactgttgcaactactcaagtctgctgtgatagtgcaggagcagccagagacagcataaacaagtgagcatggctgtgtttctataaagctttatagacactgaaatttgaatttcacataattattttaaataataagcctacttttttagtataattatagatttacacaataattgagcagatagtacaaagagtccacatacttccccttcatccccagcttctcctattggtaacatcttgcattagtgtggtacattggttacaattgatgagccagtattgatacattattattaactaagcccatcatttaaagttcactctgttgtacattctatggcagggatccccagccttttggcaccagggactggtttcatgaaagacaatttttccacaggaggtggggacagggaggcacaggaaatgttttcaggatgattcaagtgcattacatttattgtgcactttatttgtattgttattacactgtaatatataatgaaataattatataactcaacataatacagaattagtgggagccctgagcttgttttcctgcaactagatggtctcatctgggggtgatgggagacagtgattagatcatcaggcgttagattctcataaggagcgtgcactctagatccctcacatgtgcagttcacagtagggttcacactcctatgagaatctaatgctgctgctgatctgacaggtcgtggagctcaggcggtaatgcaagtgatggggagtggctgtaaatacagatgaagcttcgctcactcacccacctgctgctcacctcctgctgtgtggcctggttcccaacagggttgggaaccactgttctatgggttttgacaaaggtataatgacatgtatccataattacagtattatatagaatagtttcactgccctaaaaaagccctatgctctacctattttttcctccttcctcttccctacctctggtcaggtaaccactgatcttttcactgtctccatggttttgccttttgcagaatgtcatatagttggaatcatacagtatgtagcatttttgaattggcttctttcacttagcaatatgcacttaaggtccctccatgtcttttcatggcttgatagctcatttcttcttagcactaaatagtattacaaaaatactatttacagtgttacaaaaaatagtatgtatgttctatagcctattagtctgcctaggctgccataagacaacaccacagactgcgtggtttaaacaatggaaatttattttctcccagttctggaggttagagttcaagatcaagatggccgcaccttcaggttctggttagggctctcttcctggcttgcatgcacatggctgccttcttcttgtgtcctcacatggcactgagagagagaatcttcttcttcttataaggccacagtcctatcagattagtgccccactttaatgacctcatttaactttaattacctcctaaagactgtatctctcgatatagtaatatttggggttagggcttcaacatacgaattttggaggacacagtttaggccataaattcacagtttgcttatccacttacctattgaagcacatcttggttgcttccaacttttggcaattatatataaaactgctgaaaacatttgtgtgcaggtttttgtgtggacatgcattttccaattgtttgggtaaatatcaaggagcacaattgctggattgtgtggtaagaacatgttttttgtttgttttgtaagaaattgccaaactgtcttccaaagtggctataccattttgcattcccgctagcaatgaatgagcatttttgatgctccacatccttgctaacatttggtgttgccagtactttggattttagtcattctaataggtgtgtagtggtatgttttaatttgcagtttcctgatgacatatgatgttgagcatcttttcatatgcttatttgccgtctgtatgttttaccctcctctctccttctctcttctcttttactcttgcttgaatttgtgcaaaagctgctttattctgctttcttctttcttccctcctcctcctcctttctcctttctcctttttccttctctttattcttctgtcagctgtacttaagatatgtgtatcaagatcagaagctttcgtctgccactgtggtttcgtttatgtcttcagtctcttctgtgaaggttctcttggctttctagcactaaatcaaaatctggtgctcctggatgacacaacttcccgtaatgccccggtgaacggttgctaattttattctcaaaaccttttcaccatagggcctctgttggtgggataggtgtctccattgtccttcactgctattctcctttcctcctccctaaaaatatctaagttgaaatctcattttgtcacaatatcccatcctctacctctcctgattcctggatcactctctttcacttttctttttttcttttagagatggggtcttgttctcttgcccaggttggagctggagtatgcggtggagcaatcacagctcactgcatcttcagacccctggggtcaaaggatcctcctgcctcagcctcccgagtagctgggactacagacacatgccaccatgcctggcttctttttggctttttgaaaacattttgccactagcttactgttactttcttcaccattacttccatcatgattcttggatgatttcagtatccttagagaagatccttcagatacactgacctgtcattttctggacctcctctttatcactgatcttaccttttacccagtctcagccatttgctttcctgatcataagcctaagtcttgtcactaccaataacatctcactttcaaacatcctgctctgactgccttcgcctgttttaccagcttacttcctttagtattccagtttcaatagttgttcagtccttctgagattttgccatgtttccagtgtctctcattctcttcagttcatcacgtccctcttacccagtttaaataccatggacagtcattgtcactatttccttcctttcacctttcatattcatgtctgtctcttttctggtaggtttctcttggataaacctattagttaaattcagttttgcccacttcatgcctgtcctagtatagctgaatcagctgaagaaaacacttcaactgtcctgactggtctcaatttaagtgttgccagaccaatcatatttccctggtcctctcactgtcccattctgatgattgctttataaagtttcttctatcttcaaacctccaacatctctcccatcctttgaatcagaagagaacttctacagtctcccactacctcatttacccacctatcaacatgtttgctttctcttttgttggtgagaatgagtggcttcttgctcctagctagagccagtccttccatatgtgctttagattcttcctgttttgttcaagaatattgctcaagctattcttcctcctgtttcctgcatcagcatttcccctctctactagatcatctctgtcagtaaatgaacatgttgttgtttctcctagaagtactgtttctatatctagatagtactctagctagagttaaaaaaaaaaaaaacaaaaccaacaaactcaaaactctcttcagatgttacttcacctcttgctgttactgcatttctctactgtatgttacagcagaattccttttaaaaaatgtccacgttcactgactctagttttttatttctccttgtctcttgaacccagtccagtcaggtgccaccactccactgaaactcctgtttttttttttttttttttttgagacagagtcttgctctgttgcccaggctagagtgcaatggcacgatcttggctcactgtaacctccacctcctggattcaagcgattcccgcctcagcttcctgagtagctgagattacaggcgcctgccaccatgcccggctactttttgtatttttttttttttgagacggagtctctctctgttacccaggctggagtgcagtggctcactcggctcactgcaagctccacctcccaggttcacgccattcttctgcctcagccttccgagtagctgggactacaggcacctgctaccacacctggctaaatttttttttgtatttttagtagagacggggtttcaccgtgttagccgggatggtcttgatctcctgacctcatgatccgcctgcccaccttggcctcccaaagtgctgagattacaggcgtcagccactaatttttgtatttttagtagagatggggtttcaccatgctggccaggctggtctcaaactcccgacctcatgtgatccacccgcctcggccttccaaagtgctgggattacaggcgtgagccatcatgcctggcctgaaactgctgtttttaagggcactactgatttccacattgctaaacccagtgactgtgtctgatcttattaaacttataaggagtaaatgaataaataaatgggcaaggtggaggtgaggtgggaaagtttgttgagtacactaaaaatagtaactaccattatttactactgttgagggaaatctaatagtgtgggactggtgcaaaggatatagaaataggcaataggttttaggatactttggggtaactgatgctaacagtttcttatggattcttttggaatgttctataaatatacgagtatatttatcaacccaccttcagttatttttttaaccacagaaaagtcaaaagatcagtacactgataaacgtgcgttttccttatctagatttaccaactgttaacatcgtgccacattcactttatatcttaatattacccacactttcctcctttttcacatctgaaagtgggctgcagataatatgaaactcctaaacacttcaccatgtatttcctaagaatgaggaaatgtttatttttaaaaagcatcaattcattttaatatgctttatacttcaaagctaacatcacagggttctttttcaccttcttgcaccatatgcttgtatttctcttctgccgctatgagaatcctgattcccaataacatcctttgtttttataggctcacttcagcagctctgttggaaataaactgaaagaggggcaagggcagaagcagggagacgttttggaggctgttatagcaatccccatgagttacaatagtagcagtggagtaatgagaagtagttggattatggatatgtacacacacacacacacacacacacacacacatacacacatatatatacatacattttaaaattttgaaatagtttgaaatctatagaaaagttttaagaacagtgcaaagaactcttgcatgccttttacacagactcctcagttgttaaattttactgcatttactcaatttctctctttctccctttcaagagagagagatgtgttgacccatcacctttaaatactgtagtgtatactctctatcctcctgcctcccaaaagaaggccactttcctctattactaccctatatttcttccagtcaggagataaacattgatacaacagtgtcatccaattcaaagacaccattcaaagtttgccatctgtttcaataatgatttgcttttctagtctaggattttacttgcaaacactcattgcttttacttatcatgtctcatcagtgtcctttaatctggaacagttctttagtcttttcctgtctctaatgtccttgacagtcttaaagagtagaagtcttttattcgacaagatgatcctaaaccactaaggggttccttggaaaaatgaccaattccagggctgggaaagtgcagggaaagtgcaaaataagcctggaaaatcttgggccagaaattctcagcaaatgaacatgttaaaaagaacaaaggccccaatatgaatgaactccccgtggtcaaatctgggaaaatttggcatcagaataaaatgagggtatacattatagtgtaaatactatgcgatgttcctatgccatcatatcatcctgtgatatagtcacatgatcacttggtcaagttggtatcttctaggtttcaccactgtaaagccactgcttcccattttgtattttattgctattttgggggagataatctgacataacaccaatatccttttcttattaaacctctaaccacgagccctagcctcattaataaccccaatctatatcagttaccactctaatggttgccaaatggtaactatctaactctatcattctgtctatcattctatcattgttgattgacattgcactataagaaccaacctacctacctaccttccttccttcctttgttccgtgatgaactcattgattccttttttatttggtggttggtaaaccgctactctcattttattctgatgctcagattttcccagatttgaccactgagaattcattcatattggggcctttgttctttttgacatattcctgtcatttgctgagaatttctggcacagcaagatttccaggcttattttgcactttccctgctgcaagccctggaattggttatttctccaaggaaccccttagtggacttctgtttggtggaagatggtatttagtatccaagatctggtcacccagtattttcattgctactgggatgtcattgcttctaggacctcttagcagacagaactaggaaatatatatacatgtgtgtatatatatatatatgtgcatgtgtatatatgtatatatgcataatacaaacatctgcatatgtgtgtacatatatatatacttccacagctatctgtatgtgttatattttaaatgagtttatttactaatacttctagttctaatccaacatcttaggattcttttagtctcccgactctttccatgctcttaaatcctttctcagactgtgagaaatctgactccaattattttagtaaaaggcaaaagattcattcgttctgaagagaaaccagagcattctaattattttagatatattcaaccatttgctcagtcacctaacatatttgttcagtatgaccactctcctaaccactcagcctgcgttttccatctgctactccattccccctcccactgggctggggcatgctggcatctttgctgggcaatagtctctcccacaccatcctatttccttggatatgaggcatattgctggagatgactgtgcacaaaaccccatcacctttgttgccctgcttctttggaagctgacatctctgtgttgggaggggtagggaagaaaaggaaggttgggaagggaaggaagaatgggaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtggggttgatgaggagctcattttggatatgttaggtttgacatgccttttaaacatctaagaggagatgtcatactcactgcacatgcatcttgaagtgtgggttggagatgtatatttggaaatccttggtatatagattttatttaaagccgtgagctcagctgagattaccaaggaagtaagatagatagaaacgtttatgctgagcccagggacaaatttgtgttagggagatgaggaagaaccagcaaggtaggtcaaccactgaggtgggaggaaaactgggtaagtgtgatattctggaagtcaagtgaagaaaatgcttcagttaaaatgaaaggatcaactatgttaatgctgttgataggtcaagtaagatgaggactatgagtttaccattgaatttagcaatatggaagtcactggggacattaataattatgtgtatgtggagcggggagcttgattggagcaggtttagaacgaatgggaggaaagaaatgagagagccagatagagaactctttaaaggagtttcagcctatatataagccgcagtcctctgcttatatgtttcttggctctgcacctgagtagtcttttctgagagtcatgtgagtaaccttttgttattactacgtatacatttttttgctaaatactattttgtcttaggcggtgaaatgttactgtaattggtcaggttaataacagactgacagtgcagttcctacacttgtgcactgaggaaatcatcagagcagtttcagcagcataaaataggtagagagtacaaaggaagacctagttttgaaaaactcttcaaagtgcttaaagttttgaaagtgtcagaggaaataggaacttcatagattctatggtgaggagccttcttgggccttggtcaacaccttaacctttctttacaaaaagttttcagtatagtgtattgaagaatgttttctgtatccacatatttcttgatttgtaatgaaacctcattaggaaattggaatatagttagatttgctgaaatgaatttgatggtttagatgaatgaatcctttattgtctagatagaaaattggttgcacccttaacttaaggcatggataacaaatacgcagtgtgtatatactttccacagccctctcctattgcttatgaaccatgtctactttccacagttgtctcctattacttatgaaccacattaactcttcatgctgaacccagatgtagcatcagaattcttgttagtaatgttccataaagccactaccaattagtcttacatgacatatgacataaaaccttttttgatccctggtgtaagaattcagttcacaagataaaaattatgcagaaaacaacacataaattggaaatgagcattgaattgcttattcacattactggagtttatcaataatagtaatggctaatgagaaaccttaatagaggtgacatagggacacagtgcttgtttctttgtcaaataattgaattgacagttcatttctattcttttcctttgtccaaagattctgctctctttgctgaactcggttatttcacagacactgatgagctgcaattggaagcagcaaatgagacgtatgtaagtatttactaaggttgaataatgtgatatttagtctttaaccctaattattgcaagaaagtttcaggacaacaggttcaggctagtaatttaagttacatacttaatggtaaatagcttctaccattaagtatgaaagttagtagccattttgtaatcagtaaatgtaggacagtagaaattgcattgtattgcaattctaggcccacctttggccctagggatgggtgactttggaaaagtcactaatctgcctacctggtttttacagatactttgctacataagggaattggcaggtgactttggaaaagtcactaacctgcctacttcttggtttttacagattctttgcttttaaaaaggaagttggtaagttctgcttgactaagttagtcctttttaaaagttgtgtattcatgtagaaagctctgaaaagtaggtgtatccttacctttgattggttagaggtctgtgtgaaaactattataacactgagtccccgagaatatcttagattttcttttcttgattagtacatataaaactctttgccctatagaactttgattttgtcttattctttaatggatgaggtgctgtttcacttaagaagtaattcaagtgagcagagtaatttgtcaatcaggttgaatatcacatcattttaggctcttattaacttgagtacaaaatatgtaaagattgcttagtgagtttcagacatttcttaaacaatgatttagcagttgtttttaccattaatcgacagaagagaatgaaggacatgatatattttaaaaaatcagtactagggattttaatggtttcatttactccatgagatactttagaatgtggcccattgattaaactgccttttaatattggctatttgaataagcaactgatactcatatttcataacatctagaatcctaaaagaaaatgtttcttttaaactatgtcaagaaactgtgtgctcaattggaaagattaagggaaatatattcctgattttacaactaacattctattattttatgcaaatcactcaatctttcagttccttagtttttctagtatgacatgaagggattgaatctctgagacccctcatgtcattcttcttccaaacggcaatagaatttcccatgctaaatcactgaagagttagagtatataagtgccagtatgtttcattttgcatgaactgggcctgttaaatttctgatgtgataaaatctttatgctgtagaaggtatttgacttatttggctgaagattgagtcagaagtttcctcaagtagatcatgcccttatttaaaagtgttgctggcactcaggcaagcaacattggtaactttacttagattaagaaagtttaaggattttttggttgctaaaacaaggctgcttaatttttttttttaagacagagtcgcactctgttgcccaggctggagtgcagtggtttgatctcggctcactgcaacctctgcctcccaggttcaagcgattctcatgtctcagcctcctgaatagctgggactacaggtgcatgctatcacgcctggctaatttttgtatttttagtagagacggggtttcactacattggccaggctagtctcaaactcctgagctcaagtggtccacccacctcggcctcccaaagtgctgggattacaggcatgagccaccacacctggctaaggctgcttaattttttgatgtgaagatccaaataagagaaaaaagtgaaggagattgattttttaaaaaatggtttttttatgatttaaatacttttttttcatgtgcactttcacatgttctctttatgtaccttgtactaatatttactcagttatgggcatcataagaaaatagtttcccttctgtgtttctgttacattctcaataaaaatgaaccatatagtagtcattttgaaatgataatattcttctagaaattgttaacaaatggtcgttaccaattactagatacatttttactttttttgcctgaggtgtatttttttatttttatttttattttttttttgagacggagtcttgctctgtcgcccaggctggagtgcagtggcgcaatctcggctcactgtaagctccacctcccgggttcacaccattctcctgcctcagcctcctgagtagctgggactccaggcacccgccaccacgcccggctaattttttgtatttttagtagagatggggtttcaccatgttagccaggatggtctcgatctcctgacctcgtgatccacctgcctcggcttcccaaagtgctgggattacaggcgtgagccactgcacccggccgaggtgtattttattgttgctgtttttgttgttgttgttgttttgttttgtttctttgacagggtctggctctgtctcccaggatggagtgcagtggcatgatcttggctcattgcagcctccatcttttggactcaagcgatcttcccaccccagcctccagaatagctgggaccgtaggtgcacgccactatgcccagctagtgtttgtattttttttcttaggtagagatgggttttgccatgttgcccaggctggtcttgaacccctgggctcaagcaatcctattgttgctgttttatcatttgtgacattaagttaatatttactgccttttgactttattgcattatttatgtattaagtttacttttctttttgtctctgtgactccagacacttaatttaaaatagtactgtttggtactaacttgatctcagacttacatgaggactctgaaattatgtgacacttctttattcatgtatatagtataaggtggttatctggatgacccagaatatgcttatattttggttagaaaaaccacctaaatgaaaagaacttaatgcaggctttaagaagtttgctggaccctgttttagaaaattagttttattttataggattaaaaagtggtgttttttttgattcataaaagttttagaaatttaagaagtatagaactgtagaaaaaaggaaaattactcagtgattcataaaagttttagaaatttaggaagtatagaacagtagaaaaaaaagaaaattactcagtggtaactatcctctttatgattcttgcctgtcttttggatatatctatattctttctattgtatatagagattatattatgaatagcatttactttgtcttgtttttcttaatggcaatgggaaaatgtattttgctggatttcccttaagataaaagacacatttttgactcctgtaatggtcattctcatagaaaataatgaagccaactaaatgttttaaatactgaatcccttacctctttcctagttgttgctgctgtgcttcaagtaactgaattgattttatctctaggctatccaagatgtattctcatacaagactgacttagagtattctttttactaggttggctaatagcagttaaattatttgtgccaaattgtgtctcacagtttgattttaagatgtgtatgttttattcttttaatattcttttgctgatttgaaacctacaggaaaacaattttgataatcttgattttgatttggatttgatgccttgggagtcagacatttgggacatcaacaaccaaatctgtacaggtaattatgtgtttcactggtaaaagttttaaaaagatcaattttattttgtagtttggtcatactcaaaattaggtggggttattgggctattctggtaggttaaaagattcctggtgttatgcattctacttctggtatggcaattatgtaaacaaatttcttgccaaaaatggatatgaggagtttcatagttatgtttcagtagtgtaatgaatgaacagttcatatcagaaatagaaatagtgattttgaattatgaataatgtctctgtataagattaacctgagaaccagacagggcttagggaatcaaagggaagagcctgggttaccagaacctaggaacttggtggaggagtcccatgcatttaatacatgtacttctaagaaggggcagcacctggctgatactaatatctttaagggggcctgatgaggtcggggttgagtatactgaaagaagccagaacctggagcaaattgccagtgctgggatacagctgatggtagaatgaagaaaaatcccttctcctcccttctagctttttctagtatcccctattgacaggacctaaaaggatgccagctgggaataatttatatcaccgattatagaaagtggacttagtgctgagagacagtgaataaataaccagcacattctcctatctaaattcctctctacctctgcactacctattcctcttcattttatgtatttacttatactgtttcatgcctgtttgccttcatagaatgtgggatacacaaagtcagtgttctggttttatcgtttgacaaactaaatcttagttgcttaaagcaacaaccattttattagattgctagaatctatgggtcacgaattttgactgggtgcttacgaattttgaccgggtgctccaaggatggcttgtctctgctccatgatgtccagaccacaactggggagatttgaagattgtagtagcttgacatttgggggctagaatcatcttgaggtttcttcactcatatgtgtggcacctggggtggaatgacttgaagactaggactactaaatggagtgcctgcatagggcctctttgtgtggcgtggtgttctcagtcatggtggtctcagggtagtcagacttcaaaggctccaagtatgagtgttccagcacacaaagcagaggctgcatttccagcttcagaattcacatagcattacttctatcttctcttgattgaaggagtcaagcccacctaaattcttggggaggggaaatcgactctacttcttggtgggaaagtggcaagatcacattgtagaagatcatgagggaagatcatgaaggatggtagatatcgtatggctaattttggaaaacacagtctgccatccccaccctattctatctttgacaccaagggatactgcctgggccatagttgctcagtacatttttataggataaattaatagtttaaaagatatgaacattttttatgagtttgaattgtattgtcaaaaatgctttccaaaatatttcctgtttcttatttttttaaattttttgggaagctataatattttgcatatggtaaaatattcaaaaggtacaaaaatctgtatagtagaaaaatgtctcctgcttttattcctcagccaacaagttctattttccagagacaaccactgttaccagtttcttctgtttacccttccagagaattagtgcagatgcaagtgtacacatatatatacacacacacacagacatacatatataccccctccccacatatatatataatttgtaacacaagtggaaacatactagatatattgttttctgcatctttcattttcactcgttatattttggtgaccttagcttccatatctgattgaattttaaaagtagattttaccttctttcttgttcattttattataagtttttattgtccagtgggtaaaacctttcctccatgttttccagttaaagatattaaggcagaacctcagccactttctccagcctcctcaagttattcagtctcgtctcctcggtcagtggactcttattcttcaactcagcatgttcctgtgagtagccagtcttttacaatgattttggttataatatgctatctggaaaatatgtatatggaggaggcagttaacatttattgaatactactatgagttatattgtctcatttattgagggaactgagactcaagaaagagccttgtgggagctagaaagttgttagtgcctttggttttgctctcttttcccctctgttcatgcctccataatttcattgtttcatttgtttcattgcattttaacagtatccagtatttgtttattggcttactgtcctttctcccaccctttctttctcctccctattaggatatacattctttatatatggacatagaagaatgtaagatggtcagtttttatatctctttagtcacagcatctagaatgattgccttagtttgggaatgcctagtgctaccttttgaaggggctcacgtttttatagaagtctggtagctcttttaagaacacttctgctctgtgtccagacaaaagccctgaggccaggaaaaggaagtacctgatttaggtactttttagaatggggaaagggaaagtataagaataaaaaaatcaaataatattttagtatattatatgtgctataaattgtggtatctttgttcctgcaggctctacatttagttactaaatcctggtggttatatgcacatattaattcaaggatttatcttttctgcccctgccaggccatcactatctcacctggattaagtcaataggattttaactggtcagccttacaactcctcaaacctttcttagcagtggaatcttcaaagagaaatctttcagtgtcacaagctttactgtatcagtcatttgcttaaaactttttagtaacttcccagtccttacaaggatgaaatttaaattcccagagtactaggctttccatgatctggcccccatttacttttccagtctcttttcttgctatcccctcctacttccacattccccttaatttgagccctgtgagagttcctctctgagagctcctatgcactctactcattcaaccgctgtgccaggcactgttccagatgctggcagtgaacaacagcagtgagattgctgctgttacagttctaggtttttgcacatcctctttcttctgcctagaatagccccatttttttcttgtcttggaaaactcatccttcaagtcccagttcaaaaactacttcctttatgaagcttttctctgattgctgctattggtagctctctgaggtcccacaatttctccaaatgatttaattttttaaaaaattaataattacaaaaggtagcatactgtataccctgtcctgtaccttgtttttttagcttagcaggataactcttaatttcagagtatataattttcccattatgctacataatgtttcattgcatggccttatcatgcttaatttagtgatttccttattgatgagtatttgtgttgtttttagtcttttccagacccaattaacctgtacataagtcttttccagactcaaataacctatagtaaataacctggtacataagtcactttatatttttaccaggatatttttgggatatatttcaagaggtgggattgttgacaccaaggtaaatacacttgaattttgctagatactgccaaatttctctctataggggttgtaaaattttacatcctcatcagcagtatgtaagagggcctgttttcccatcatcactccacaataggttttgttttatatctcttttattataagtatggttaaataatatctattcatatgttttatatgtttaaggcctatttgcatttctttttaaaaaatgaactgtcatttcaaatttttgttctttttttttttttggagatgaactctctctcttgtctaccaggctggggtgcaatggcatgatctcggctcactgcaacctccgcctcctggcttcaagcaattctcctgcctcctcagcctcccgagtacctgggattacaggcacctgccaccacacccggctaatttttgtatttttagtagagacagggtttcaccatgttggccaggctggtctcgaacttctgacctcaggttatccacctgcctcggccccccaaagtgcttgggattacaggtgtgagacactgcgcccggccgttcattttttaattgaattgtattggtctttttctctttaatattttaggtgctttattatatattaggattattagtccttagtttgtgaaataagctgcaaatattttttccccaatttttcttttgtctctttgctttatttctggtgtttatttttccccaggtgtactgttttctatagccaaattattgatcttttctttaattgcttttttgttcactcaaaggaaggttttcaccactgagaggttataaaataattcactcatatttttactctttttttttgcttatgttaattttttgtttggaacaatctcaaattcacagaagtgttgtgagtaccttgcaaataacttgttttttccttatgcatttcagagtaagttaccagtccgatgcccctatcactccaatactttagtgtctacttcctacaagcacagatatttcttagccataatacaagcacaaaatcgggaaataaacattaatatgttactataatctaaccttcagctctcgtttaaattgtgccagacatcccagaggtgtcctttagactatcaaaaggacccagttcagaatcaagcattgcatgtggttatcttgtctttttaatcttgttcagtatgaaacagttcttcattaatccttgactttcttcaccttgtcacttttggggattaggagttagttattttgaagagcatttcttagtcgggtttgtctgatgtttctttaggatcatattcaggttttatatctgtggcaggaatgtcacagaagtgctgtctgtgtccaacttttgatgacccaattttgattttttctaatactgattattttcactttgatcccttcatagatgttatctgccaacctattccattgtgaagttgctttttctctctatgccatacatattttgtgagaaagatactttaagactatgtaaaaatatcctgttcatcatcacactttatatttgttcacttatttgttaatatctgtatggattcatcgtttcttattttattcaacagattataatccgttactataattatttattctgattcttacattgttctggatttggccagtgggggtcccttcacaccagctcttatgttcttttaacatgtctcctttgggctctgatgtccttacactaggctgtcttcccatgcggatgccctcctcactctgctgtgactcctcatgccaggccgcctgccatatcagtgccctctctacccttcttggaccctgacattccaccaggctacttctctgcgtggatggtggtcttgctttaccccatctagtggcttaggataaaattattcaggaaggaatattttctaagtgactatgaataagtatttatcatgagatattatttttagtgtttagatctcggatccatttgaaattacccttgtgtattatatgagatacaaatccaattttatgtttttccaaatgactatcaaaatgattattctagtaccatttatcaaaaagttcatctgatttcaattatatgcatgtattttaaatttatgtaaatggcattatagtagatatctttatattatttacttttaaaaatcagcacagtgtttttaagataaattcctattgctctgtgtacatcaaatctgttgcatctaactctgtacaacattcaagtatgcattcactacatttttacctacaccataatgaatattttaaaaaatgttcccttgcggacccatgtgagaaatcctttagaatatatgcctagaattgctgggtagtagaatgtgcaggtatttaatttgacaagtgcttccatatttctctccaggatcatcatagtactctgtgggctggcagcagtgcctgaggatccctgtgacttctctcctgatacttggcattgtctgcctttttaatttttactccatggcacaatgtgtttttttgttgtttgcttttattttgttttactttgtatttctttggttattgttttcaacatttatttacattcttatgagctttttggactttttttcttttatacattgtttattcctgtcctttgccagtttttctactcagttgttgtcttcttgtttatcagcaggaattcctcatatacttgaaatagtaaaactcttgttggatttagacattcaaattgcctatatcttttccctttctattatctattaactttgtagtctttattaagtataaatagttaattttcaattactcaggcttatctttttttttcttttcctttatggcttatttaagaagtccttctatgcttttagagcacagaggtattctgcattttcttttattaaccatatggtttacctttcacatttaggtttcttaatactcttagacaccactttaatatgtggtattatgtagggatctagcactaggtagggatctaattttaattttctctataaaatgaatcagttttcctaactgtattgtctttataatcacttgtaatcactcttttcaacaatattgtatatctctctgtttactgaaatcttttatgccttagttcagttgtgtagttttcttcatatgggtcctgcacattccttagaaaatttctaggtattttgtaattgttattgctattgtgagtgaaatatttatttatttgttttatttaaatcttttttatttttaactttttttgggtacatggtaggcatatatatttgtggggtacatgagatgttttgacacaggcatgcaatgtaaaataattagatcatggaaaatggggtatccatcccctcaagcatttatcctttgtgttataaacaatccagttacatactttttgttattttaaaatgtacaactaagctcttattgagtatagtcaccctgctgtgctattaaataatatgtcttattccttctccttttttttttttttttttttttttttacccattaacaatccccatctcactaccagcttctcagtaccctccccagcctctggtaaccatccttctaccctatgttcatgatttcaattgttttggttttttgatcccacaaataagtgagaacatgtgatgtttgtctttctgtgcctggcttgaaatatttattttttattatgttttctaagtgtatattaatacaatattttcaagtcaaatttttttttcagtggattgttacatgtgcttcaagtatatagcatattaccttgctaaaaggcacgctgtctcttttgttttaatgttttttaaatttcttcttttagtgtaattatactagaattacagaaaaagcaggtatctattttttatcctgactttaattgtaatgcattcagcattggacttggctgtataattactgatagctttttaatgttaagaaagtattcctcggatccttgttttctaggattttattgaggaatacttgtcgaatattatcaaataccttttaagcatcaaaggccgtgaagataatagtctcctcccgtgttaccttgtactctttggtttcttggaaatgtattttaatacactctacatattgctcagcttacatgctgagtaggtgttaaggatgaaggaagatgcaattgtcacttgtcactctcaccagtgagactgagagcatttctttctcccatatcctctcaaggtcatttaaatttttttttatgataaaaaaagtttaaatttgcctttgactaccatttgcgtttccttttcagtgaaatggctgttcctgccttttgtctatttttcgcaaatattttctaccaatatatatcttttaactttgtttatggtctagtttttattgttaaatagtttacttattatttgttcaaatctatttcttcttcctttgtggcttctgtgtgttctgacttaagagggtctgcaacaccctgagagtaaacaagtattctcttaaattttatttttatattataatcttatagattattttgaagatgttatgaagtagagattatgtctattgcgtgatcatgcatgccatcttttctgtctgaattgaattgctacttctatgttgtttctttattctaacaaaatgagatagattcactgaatattaaaagactttgggaaaatgcgaatgttatctttatgtatctcaatcattatgaattcacctactaaattaaagaaaatagcactgttggctgggtggggtggttcacgcctgtaatcccagcacgttgggaggctgaggtgggtggaccatatgaggtcaggagttttagagcagcccagccaacatggtgaaaccccctctctaccagaaatacaaaaacttagcaaggcgtggtggcacacatctgtggttgtagctactcgggaggctaaggcaggagaattgcttgaactggggaggcagaggttgcagtgagctgagattgcgtcactgcactccagcttgggcaacagagtgagactctgtctcaacaacaacaacaacaacaacaacaacaacaacaacaaagcactgctccattcatgcatctttcttttacaacatttggaacaaaggcagtattacaaaatagaaaacagaaaagaatacaaataaaattattttgcttttgatattcttttaagaccaaataagagagattatggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacaggatggcatagacttactctgcattttgagttatttttcctttggtatagatggatcatgctgatagtcacttattacttaatatatatatacagtttctaatatacctttcctttgaagttaccctgaagtgtttttctgtttatatgtgggtctcctccttttctatgcaatttgctgcttaaggattatactcattaatttttgtttttattatgctacaggaggagttggatttgtcttctagttctcagatgtctcccctttccttatatggtgaaaactctaatagtctctcttcagcggagccactgaaggaagataagcctgtcactggtcctaggaacaagactggtattactctatctcctaacttctgttatttctatttcagattgagcttaggttccatttcttaaaagaaaatgctggattaaatttatgtttattaggctggcttgctgttttttaattggtggacctatattgtttgttgtgagtgattaccgtggagaggaaaggggagaaataatctttggttgtctctgtctttacaggtgaaagatactttaaaatagactcagaccccaccatcttcaggagagatttcaaagtttcagttaaagataactgaatggagctatgacatttgttacctcattaatctctgggtgttatcccgtgattttagcaattctcctttaccagttagtgtgtcccattcccaaaactgcagcttggttagaaaaggaggtaacagtttaagtacttttcttcagttcattcaggtatatgtactgtagctatgcttaaactccagttaaagattgttaatcgaagttaagataatgtgtagagaaaggtgtgtgatagaatctgttttttagggcttgcgtaattgctttcacattgacttgtggtttgtctggtttttctccagaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggtacctgagcagaatttaaggctgtgtaaatttatttggagggcagtaagggttgtgtcatatgatttgttttaattcaggttataatttctgagcacgtgctgtttgtcaggaatgtctttggttatgaggacgttgcagagatgactaatgtgtggttcctgtcataacaagggatatagctctccagaccagttacatctgatggttattttgaaaatctgggacactttcttggtgccattttattctggtggataaaatacaggaacacaaattttaagctagttgaaggcagagttcaggtcagccagatttttgtggctgtgaactttttttgttttgaaggaatatttaaaataatagggtccatttcaggtgtgttatagcaatagaatcacacccttaatctctgaggaggctgcatggtttagtaaacagtatattgacctggtcatgaggagacctgaactctgctttcaactagctaagaatttgtgtgtttcgtattttatccaccagatggcctcatacacttgtgattctatgagaggtttatgtcattattgaaagaagttcaagtctgaggatttggtactattcagatatgggagtcatttccgtatggagatctcttaggtagattagtcatcattgtactcatactgatatctgtatacactgggtacaagaaaacttttgcagcattcttatctctggatttagtttgttggcaccagatatgactaggcgataatggggtatgggttgtaaataaacaccaatgttacatttgtactgtatctccaattgtgaataggtagctcgttttttggagcatagttttaatgagggtaaatttgataaatttaatttccagatactcttttagctttgttctattacatggtcatagacaatatgacattgataaaaagaagacctagatgagagaatggatgaatcagtgaaaattcatccatcagtcccaccaaaaataaacagacaaacaaacaaacaaaaaccagtttgaaatgcctgctctctcagtacaaagtcagaactgctgccttttccatctgaaaagtagcattcctatagaataggtattcttgtgatttataaatgtgtattaagggttcatgaactccttgaaacaaaatgcaggatttaatgtatgttcatatgtggattattctagggatagtctccaaaactttcattaggatctcataaggatctgtgccttcccaaaggctaagaatttaaactaatgaagaacctcattgtagttcccataagctattaaaatacgtctatacaaaaagtctgacattaatatgactagcgtataaagcaggggtattcctaagaatttgcccttagcagatcattgactatgtttgagtgatggaagatcttacctataataagaagacaaactgttcttttctgagcagtttatcagttccagaaacctgaattacacattatttgaaacttcaatactttcctgtcatctgaagactatagttatttttttgtgagcatgtgctaatatgaggaactgcaccttgcctgttttttttcttttatttgagacagagtctcgctgtgttgccaggctggagtgcagtggtgtgatcttggctcactgcaacttccacctcctgggttcaagtgattctcctgcttcagcctccagagtagctgggactacaggcacgtgccaccatgcccagctaatttttatatttttagtagagacagggtttcaccatgtcggccaggatggtcttgatctcttgacctcgtgatcgcctgcctcggcctcccaaagtgctgggattacaggtgtgagccaccgcgcctggtgccttgtctgtttttatagtacaatctaaataggtggtattattataataacatacagatttaaagtatgtttttcatttatttgagaatggggaggaagaagggaagtatgggcaagacattatacagttaatcatgttaatactagtagtaaatatgttaccattgaaaaagaagaggtaatttccacaggtttaagactgagattctctagcttggaatgtaaaactcttcacaatttggctctagtttagttttttgtttttttgttattgttgtttgtttgtttttaatagagacaggatctcactatattgctcagtctggtctcgaattcttgggctcaagggatctacccaccttgatctcccaaagctctgggattaaggcgtgagccaccatgcctggcctcctagtttagttttcgaactttataatattactcttttctataaatcccttcttctagctcaactaatctgtcattgtcctttgaattctcttgtttttcctagttttttggctcaccattttctaccaaccagcaacaacttatgcctacttctacttctcagtcctccatgtcctttaagactgttttgagtagtgtagatgagagataatgaaagcctggaatatcaatgaaagtggagaaccaggatgaagagtagagatgttaaaagtgtagaatcttagagattggtaattggattgtgtagaaggaggctgaacgatagagaggaaggtgtctaggatgacttccgtttttctatcttggggctttttgggtagatgatggcgaaaattattgaaatgggagacagaggtaaaatatgttgcccagatcactctgctaataagaagtggagccagaacttgagcccaggtggtctggctcggagtctatgtgaataatcactatactgtatcgccttaaaaaaaaaatgacagatgtattccttgctctcaagaattctacactttaattgggggattaaattcacataaacagttaaataacagtcactgtgataactaataaattaataactcatgcagtgcccttatggaagctattattatatagaaaaggagattaataataataataattgcatttaagttcttactatgtgccagacactcttctaagtgcttaagtgcattatcttatttcaaataatatttacacattatttgaaacttcagtatgtttctatgatttatggtgatgggttgtgatatctccattttttagatgagaacgctaagtacagattatttgccctaagtcacacaccgatgctgtttcagacaaagtaggcattcaataaatgtttgatacatagtttaaaatctttgaagaaagtttaaaagaaagaactatcaaaatcagtgagttacacatagtcaaaaaaatatatggcattgaatccagccatgttccgttaagggggatttgcatgtaatgccagagaggattttgagcatgctaaaatggataaacagcctttggaatgtcctttttaactgtttccacactaggaacagtagtaactatgttcagctgctatttaaggccccaaacaattctttgcattgtagtttgtggcctggtcagcatttaccaagtcaccatgagagttttttgttctttcacttgaacatattgtcatagaaatttagttgtttcccctcattctgtgttgaacccaaacatgcctagaatatttagagtatccctgatttagctgctgggtaatttgaggatagttgggtactctgggatgaaaaggcttgatacaatatgggaaaaaaaggaagcagcagtggcttggtaggactcaagccacatttggccttgccttggtattcttccatctcctttgtgtgatgcggtcgtctcagcaaggagacagtggtaattacacaattggtagtacagatttggattatttttcttaattagtttaagaaatattacaaagccctctgtacatgttatctgctagggctttaaatctgtaactgtagctagaaataggattctttcttataagttgcctaattcattatatttacacctcttctgttctttaaaatagtcccaaagttccctgaacagtgtttaattttggggagggatcttttaatcataattttaaactcagaggatgtagaacatggcttcctataatactcttctcaaagtattggtttaagtcagtggttctcagtctgtatattgtggaccctgggatgtgggtgatgggggtagtagctttatggcattttgcaaagcatctgcaaatccatacttgaagcaagcattttctgtagaccaaataatttatttcatatatctttgtacagctcttcaaatttttatagctatacttctgactaataaactccaagttcattttaaatcttcactaaattcttagcagcctttttccatcatgtattttctcagtacacagaagctgaaaggacaaccttgatggttttgggtgaccaggatattattttatattaaaagagagcccttatattcaggagcctttggggagagactatgggttttctaggtgtagaattatatcatctgtgtgagagatggtttgacttcctctcttcatatttggatgccttttatttctttcttttgcctgattgctctggctatgacttgagcacttgggaattcttgttttttggttttttttttcacattatgataaatatatattttcatagtgccagatttactgtaatttcttattgttattaaaacctaacacttggtcatatgctatttactttatgtgtttctaatttttatttgcgtatttggcctaagcatgtttatatctgcttctgagtaatttctgcattttatatgtttttacttcataaaagatggaggccacctcaaaacaaattaggcatcaaaggaacatacctcaaaataataagaaccatctatagcaagtccacagccaacattgtaatgagtgggcaagagctggaagtacattccctttgagaaccagaacaagacaaggatgtccctctcaccactcatattcaacatagtgctggaagttgtagccatagcagtcaggcaagagaaagaaataaaaggcatccaaataggaagagaggaagtcaaactacctctcttcacagacgatatgattctatacctggaaaacccatagtctcagcccaagactcctagatctgataaacaacttcagcaaagttttaggatacaaaatcaatgtacaaaagtcagcagcatttctataccccagtaatgtccaagctgagagccaaatcaagaatgcagtctcattcacgatagccaaaaaaagaatataaagtacctgggaatacagcaagctggggaggtgaaagatctctacaatgagttacaaaacactgctgaaagaaatcagagatcacacaaacaaatggaaaaacattccatgctcatggataggaagaatcgatagtgttaaaatggccatactgctcaaagcaatttacagatttaatgctattcctatcaaactatcaatgacatttttcacacaattaggaaaaactattctaaagttcacatggaactgaaaaagagcctaaatagccaaagcagccctaagcaaaaagaacaaagccagaggcatcaagctacctgatttcaaactgtactacaagactacagtaaccaaaacagcatgatactggtataaaaacaggcacatagaccgatggattagattagagaacccagaaataaagctgcacccctgcaaccatctggtctttaacaaaaacaaacagtggggaaaggactgcctattcaataaatggtggtaagataactggctagccatatgcagaagattgaaactggatcctttcctttcagtgtatacaaaacccaactcaagatggatgaaagacttaaatgtacaggctcaaattataaaaaccctagaagaaaacctaggaaatatggttctggacataggccttgtcaaagatttcatgatgaagactccaaaagcaatcgcaacaaaaacaaaaattgacaaatgggatctaattaaactaaagaggctgggcgtggtggttcacacctgtaatcccagcactttgggaggctgaggggtgcatcacttgagatcaggaattcaagaccaacctggccaatatggtgaaaccccatctctactaaaaatacataaattagccaggcatggtggtacatgcttgtaatcccagttacttgggaggctgaggcaggagaattgcttgaacccaggaggcggcaggtgcagtgagctgagattgtgccactgcactccagcctgggtgacagagctcaaaaatcaataaataaaaatcaactaaagagcttctgcacagcaaaagaaactatcaacagaggaataggacagcctacagaatgggagagaatatttgcaaacagtgtatccaacaaaggtctaatctccagaatctacaagaaacttaacaagcaaaaaacaaccccattaagaagtgggcaaaggatatgaacagacactttcaaaagaagacatagacatggccaataagcatatgaaaaaatgctcaacatcactaatcattagagaaatgtaaatcaaaacaacagtgagataccatctcacatcagtcagaatggctactatcaaaaagttgaaaaatatccgatgctggcaagattgcagagaaaagtgaatgcatatacattgctggtgggaatgtaaattggttcagccactgaacgtagtttgtagatttctcaaataacttaaagtagaactaccatttgacccagcagtcccattactgggtatatacccaagggaatataaagacacacgcacacatatgttcatcacagaactattcacaatagcaaagacatggaatcaacctagatgcccatcagtggtgaactggataaagaaaatgtggtacatatacaccattcaatactacacagccataaaaaagaatgaaatcatgttctttgcagcaacatggatggagctgaaggccattatcctaagataattaatgcaggaacagaaaaccaaatacttcatgttctgtcttataagtgggagttatacattgagtacacatagacataaaaaggggacaatagacaacaggggctacttttgagggtggaggatgcaaggagggtgagaatctaaaaattacctgttgggtactgtgctcattacctgagtgatgaaataatctgtatgccaaacacctgtgacatgcaatttatccatgtaacaaacctgcctgtctaccccctgaacctaaaataaaagttgggggaaagaaaaactgaatccaagggaaaacgagaaggtaaaaatgtttaatgatcatttatgccgaagtattaatacattgtatctactccaaatccatgaaattatttttagatcttcttatctgggataaaatgctgtttattgaaattctgctactttcagtgtgttttttgaggccatctgaaacaagggctttgcttttataagttatcttttttagccaagacagatgttcttgacaaacaggtgttctgaagctttattttgatttttagttttccccgatcctttgaaatattgagctgagttttacatgggtcaacctgtctgaaagcataatgctttttttttcttaaacaaattataaatttacatgatattttagttgccagttattttagtaccttcattttgttagataggctcaagcagctgtggatgttaggcaaggctttcagcaccttataaaaatctgccagatctgaaaggaaacacttagcaggcaagtaaaatttttaatagattagtgttatgagttgtataagtctttaggttaatggtacaggtttagtaccccttaaatgaaatgcttggaaccagaagtgtttcagattttgggtacttttggattttagaatatttgcatatacataatgagatatcttggggacagaacccaagtctaacatgaaattcatttatgtttcatgtatatctcatacacatagcctgaaggtaattttatataatattttaaataattctctgcatgaaaccaagtttgcatacagtgaaccatcagaaagcacagttgtcactatctcctgtggacaatctgtagttgtttggcaccaccatcattcctggctctgaattcatatgctactgacaagcaatcattttcttacacttattcacaaattcacacctaagaacttaacaaaaattatgacataccattaatacagtgaaaaaataatgtgtgcagagtaacaaggcaggacagtagaatcaccagaataccagtgtcagctactacacaacagcaacaacaaaaaatggcagctttcagtctctgcctttgatgctgttttcattaaaagcctactgtaccctctattttatgtcttcaggtgagaagaaacatcagaagcagttgagagactggaagtgggtcctctagggatgaggaggcattctgctggatgacttctaaaaatgttttctatggagtcatctgcctcattaacaagtttttgttttagaagtctctttttgattttgtaaactgacatgatttctttttctgttatgactgtatgctgctttagtccttcactaggcccatcacacatttttaccatgtcatctataggcactttttctgcagcgttaacagcatcatcttcattgtcattattatagattgagtatcccttatccaaaatacttaggaccagaagtgtggagttttccacttgtgaagttgtgtcagcactcaaaaagttttggattttggagcattttggattttgggtttttggattaaggatgttcaacctctaataattctcgtcagattagcataaatttaaaataatgatacctctgaatactcagaaaagaattgaaggccatttttgggggaagagggaaagggctggtatcatctacagactattttgaatcacagatttatgtttaccgtgattgttagctaagatttaatctcaaatggttttaagttttttggtatttgtagtctttttttttttttttttttttttgtcctttttagggatctgcctgcctcagcctcctgagtagctaagactcgaggcacataccaccatacctggctaatttttaaatttttttttgtagagacaggctatcactatgttgccttggctggtctcaaactgctggcctcccaaagcactgggattacaggtgtaagccacagtgcatggcctgtagctccttcttcttctaatattgagttactaagtttatgttcagatatttttggtattgtatgcatttgtaaatcctattaatttagaatacatgactctccatattcagtgtaaaagatttgttatttataataagacaaatccttttagcactaataaatttcagaggttaattcttagaaatctagggattacagcaaatttgatagctgtttagttgagaaagataaataagaaagtatattaaagtatattgttaatgataactcaaagagatgaatttagttggtcacattaaaaacataacaaagtcaccataagcgtgtgctgctattgatccaatgttttaattgatggtgtccaatcccttggtgttgatcttacccattacgtctgcagaaaagacctaattataagctgcttcccctgccacagtagttgtgtaccctttgattccttttcttttttctaacgcaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatgtaagttttgaaacttagtgcttctcttaatgcctgatttaaaaaccaacaaaaaaacaccttttgcttttgttgccttgtttttgttttttttagagtttcttatattgcatcaaataaaagagtgtgctgaattgcacatctagtctttggaggaaaattagggtaaggcttactacgttagaatctaagtgaaaaggtttttgaaagtgaagtggtttgatgaaaagcaaagtatgcatacctccctcttctttactccttctttagaaccaaccctcttattattctcttcaagcccttacaccctcaacccagtcatccactaatattttacagattcaacgtttcctgattgaaatgttttagcgatcttcagataagagtctatagattactttttaggtaggttttatatttagctttcttccttgccgttttgaagtattttcaccacttcataatgatgactagctactcttaggaattctgtctcttagtgattatttggtactttcccatttttgcaaacctttaaattttctagcatgttgtagggatttcttataatttataaatcacatagtttcctaagacctgtcactctctaaagccagttactgcacttgccaactaactcttgctttctttcaaaatgattggaaataacttatgtattaaattgaacatcttggtcctaaaatttaatgaatgttaaagctatatagtcaaacagtggattctctaaagttacgattgggaaagcaaagtgtgtatgttttctttaaaataaaaatggatactactagttgttaatattactacttcatcctttctttaggtagaatgcatttgaaaagtaattttaaaatcctgtgggttatgcaaggttgtttatcagactactgtctgatctgtctgccagaatttattaaccagcatgtcagtgacccatttaattataaaattgctccacagttgcataaacagtaatctcagccagcaatattgtaaaaattcataacaaaggaatattgtctggtgaaagtagaacatccagtttctagaataagagtcccatcgtttgtataggtattgaaaacaatgcatgtcaagacatggaataggaaaattagtgttgctatgagactagagaccatggacagtacaggattaggcttgactgttatgttggtttgttttgaggactagaagaggtaagcacaatgcttatggcataataggctctaatacatagcgtgtgtttcagttgaagatgaaacaatgttgctgggatgggaaggtggtgagcacaggatagaggcaactggattggcaaaatgttgataatgatggaagctgggtgtttatttttctatccttttggtgcatggaaaaatttctacaatatgttaaaaaaatgacaataacaaaaatccaaaagctttctgtgatattttcaattaaaaagttgtgtgaccaataagaaaagagtatgattttcatgggagaccaaccaggttaagaatgatgaaaaaggatttttaaaaataatgctttgaaatttctttttttttgttttattatactttaagttttaggatacatgtgcacaatgtgcaggttagttacatatgtatacatgtgacatgctggtgcgctgcacccactaactcgtcatctagcattaggtatgtctcccagtgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccttttaatactcttttaaattatgaacttgaatgtttcttatataatacccccaaatgaaacttataatagaaaatatccaaagttgcctttatgtaatatgttaggacatttaaaatatttttatgaaatattttagacatgaaaaaaagataaagactaattagaactttaaaaatacataggtcaacagtatatcactgttgttaaaaaatattaacaatattaatctaagtcatcccaaacatggaaaagtccagaaaagcatagctaggatggggagagtatctagaaaccatggggtagaggagtgggttaaaggttggaatgattcagtaaactgaagaagagaggatggaaagtagacctgggagccatcttccaggaaaggaaggttgttatgtggaaaatagaattgttctgcttgttccagaagagttatctggaacaggtgcaggaaaaatatagaaaggtttcttctaaacataaggttttttgatacaatcattgtatttaaaaaccagaagagcaacccccctgcctttttttttttctacttttaggcttactatctgaataatgagcatcttaatgttgacaatcatcactgtatgccattgacccattttataatctctaaacatattccaattaattatatgttggtctattagtcagacatcctttattagttctctggtgtgaaagactgtgtctgttcagcttttgtactcttaagggggatctgtaaatttaaagtatttttaatgaaatattttagacatgaaaaaagataaagactaattagaagttaaaaaatatataggtcaagagtatgtcactgctaaaaatatgagaaaatgtagaaccaataaatactgctagaaacaaaagctaatacttattggttactatgttttctcatctcacacatcccccagttcttcaacgttaattgagactttgtcagcaaagtctcaatgtatgaatgtctacatttattgtatgaatgtatattcagatgaggttaatttttttaacaatgatataccgttgacctacaatttttannnnnnnnnnnnnnnnnnnntttaggatacatgtgcacaatgtgcaggttagttacatatgtatacatgtgacatgctggtgcgctgcacccactaactcgtcatctagcattaggtatgtctcccagtgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccttttaatactcttttaaattatgaacttgaatgtttcttatataatacccccaaatgaaacttataatagaaaatatccaaagttgcctttatgtaatatgttaggacatttaaaatatttcattaaaaatactttaaatttacagagcccccttaagagtacaaaagccaaacagacacagtctttttgaagtttagaattgacaggattataaagaaagattcaaacactttatgtttaatgcaaagagacctaaggacaattagaataattttctagtcaacctgcattgaggtttttgtgcttatttttacttggccagcacatcgagacgtgagccaagcctttcaatatgagtttttttggtagaaattttgactgaatgtttatttcaagtaaagaagcattagtctgtcctagcagcaggccaacccactcaggaacccaaagtaaatctgttccagaaggagttgcagagaagaactttgatcagcttgtatagccttctgtgttagtaacttggttgacctcagtattacatgtgtctgttaaaacacaagtcctattaaattaggataaattaatataaattcctaatttaaaatgatcaaaaaaatattttttatcatataccttttgtgcctttaaaccaaaagtatggtgaaagaattgtaatccaccaaaaaaaaaaaaatcatatcagtttttttgtggctttgtaatgctgacatggcttctttttctaccttttttagttcttttgtttggctggtttcactctccagaggcctgctacagccataagtagcgtttttagcataccatattctgcaaactgcattaaatgccacattttctgttatgaaacagtttgcctggttcaaattatatcttactcttcctgtcttttgctggtaaatctgttttgtttaactcttggagacctcacctaagttttcaagaaatatggtttgtttttggctgtgatcctgatggaaaaaatgaacatgatctctcatttcagtgtagaagttctctgtgcagtttcttagtaaatggcaatcttggaactacaaagttgactttataggacagcatgcttatctttctttaaagggctatttagtgttgccacacatcaaaccaagggcttaaaaacaagcagtctgtttaaatctgcattacactcactacttccacctacccatcataatcgcataaactttatgaaacattactgcccttgttttaaggttataggaattacattgttttagttattggaacaaaagaccagaaaaacaagtggtaaaattctacatcttccacagtgggccacattggagcaaatactcttagtggaaatcagtaggtgggaataatggaaagaaaagtatccagaactgatatagaactataaataacctcagatgtgaggttgatgaagggatacaaactactgttaggagtctccttccttccggctcagtcaccccactgaatatcttccaaactctgtatcaccttttaccctgtttctaaatcctatagttaggaaacttgatcccttccatcccaaaatgacttccctttgggagtccctgtcttgggttcctagagtcatcatgagaaggtaggtgctggggggaatcctttgctactggtttgcaggtattagaaatggtgcgaaggggattctcctgtcataccaaattagaactttgtatttcctttctctagaattggtgtacagttaatttagggatttcaggtatttttagtattgttctatgggagtgatgtgacatgggcctagatggatgccctgcacacagtgttcctctcttgcagtggaggaacatgagcttggagaatctaccatgtgtatagcaagcagaaagcaagcctcctcattgtctagagggagattttatctcatccttcaaggttgcttgttggaaactgaaccttgagaatggcctgggaaaagagtggtccggaccttgcattctttgcatacccaataagacgtgtaggagcaaaactcataagagactccctggaggtgtgtttctcaagaaaaatatgtctataataatctatttgcaatgcatagcaactcagaaaaacagagactgcctatgttctatttcagaaaaaaagcaaaacttcaatagacgttgaagttgcttatctgtaacatccaagaataggacgctggttaggtcaaaatgtgagctgaatctccttaaattatgtggctagcttagatctcagaagataaataatgaataggcacttcttaataacttctaacaacaaacaagttgagatcatgatatttctttaggctgcaaagtagaggaatctatcagaacaaatccaataggaaggatttggagagctggagttatccagggtttagtaaaaaaattacttctgtgctgactgcattgtggctttgctgctaccagggactctgcaaataaaagaaaatatgctttgtttaaatatttgcagtatctctttaaatgtaggtttggagcttctaaaaatttatcttgaatagcagttcagtttcattcgaggttacagtagctttggaaggggaagtgaacagcttttttttgttgttgtttatttttccttcctgatgcattgcattaggataaatttatgttgtggcaacctcagcattctttattctgtactttttgtactttttagtttgtcatcctttttttttttttttttttttttttttttttgagacaaagtcttgctctgttgcccaggctggagtacaatggcacgctcttggctcactgcaacctccaccttccaggttcaagcgattctcctgcctcagcctcctgagtagctgggactacagctatgtgccaccacacccagctaatttttgtatttttagtagagatggggtttcaccagtttggccaggctgttctcaaactcctggcctcaagtgatccacctgcctcggcctcccaaagtgctgggattataggcatgagccactgcgcccagcagtttggcatctttataagaataataaataattatttttaaggattctgatttttatcttaataaacaatgaaatacttctctctcctttctctaatttcccttctcaaaaccttgtggggactcattctagggagacagtccttttataccccagagactttcttgcaaatcagtttccttgtctggtagtcattcttactagttttgtgtgcattcttctggagacagttctttaatatgtaagtacttatagttttatttattgacctatttcatagaaaaggtagcatactgtacatgtcatcctgcaacttgcttttctcacttataccttagagatctgttcagatcagtactaaaaacttttctcattccttttttaaatttttatttatttatttatttttttaaagacagtctgttgctctgttgcctaggctggtgtgcagtggcatgatcatagctcactattgccttaaatatctgggcttaagcaatcctcctgcctcaggctcctgagtagctagatgtgtgccacctggctaaattttgatttttttttttgtttttgtagagatgggggtcttgttgtattgcacagggtggtcttgagctcctggcctcaaatgatcctcctgcagtggcctcccaaagtgctgagattacaggcataagccaccatgcctggtctttttcttattcttttaatagctgcattttaatggctacatagtaacctacttcataggggtgccataattattgtaaaattttgcagtccttttcattataaacatttcttcattgaataacttggtacttatttcattttgttcatatacaaatatatctatgggagaaattttattttatttttattatactttaagttctagggtacatgtgcacaacgtgcaggtttgttacatatgtatatatgtgccatgttggtgtgttgcacccattaactcgtgatttacattaggtatatctcctaatgctatccctcccacctcccccaaccccacgacaggccctggtgtgtgatgttccccttcctgtgtccaagtgttctcattgttcaattcccacctatgagtgagaacatgtgtgttcggttttttgtccttgtggtagtttgctgagaatgatggtttccagcttcatccatgtccctacaaaggacatgaacttatccttttttatggctgcatagtattccatggtgtatatgtgccacatttttttaatccagtctgtcattcatggacatttgggttggttccaagtctttgctattgtgaatagtgctgcaataaacataagtgtgcatgtgtctttatagcagcatgatttataatcctttgggtatatacccagtaatgggatggttgggtcaaatggtatttctagttctagatccttgaggaattgccacactgtcttccacaatggttgaactagtttacagtcctactaacagtgtaaaagtgttcctgtttcactactttgtaatgattgcctgtttcctgactttgtaatgattgccattctaactggtgtgagatggtatctcattgtggttttgatttgcatttctctgatggccagtgatgatgagcattttttcatgtgtctgttggctgcataaatgtcttcttttgagaagtgtctgttcatatctttcgcccactttttgatggggttgtttttttcttgtaaatttgagttctttgtagattctggatattagccctttgtcagatgagtagattgcaaaaattttgtgggagaaatttttagaattggatttgctgggccagaaggtatgtacttgttcagttttgataggttttaccaaatggtcctccattgaggtagttctaattgagaagtcagtcacagggcttaatggagtccttgggtgggtttcagtgtttccataatcagcatcctatattagtcagttctcacacttctataaagaaatacctgaaactgagtgatttataaagaaaagaggtttaattgtctcatggttctgcaggctgtacaggaaacatggctggggaagcctcaggaaacttacaatcatgactgtgggtgagggggaagctggcacatcttacatggctagagcaggagaaagagagaaaagagggaagtgctacacacttttaaacaaccagatcttatgagaacttactatcatgagaacagcaaggtggaaatctgcctccatgatcgaatcacctttcaccaggctcctcccccaacattggggattacaattcgacatgagatttgggtagagacacaaatctagatcatatcacacccctttaccccacctcacctcatccctcatatagttgttagcaatgtgcaagtgcatttgtctggggagtccataagctcttttgttgtctttttttttttaacagcttcattgagataaaatgcacattacataaggatcacccttttgaactgtacaatttagtggtaccatcactgctgtctaattccagaatatttttgtcaccctaaaaagaaaaccccatagtcattagccatagtctttcctcatttctcactccctgcagcccctggtagccatttaatctgttttctgtgtggagttgtcccagacatttcatatgagtggaatcatacactatgtgcccttttgtgtatggcgtctttcacttaccatatttttttcaagcttcagccatgttgaagcatgtgtcagtgtttattcttttttatgactgaataatattctattatatggatataccacatttttgataatccattcatcagttggtagacatttggcttgtctccactttttgtctgttatgagtaatgccactttgaacactcatgtacattttcacagtcttttaagaacgatttttaatatatagagtataaatcagtgagaaaaatgcaaattaattcaaccatcaatggacaatatatacgaatagataattcacgaagaagagtggtaaattttaaaaatgaaagtatcaatggctgtgtattcctgaagggatattccctctgaaagattactattttataactatgtgaaagaatattaattgttagcaggagagatcttgtggctggttacaggtagttcgagaatgatattcaagaatttaaagtgttatggttagacttttctgtggctcttacctcccttgagtatgagatctaaaggaaaatgtcttatggcttcttataacttcccagtgtgtatacactgcggttgtgtgtgtgtgctgacacatgttaaactttggttattgtatgggtacacatgttaaactttatatttagttataattttaaatttcaaaaagtacaaaaacaaaaaatagtacagagaacacccaggtattcttcagccagattcacctgttgttaacattttacccaatttgcttgcttattctttatctacctacctacccatccatccatccatccactatccatccatccatccatccatccactatccatccatccatccacccacccatccacccaccatccaaccatccatccatccatccatccatccatccatatacacacacaatttttttcctgaactattttagggtaagttacatacctcacagtattttacccctaattttttcagtgtgcattttctaagactaggtacattcttttattaacttcaataatttacattaataaaatagttcaatcacctgtcaatattacaattctgtcagtcgaccaaatatttactggattttcacaaagtctttgtgaaggggacattatttattcccattttactactgaaggaatcaactagctaagtgattcaacaaatgtcatattgctaagatggctaatattaataaagtactatgtgccaggcacttttctaagtgcataacttgtaaatactctctttaaatcttataacagctctttgaaatgaatcagggccctgaggaatacagagtaaggaacagacagagtgctcagaggaatgttaagttttaggctctttttctgcttctttagtgattaaataacatttcatgctttgtgtgtgtgtgtgtgtgtgtgttttaattttaaaacttaaaatctgaaaatgggagctggaatgggagcaggtattttccttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttgtatttttagtagagacggggtttcaccgtttttagccgggatggtctcgatctcctgacctcgtgatccacccgcctcggcctcccaaagtgctgggatcacaggcgtgagccaccgcgcccggccaggagcaggtattttcaatattgctttagttgcatggtatatcagagcagctgtgaggtacattgttgatggaagtaataattttgcctcctctgtgtgtgtgtgtgtgtgtgtgtgtgtgtgtgtcacataattttcctgaaagccatatttgtatggtacattatagcttacagagaaccttcatgtctgttacacagttgattctcaccccaatcatttgaccacttataattgagttaggattcaagcctagctcaattataactggtcttctcctaatccagtggtgtcatcattactctgtgctccattaatagagcctttactttcaaggtagtcctgatgcagctcagactttaaattacccacgtcctttgcttacaactttatgggaaaagaaaaaagaaaaaaaaagaacaaattacccaagtctcgaaacttgctgataccttttttctccctttacaaatgttttttcttaatttataaaaattaagatagttttaagatttaatttttaaaaattaaggtagcagatagttttaagtcatgagggacaaaggtttagaaagattgaccttatttgaataatttggtggtatcaaatgaaacctgtagcaaaaataatcagatccatatttcattatatagtagtcattattgtgctatgtcgttgtgccaattaaattaagtgtatctatttagcatcagccccagaattattttgtttttggattggatgagacctttagaggactaatgaagtggctttaaacttttttgtacacagtccacagtaagaaatgtatttaacctctctttctctcttatactcaatctcatgaaacaactcttactaaatataatgcaccctttttcttttattctgtcctgtgcttttctgtcaaattgtttttgaaggctgtggtgatttactaaattgataaacctgatattgggttataataatgtcataagcactattctggtctaactctctctttttactaatatgtaaatacaccctacaaggtgacgtgatttatttttatttttatttttagattttccaattaattcattgcaatgctgggccaagaattaaggactcctaacttccaattttgtattttcatttaatgacttaaattactattacttttatttagttgcatcaagtatttcttttctttctttttttttttttgagatggagtttcacttttgttgcccaggctggagtgcaatggtgtgatctcggctcaccacaacctctgcctcccaggttcaagcaattctcctgcctcagcctcccgagtagctgggattacaggcatgcaccaccactcccagctaatttttttgtatttttagtagagatgggttttttccatgttgaggctggtctcgaactcctgacctcaggtgatccgcccgccttggcctcccaaagtgctgggattacaggcgtgagccaccgcgcccggcctccatcaagtatttctgaagacacgtgaagcagtggagtcattaactgaaataacaggaaaccattttgaggctcctttgaagatccctgtgttcaggacttgggtccctctattcttcaagaggctgtgcccatggtgtggctttgctgagagcatctggtgcatacttctgcttttacctctcttttggttgttctttatcttcattcagaagatgagattggtagggtttccccatcctataacctagcagggactttgtctattatctgttctcattctggaaactatactacatatcagaaggcattcttcattttaaaaaatagaaggaaatagtttgcaggatgaagattatttccttgataatctgccaaataaatggttcaggttgccagtatgaagcttctttaatttttggcaaatgggagctggttatatgcatacatacacacaaaacttaatagaaagagtaaaataaaattttgactgtcatgagattgagaagagtagagatagtgaaagtctaaattttctctttttttctgctttaaacaatttaatgagaaaaataagtgtacgtaagattcttaacaaaaatcaaattaagttttttaatgtatttgaatatttaaagtaggattgccacaaattaaatttgccaatgattttaactatgtgtgttttttaagaatgtatctataaatatgtttactgcaatacatatgcaataatgtatgttatgtaatttttatttaattgaaagattgtatttttatttttggtcagttacagtgaagaggttaatcagtaatggcttccactttatctatcagtttagagggcaagattcagccaaatgagaataagaactgttagaaagatgtgcagcaagtcaatgattaccatgtgattcatccataggttatcaatacttgatctgacttgagtttacatgagatattcgaatgtatttcttagcataaaaatcccattttaatttttttttttttttttttttttttgagataggctcttactctgtcacccaggctggagaacagtgatgcgatcatggctcactgcagcctcaacctcctgagctcaagtgatcctcctgcctcagcctctagggtagctaggactacaattgtgcaccacgatgcccagctaattttttaattttagcagagacgaggtcttcctatgtttcccaggctgttctcaaactcctggcctcaagcgttcctcctgcctcgacctaccaaagtgttgggattacaggtgtgagccaccactactggctcctatctagtattatatctaatttaatttatggtcattgagctcatttcttagcaacatcacagaaacaaggctttagtcaattttattaataaaaagagactataataacttacagtgtttatcaatcaataaggtttttagttttaaaaaccttattgattgataattaaattgataattaaattaaaacaagctgggccagcactttgagaggctgaagcaggaggattgtttgagcccaggagttcaagaccagcctgggcaacatagagagatcctatctctacaaaaaaataaactagccaggcacggtagcatgcacctgtagtcccagctactggggagcctgaggctggaggatctgttgaacctgtgaggttgaggctgcagtaagctgcaattgtgccactgcactccagcctgggtgacagagtgagattctttctcaaaaaattaaattaaattaaactaaaaacaaaatgtggacgtacttgaaactttgactcttacattgattcaaccttcaaaggaacttgtccatttgtgaaagttttccttttatataagtctttcttacagtcaaataagtgtttactaagtgaaatactacattttatagtgcagtggcactcaaaggaaactattttgcagctgtagagttttttcttttgtcctttttactttttccaaggcaagatgcctggtgggagagttgtctggaggcaggatgatcagaagcaggacctggccagctgttcgcttatttcagtctgtatgaaatcatctgatatgcccataagagagatgtgtcaattggctaatgggtcagagtattgattttatgttttcagattgctgacagagagattaggcttccagatacaagcagttccacaagtctctgttttcagacaggcacataattaaagtaaccacacagttctctgaggttagagttccatgctgtgatgcaagcctctctatttggtatttaaaagcagtttgaagctgttgtgtaagtatcactggacttggagtcaactgacctaagttctagccttggcccttctactgtcttaacagtggattaaatgatgaggcttattttaaagaatcttgaaaactatagtaatttcaacaagaggagattaattgaatatattatgaaacatcaagataattgaaaatctgtgctgccattattgcatgtcaaaggtcattttgatacactgtatgtgcaaaagcagtttaccaaacagaattacatacagtgtaatcctttttttcttatataggaaaatacccacttccccccacttaaaaaaataccaaacaccacaatgtgtgtatgtttagcctacaaatcatattttttttgcctaggaagtattgaataatttaaatattttatattcagatagctaaagatggcttgctgagataaaacattggagccctgtgtttggtgatagccgtgggtttcatttatttttactgtctttatcctctgtatttattgatagtattgaatatttattttcagaactattatagtgtatctgtttctatgggaagaaatgaatatttgaccacagatggttttcatttttttagtatggggcacgtggattgacagcctttgaaacttgaatgctgtgtaatattcaggtgcttttattgtttatagaaatgcctaatccttgtttgaaatttattaaatggtatgccatctgtaagcccctctaaattccacagattaattagcctttaaagtaaggttgccttttgtctaacttttagtataaactcttccatctgggaactttcacttttatgtccctgttcagtgttctgtgtacttcagcactctagtattaattatggacactggcattctaagtaacatgaagaacactaaaaataaaagtagactgaacaaagtggcaatgtccggagaatagtttgcatttggtgaataatcaatccatcatggctttgccattgctctttgtatgtgcgtgcgtgtgtgtgtgtgtgagtgtgtgtgcatgtgcgtgtttagcattacttaagagtgagatagttattcttcagggaaatttttacagatgatggtttcacaaaaatcagcctttttgtagtttaaataaaaaaacaccctttttgacatttcatgtaacatttccttgtgggttctgatttaaaggttgttgaaaatatttggtgttggcagatcacttggttggctttggcatacttctctttctaggaaatgtagtatcagggtgggaattgtgttgttgttttaaaagaaatagattacaggctggcacggtggctcacacttgtaatcccagcactttgggaggccgaggcgggcggatcaggaggtcaggagattgagaccatcctggctaacacggtgaaaccctgtctctaccaaaaatacacaaacaaaattagccaggcgtggtggtgggcacctgtagtcccagctactcgggaggctgaggagggagaatggtgtgaacctgggaggcggagcttgcagcgggccgagatctccccaccgtactccagcctgggcaacagagcaagactccatctcaaaaaaaaaaaaaaaaaggaaatagattacattctttaactttatttactggtctcagtaagagttattgaacactctagagtgtttactttttaaagtccattgcaaaatatatagaaattagtaattcaaccatctgtgtactcatactaatcaatgtaatataggttggcgctttttatgcacttaattttgccacctctctcacttccccaaagaaattagactaatgtataacaataggcttcataacttaatttagaaaacataacaaaaataatttcgctcagtaagtttctgttgtagtagatattgttggtattaaacaaaaaagtaggatcagatgtggtttggctttcaaggtataaaatctaggtggggaaagagagagagagttaacattcttgaaacaattgagagcattagagtgttccagtatatcctccaaattctaagggtataagatgttcagagaaaataaaaaatcagggtgggttagaataattgagttcaaatggaccttggaattaggttagtggaggagatagcattccaaatggaaataaacaatgcgaataaggaaacatgttagacatgtatggagattatgaagtagccttaaatgataagattggaggagtgtggcttgaatagctgtagatttagggcagaaggtctggttaggccgtgggaggtcacaatatggaagaccttaaaagaaaagatgggtagcagggatacatgactagcttgtttttgcaattgagtagtaagataaaaatattttcttaggagaagttatcttagaaatggtggacaggatgagatggaacacaattgaaataggagtctgttgcagtagtatagggatgagttaatgagtgcctgtattaggagagtggaagagggaatagagagaaagtaattactgagacacattttcactggaataaatttggtcattagtatatacttttaacatattcaatgagtgaatgagggattgagaaggactgaatatagtgaataaagtaaaataatagttactattgatagaaaatggatagatttttaaacaatctagttagagggagatagttcagtttgcacataatgaatttgaagtggtaataactgtaagaagtggccttataattaattgaatatatggttctggggcatagccatttaagggccagagatacagatttaagatgtatgtatatatgcatatatatttaaagatactttctgagggagtttctaaggggaaaattggaagattaataaacgagccttagaaaacataagaagaaattatttaacatttgggttttagaaggccttatttaatcatttgattttaacttatttagtttgagcagtgtgttttcaaacctcttttgaaacaactagtaacctatgctttgaaaaaattgttggttaaaataattgtaaaaatgagtatattctgatctattttgatctgattttaaaaccagggtattctgattcattataactttttctagattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagaggtaagtgttagtaatacggctgagtcgagatgggctaaagtatcctctggattaataaatagagaaacttttacattttaaattaaattatgtaaaataatagtgctaggaaaaggagggtataataagtcctaaaacatttgcagtaaggataaagcatttgaaggggaccctttgaattgtactccccaatctacatagaaaagttgtctccttttcctaggtttctcctcattcattgccttagcaccctcttttctggctaagtgaatcacactgaggcttctaaagtgccctgccatattttcccttttaaaaaagaaaacaatataaaagtgtttttattttttctcagtccacctaacaactaatgtgatttttgcattctgttactatgctgactccaagaggttttaatctcctcagttctattcgggaaatttgctgttttcagaatttctcactgcagtgctgaaccatatagatgcctactgaatggggcttcttacactctttttctcttggccctgagtacatgggaatactcctatattttactgaaaacaatgatttaaaaggttagggaggcaaactatagaagtgactcaaaattctttggggatccgtaaaaatataaaaaatgttgaattctggtcgggcgtggtggctcacgcctgtaattccagcactttgggacgctgaggcaggcggatcacaaggtcaggagatcaagaccatcctggccaacatagtgaaaccccatctctactaaaaatacaaaagttagctgggtgtagtgcacacctgtaatcccagctactcgggaggctgaggcagcagaatcgcttgaacctgggaggcggagattgcggtgatccgagatgatgccactgcactccagcttggcgacaaagtgacactccgtctcaaaaaaatatatatacatatatatattgaattctttcctcttgggtgaagaggcaactgcaatggagtggctgctgtgtttttttctcttctgcttctctccttttctctccctgctggaaaagggaacctggaagtctctgctctagtcttgaaaagtgttatttcctcacctttgattttttttttttttttaaataagacaaggtatttgtaagacaagagatttacgtaaccggtaaagaggaaaattctaatcttaagcgttgctttttctgaaatcgatgttagtttaattgtatttaatgtggtcatttcctttagaaccagaggcttaaagtccctagtccaaagcgaagagttgtctgtgtgatgatagtattggcatttataatactgaactatggacctatgaggtaagtgaatagatatttattttggacactaatgctaaaaacttaaattctcattattctttagcttttgtcataaactagagaaaaaatgatttgtttttcaagatgtgtaaagagtaatgagacaggagccatgccttcaaagatctcatgatccagctgggaggagagacaagtagaaggatgactatggtataatgtgatgaacataataataacagtgtgaatgagtcctaacataatatagagtacgagttccttgaggtgaaggttcttgtcgtattgatgggtactcgatacattttttgttgagtgactgagttataagggagatacctacgaaggaagctgaacattgaactgtaatatcagtttgccatgtgcaaagtatgagaaaggcatgccaggcaaagggaacagcatgtttaaaggcacagttatgaaatggcatgacatgttcataaaaaagtgaaaagttcagtgtatcttgtatatgtggggagtgtgcctgaggctagatatatggttagaagtataggtgctgctgtgtacaatgaggcatccctagcttttaggtggagggtaacataatcagctttgcatattaggaagaggactttgtgtgttgtattgagtatagactgcagtgaggagaaactattggcagagaaagcattagaagactattgaggtgtttcaggtaataaatgagagtctgaacttacactatggttataaaaaggatgagcaatcttagggtacctctctgatgtagcttttgtgggatttgttaactggtataatgtgggacatgaggaagaaaagagggaagttaaggataattcaaaaatttctaccttgagggaccgaatggtggtgctgtcatcggaggaagcaaacatagacagatggatagttttatgaagaaagacaatagtttttattttaagtataggaagtttgtggcactgactagatattgagaattaacattatagataggtaggtagactgacagacagataatgttagtggtgtagatgagattatccaaggagaacaagtagaggaaggaaagtaacaagaatctgggggacaccagtatgaatagtagatagccttgggaaaagaaactcacagcatattaggggcagaactgaaagaaagtagctttttgaagccaaagtaaaaagagcttcaagcaggtcttgggcagtggtatcacatgctgctgagagcttgggagatgtagaaagctgaatttggcaattatcaggtcagttgtaatcttggaaagcagatttagtaggggtaggcatgaagtctgtattaaaattggttgagaaattgaaaggagttaaaattgaatgatctcttttttaaaaaaaaacattttttatgaagattttcaaacatataggaaatttgagaaaataatatgatcaaccccttgctctcatgaaatttataatctaatataggtgacatatactaatcaaaatgatcacacaaataaatgcaaaattgtaacaatgttaggtgccatgaaggaaaggtacatgatatcatgaggccacataatagggtcacttgacctagttagggaagtaaggcaaggtttctctgagaaagaggtgattgtgttaacatctaaaagaagattaggaattatttaggtaagatacaggaagaacatttcatatagaatatataaacatctattcccacatttgtgttgtgtctttgtgtttatatgtatttagtttaaaaattttggttttacatgaaacaattatatacaaattgtgctttctttaaaatatgtgaatacattattctcttttaatactacatagttttttgtagtgtaaatgtgccataatttagcaattctctttaggtcttgggaacccctttgtacccttaaaagttaccaaggatcccaaataatttttgattttgtggtttatatatactgatatttattatatgagaaattaaaactttaaaaataaaaaatttttaattcatttaaaaataataaaccgtaaaccattactttacatgttaacataaataacatgttaatgaagaataattatatctcccaaacctccaaaaatttagtgagatacagaagagtggtactactttatagttttgtaaaaatattttttttggggggaagctcaaatacatcagttttagtttttctctatatacacatttatttgctactaaaaattgaaatagcatattgaaatttccttttgttgcaatccaaaattttgaaaaccagaaaaccaaattaattattattatgctgtggccagactactcagtattttctttacattctttcctccaagttactttccttcaaattcttaatgttgggttttatctcactgacttcaggcttctaaaacacatggggatacttgagacctattgttgcttctttaggtcaaatcaatagtttcataaaaatctttgatgtccgacttaacaggatctggcaggattatctgttttttcatgtaatctgttatgatatattgtttgggttgaaataaatgaagaaaatttagactcacatcggtatgcagttggaaaagggagaactttgcagactttgaaagacttttaggatccccagagttccttggactgcttaaaaccccagtgcacacttgcccaactgctgccgtaatttatttaaccatcttttgataggcagctagggtatttccagttacttgttgatatgtgtacataaaatgtatttccatatatttatgtgtctgtatgtgtatgatagaatctagactagagctagaggttacgattatctgaaattgtgatagagtttgccaaattgccttccaaaaagactgtatccgtttacattcccactagcaggagagaggagtatccattttctcgcatttcctaacactggatattgtatttttaaaattcttgcctatcttgtggatcaaaaatgttattgttagcctgtcacattggcctgtgtgctcttcctcaaacactctaagcctgctagcacttcatggtcttcactttcattcccactgccggcagtgcccttccctcagagattctttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcctttctttcttcatttttctacatagcacctctccccttcaagtatgctatgtaacttatttattttctttctctccctggaggtatttttatctcttttgttttccagtgcttagaacagtggctggcacatagtagttactcaataaatacttgtagtatgaatgaatgtctccctcacccaattagtaggaattatatatgttcataaactatttctcaaaaaactgtgtgttcttttagttcctcatttcttatctggtatacgtggtacttatttatttagtcagacatacagcaaatatttatagagcacttaatgtttgccaggtactgagcaaggaatcaaggatgcaaatatgaataaaagtacagtctagtaagagaatcagatatgtaaacaactgttgtatgagaaagaattatatggatgtcatataaacatataggcattaaaaaaatgaaaaactttttgtttacacacttctgacaccagatatgtggattttctacactgagcaattctccaattctctggacaccaactggatgtcctacaatttgactcaattcttttttaaattttaattgtaaaatattttttattgagacagggtcttgctctgttgcccaggctggagtgcagtggtgtgatcgtagctcactgcagcctccatcttccaggcttaagcaatcccccgatcctcagtctcctaagtagctgggactacaggtgcacctcaccacacctggcaaagttgctcaggctggtcttgaactcctaagttcaaatgattctccttccttggccttccgaagtgctgggattacaggtgtgagccattatatctggccaatttaagtcatttctgacactacctggagctagcacaggctcccacaggttaagggctgagtatccaaagactgcccctgacttcagtcaccagttgcaagtcccaggttgtgacctgtaacttctgactaagtggctataagttgagggttcccacaattccctcttgaggtttgataattttctagaatggctcacagaactcaggaaaacactctatttactattactggttttattataaaggatatgtggggcaagctaaatgggagagacgcatagggtaaggtataggggaagagtgcagagctttcatgccctctccaggtgcaccaccctcctagtacctccttgtgtttgctaacctggaagctctccaaattccattgttaggggtttttatggagcttcattaggtaggtgtgattgattaaaccattggccattggtgattgcacttaaactccagccccctctcccctacttggaggttgagggatgggactgaaaatcccaacccactaattatgtggttggtttctctggcaatcagcctccatcatccaagagtcacctcattagcataaactcaggtccagctggaaggggcttattacggataacaaaagatgctcttcttaccccctatcactcaggaaattccaagggttttaggagctctgtgacaggaaccagaataaaaaccaaatatattatttcttattatatcgcaaattcacaggcatattcttgagggaacatagaagtaaccagtaacgctgctagtggcaatcatgggaggctttatgcagtagtactcgatgaaggaataaagaggattagattatgctacaggaagtgacagtggggttaggggggacatctcattgtggaagccctcatgaatcaatagaattttaggaaagaaaagactggaacaaaaaaaattttttgagtgcccccacccaccagacaaaaaatttttaaaaatgaattaatgatcttcacagctgctgaagtaaaggtggggatggatctcatttccatggtagattgattgattatgaaaggaagagatgatggtccctattttatcaagaagtggtttgtgttcaaaaaggagttagtagaaagaggggattaaaaatcggagaaagcttaaatatttgaaaatcttgaggatcaatcagttaagatctgtatctttctctgtgtgatgctttaggaacagccagcgaagaagtagtgggaatattaggaactattcaagttaaaaaaacatgttaaaaggcttaacttgaagaaaagcatcaaggagaaaagctggaaggaatgaggaagtgtaggaaagtatcttaacaagtcagaatatctttgacaccaacaaggaaatatggaggaaactggctgtgaaatttataaaaaccaagaactatttcttgtagacaaaatttggcatgaacagtgaaatattaaagcccagagaacaacagtgatttgaaagactgaaatttgtccctgaatcaaatgttgggaattgagatgtttcatcatttgtgttattcaaaagaattttttgattggccccattttttttttttttttttgagatggagtctcagtctgttccccaggctggagtgcagtggtgcgatcttggctcactgcaacctctgcctcccaggttcaagcgattctcctgcctcagcctcccgagtagctgggattacaggcacctgccactatgcccagctaattttttgtatttttagtagagacagggtttcaccatgttggtcaggctggtctcgaactcctgaccttgtgatctgcccacctcagcctcccaaaatgctgggattacaggtgtgagccactgcgcctggcctgttttcagtctttttactgcaaggctatgatcttctctggtccgggagtctgccagaggagcaggaacttcccagttgaaccttattagtaaccacctggaagatatttattgaacaagtgtcacatctgtagtcttgtgtatctagaaaccttaagcatgcattattatgttttaattggaaaatgcataggctttaaaaaaaaagattgtgagctctatctgaacttttgttaagtaccacaaaattaagtttgtcagacaaatagacatttgaatcagagatttccaaagtattttaaatttaggaacctaaactcttttagaacagatcacattaccgagtaaagtgattaatgtggtttcagatgttcagcgtagaactgaatgtttgtgccttattggtatgggccaaatgaaaaaaaaaaaataaaacacacaagtttgccaaatattggtatgccttaaacatttcctgaaggcatttggtgatgaaatataaatatatctaatgtataaagtaagagagttttgtcaaaggtaatatgcagcaaagctgactagtttgaagaggtttgggttactgaatagacgtcacacaggaaaaaaaaataaactaaatggacttataagggttaatttttctgaccttatcgatattttgtggatagtaaagaagtcatctagctatttttggcataggattcaaggagctggcccactctgggtggtctataaatagtaactctaggtagcagggactggctaaacaggacaaatgtgaattggttaaaaagaaaatcctcttcttattactcattggggttaattctatgattattagtcatattttattgttgagaacctgaaatttaacccaggttttttttcttttttttaaattatcactacagactctgccttttctactatgctgtaaagtgttactttattttattttttctaccttaaggttaaggaaccttaaccttttgtttttggcaatatggtaggctaaaggtacaggaaactcattgcagtttagcacactaaaaaatgatggattgaaaaaataaatcaaaactcttatttcctggctccactggagacaaagtaagggcttctcagaggccagaaataataaaagataagatgagtctataatgataagctagcattggaagtggtgcttgttctggatatagttcctgatccttgcggcgtagtgtctggggatgggaaagaaagctgtggacccaagtgaggtgggaagtcacaactgaggcctcccttttcctctacccaaataaagccagaacttccaaagaatgacactcttggttgccaaaagaggggaacaaaagttgccctaccactcagggagactgttattaagtacctatcttggttttggctttagttagagtggaaacaaatgaaaagtctttcctgataattctttactcaaagcccctacctaatcaggttagagcctaaatttatactactagtgtgatccccccaaaatcaagacaaaaatgcagtttaggtgggcttatgttggtggtgcctgtaggcacctgagggaattgaatgcaaattcttctcagaagagacactttataaaagaaagtgtccatcctagaaaaactggagacccatctcatatgcagagacacacacaggctcaaaataaagggatggaggaagatctaccaagcaaatggaaaacaaaaggcaggggttgcaatcctagtctctgataaaacagactttaaaccagcagagatcaaaagagacaaagaaggccattacataatggtaaggggatcaattcaacaagaagagctaactatcgtaaatatatatgcatccaatgcgggagcacccagattcataaagcaagtccttagagacctacaaagagacttagactcccacacaatcataatgggagacttttttttttttttttttttttttttggtgagacggagtctagctttgttgcccaggctggagtgcagtggcgcgatctcagctcactgcaagctccgcctcccgggttcatgcataatgggagactttaacaccccactgtcaacattagacagatcaacgagacagaaagttaacagggatatccaggaattgaactcagctctgcaccaagcagacctaatatacatctacagaactctccaccccaaatcaacagaatatacattcttctcagcaccacatcgcacttattccaaaattgaccacatagttggaagtaaagtagaccaatatccctgatgaacatcgatgaaaaaatcctcaataaaatactggcaaactgaatctagcaacatatcaaaaagcttatccaccatgatcaagtgggcttcatccctgggatgcaaggctggttcaacatacacaaatcaataaatgtaatccagcatataaacagaaccaaagacaaaaaccacataattatctcaatagatgcagaaaaggcctttgacaaaattcaacagcccttcatgctaaaaactctcaataaactaggtattgatggaacatatctcaaaataaaagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtttgcagatgacatgattgtatatttagaaaaccccattatcttagcccaaaatctccttaagctgataagcaacttcagcaaagtctcaggatacaaaatcaatgtgcaaaaatcacaagcattcttatacaccaatagcagacaaacagagagccaaatcatgagtgaactcccattcacaattgcttcaaagagaataaaatacttaggaatccaacttaaagggatgtgaaggacctcttcaaggacaactacaaaccactgctcaatgaaataaaagaggacacaaacaaatggaagaacattccatgctcatggataggaagaatcaatatcgtggaaatggccatactgcccaaggtaatttatagattcaatgccatctccatcaagctaccaatgactttcttcacagaattggaaaaaactactttgaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataataccacacgtctacaaccatctgatctttgacaaacctgacaaaaccaagcaatggggaaaggattccctaagtaataaatggtgctgggaaaactggctagccatatgtagaaagctgaaactggatccgttccttacaccttatacaaaaattaattcaagatggatcaaagacttaaatgttagacctaaaaccataaaaaccctacaagaaaacctaggcaataccattcaggacataggcaagggcaacgacttcatgtctaaaacaccaaaagcaatggcaacaaaagccaaaattgacaaatgggatctaattaaactaaagagcttctgcacagcaaaagaaactaccgtcagagtgaacaggcaacctacagaatgggagaaaatttttgcaatctactcgtctgacaaagggctgatatccagaatctacaaagaactcaaacaaatttacaagaaaaaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttaaaatggcagtcattacaaagtcaggaagcaacaggtgctgtagaggatgtggagaaataggaacacttttacactgttggtgggactgtaaattagttcaaacattgtggaagacagtgtggcaattcctcaaggatctagaactagaaatgccatttgacccagccatcccattactgggtatatacccaaaggattataaatcatgctgctataaagacacatgcacacatatgtttattgtggcactattcacaatagcaaagacttggaaccaacccaaatgtccaacaatgatagactggattaagaaaatgtgtcacatatacaccatggaatactatgcagccataaaaaatgatgagttcatgtcctttgtagggacatggatgaatctggaaaccatcattctcagcaaactatcacaaggacaaaaaaccaaacaccacatgttctcactcataggtgggaactgaacagtgagagcagttggatacaggagggggaacatcacacactggggcctgtggtggggtcgggggaggggggagggatagcattcagagatacacctaatgtaaatggcgagttaatgggtgcagcacaccaatgtggcacatatgtatatatgtaacaaacctgcacgttgtgcacatgtaccctagaacttaaagtataataaaaaaaaaaaaagaaagaaaaatttccagagatacagagccagttgaacatgagcacatgtctgcttctttccctcaaaagtcattaaacacaccaggaaaccataccaccatgaataagagttagaaaaaataaactacagaatcacactctgaaagactatagatatttgaattatcagatagagaatataaaatatattaaaagacagaattaaagtctggtaaaggaacaaaagactaccagaattggccagaacattttgaaaaaaaatctggaaataaaaatttaagttaaaattataaaaacaatgaccaggttaagacagcaaaataggtatacttggaataggaacagctccagtctacagctcccagcgtgagcaatgcagaagatgggtgatttctgcatttccaactgaggtacagggttcatctcactggggagtgccagacagtgggtgcaggacagtgggtgcagcgcaccgtgcatgagctgaagcagggtgaggcattgcctcacccaggaagtgcaaggggtcaggtagttccctttcctagtcaaagaaaggggtgacagacggcacctggaaaatcgggtcactaccaccctaatactgtgctcttccaacgggcttaacaaacagcacacgaggagattatatccagcacctgacttggagggtcctacacccacagagcctcgctcattgctagcacagcagtctgagatcaaactgcaaggcggcagcgaggctgggggaggggcacctgccattgcccaggcttgagcaggtaaacaaagcagctgggaagcttgaactgggtggagcccaccacagctcaaggaggccttcctgcctctgtaggctccacctctaggggcagggcacagacaaacaaaagacagcaataacctctgcagacttaaatgtccctgtctgacagctttgaagagagtagtggttctcccagcatgcagcttgagatctgagaacgggcaggctgcctcctcaagtgggtccctaacccccgagcagcctaactgggaggcaccccccagtaggggcggactgacacctcacacagctgggtactcctctgagacaaaacttccagaggaacgatcaggcagcagcatttgcagttcaccaatatccgctgttctgcagccaccgctgctgatacccaggcaaacagggtctggagtggacctccagtaaactccaacagacctgaagctgagggtcctgactgttagaaggaaaactaacaaacagaaaggacatccacaccaaaaacccatctgtacgtcaccatcatcaaagaccaaagatagataaaaccacaaagatggggaaaaaacagagcagaaaaaccagaaactctaaaaatcagagcgcctctcctcctccaaaggaacgcagctcctcacccgcaacagaacaaagctggacggagaatgactttgacgagttgagagaagaaggcttcagaagatcaaactactccgagctaaaggaggaagttcgaaccaatggcaaaaaagttaaaaactttgaaaaaaaaattagatgaatggataactagaataaccaatgcagagaagtccttaaaggacctgatgtagctgaaaaccatggcacgagaactatgtgacgaatgcacaagcctcagtaaccaatgcgatcaactggaagaaagggtatcagcgatggaagacgaagtgaatgaaatgaagcatgaagagaagtttagagaaaaaagaataaaaagaaacgaacaaagcctccaagaaatatgggactatgtgaaaagaccaaatctacgtctaattggtgcgcctgaaagtgatggggagaatggaaccaagttggaaaacactctgcaggatattatccaggagaacttccccaatctagcaaggcaggccaacattcaaattcaggaaatacagagaacgccacaaagatactcctcgagaagagcaactccaagccacataattgtcagattcaccaaagttgaaatgaaggaaaaagtgttaagggcagccagagagaaaggttgggttacccacaaagggaagtccatcagactaacagctgatctctaggcagaaactctgcaagccagaagagagtgggggccaatattcaacattcctaaagaaaagaattttcaacccagaatttcatatccagccaaactaagcttcataagtgaaggagaaataaaatacttcacagacaagcaaatgctgagagattttgtcaccaccaggcctgccctacaagagctccggaaggaagcactaaacatggaaaggatttataatcccaaaggattataaatcatgctgctataaagacacatgcacacgtatgtttattgcggcactattcacaatagcaaagatttggaaccaacccaaatgtccaacaatgatagactggattaagaaaatgtgacacatatacaccatggaatactatgcagccataaaaaagatgaattcatgtcctttgtagggacatggatgaaactggaaactatcattctcagcaaactattgcaaggataaaaaaccaaacaccgcatgttctcactcataggtgggaattgaacaatgagaacacatggacacagaaaggggaacatcacacactggagactgttgtggtgtggggggaggggggagggatagcattaggagatagacctaatgctaaatgacgagttaatgggtgcagcacaccaacatggcacatgtatacatatgtaacaaacctgcacgttgtgcacatgtaccctaaaacctaaagtataataataataataacaaaacaaaaaaatagatatacttgaagaaagaaatagtgaatgggacgatggatctgaagaaattatatagaatgtaacacagggagacagagagatagaaaatgtgagagatattggacaagaggttatgccaccataactaaggaataaagtaacattcccagtcatgagacatattgacatctgcagctcctgatgggatgcactgagaagggcacagtatcacttctatgatgttcttgtcccaaaaaatgtataacctgaattgtctttaattttattttttatttttatttttagagacaggatcttgctttgttttccaggctggagtgcagcagcatgatcatgactcactgcagtcttgaactcctaggctcaagcctcctgagtagttagtactctagatacacaccaccgtacctggctcatttaaaaaagtttttttgaagtgatgacatcttattatgttgctcaggctggtctcgaatttctgggctcaagtgatgctcctgcctcagcctccttaagtgttgggattgcagatgtcagccagcatgcccagccttactctggaatcttaaaaatattgctaactgagccctacccaagacctatgaagtctgatagggtaggtcaaaggcatttgtttgtaaaccaaacatttttcccaggagattctgaagtatgtctagggttgaaaactgttgtgtgtagttttgtatttctttcttcctatacattgttttgtatagttttgtatttctttcttcctatacattagccactatggaaattgtaaaagcacttattcattagattataagataatgtacgtaagggaagtttttattaaaatgtctctagacagacacctctgtatagataggtttgtctcatatacttgaggacatttatggacctctgttttggacagagtaggggccacagcataatctgtgaagggaacttcttcctggcacataggattgcagattatagattcctttgttatgttttcccctttctattttaaaggtcactatagtcatcctcctttgctgcaaatcataaatgaacatactaaggaggttttaaatatgttttagttaggtcttaaaaaaattaacaaatgtttggaattgacagtgcttttaccctgtttttgttctgggttaatgctgcgccctcactaggtctggaatctttatagtttgagacatcagacttggatgaggaagggtaaatcatgctactagtgggccagttactctgtggttttcttatgagactgtgctttaaggaaaaggtaaccacggagcatatggcattgagtttgagtcatgtggaactggttagaagtaaaatgtttctattccagcattctctgagtttgtcagcttttcattattttataggaagaattctagcttcttatcctgagatgagcttgtctccaaatctggttccaattttttgttgttgttgttgagcacatttcgccatatgatatcactattggctgtaggttaaaagttaccgtgtaacttaaacgtcagaattcaaaccaccaagtatacacggttttgttcagccagatttttaaatgaaatctaatttgagtttttggctaaaagtactttccacatttatcaaagtgacacatgaactgaagaaatacaatgtatctgagtaccaggtgttactgaatctggaattgcaggagggtaacagagccaaaggcagtcctttcctcaaatagtcttaacgtattcatgtttgtcaaaaatgtgtctacacaaagtaattggttctcttttctctgtagatttcatcctttgttgaaaaagatgtcttagaacctatcaagtgcagagctgggttttgagggcatggaaaattctgttgatgcttttctctagttttggctttcatgtgagttgtacatagggaggcttataaggagcatcctagtggctttaccttgtatcacttggctactttttccccacacttcattgttgtaatgaagggaaaggcagctgaaaccagaaacctacatcccttgccaacttaagagataaaaggaaatttatctcttctgctttctacctagtgagaaggggtcggtgagaaactaggccaggtgagaaaactactatcagagtttaagttgagtacttcgatatgttcttcagaccatacatcttagttaacataaaacaaggactagtggatagtttgtgtgaaatagcattttcaaccaccattttcagtacttaatatagctgggtggaatcatgctgtgtaagtgctgcagaacataaataataaaggaaataaacatcttaattttgtaacaagtgaaggtctaggctaatattaagggtagtataggatacttttgaagcttttgaatgtacagaagtacatatgtaattattatatattgcttagacttctaggcagtttgccattcatgtcttttttgtctccagattgagctgttttgtcacattagtgagcatttgaaacataattttaagtgtcattctacaaatggttcttaattgatttatgactaatgtcagtatgaactgcaggtgtgtgccgtgcctttggactttttggtgtctgtgtgttctgaacataaattggccttagtatgttatgcacactgtcagtttatcacaatccatggcctctgaggagccagaagtacggaatgtacagacgatctatgtaccttatattattttctgtctcagccctttcccagaattcccaataaagcagatttctcaattacttgcttttatttttcctttctcccatttttttttttttggtaaattaacaatgagagataaatggaaataaggcagttggaagaaaagaggatgaaaacaggtgaagattcttagttgtggaataagctaggttggctatgggttgataccatgtgtgcttgggtagtaaaggtagctagttttttctgcgtgttgtattaagccattatttatcaaatactaattacgttttatgcactaaatactagtccaagtattctatttgatatatggattaattcatttgttcctcctagtgccatgaggcaggtattattattcctgatttacagatgaggaaaccgaagacacagctaatatgtggcagagatcagaatcacaatctgcctctggagccttggcttaatcactgacagagcaacagccactcaggcagagaaaaaggagttggcatttacagttagaggagttaggactttagtaactctgcccgtttccctaaagcttaggattggctgtgataggggaaagtagcttatgaattgactggattgatgtaagtataacagaaaagagagattgtactcaaatttacagccatgttttttgacatttagaataatcagaggatacttttctgtagtgagaaatatacaaagagttgttcacacacacaccttttatattaaacactgactcagtgatgtcagcaatctaattactatagagtatcagttatctaatactgtggaacaaaccaccccaaaacctaaacgcttaagacaacagcagttattattttggtaaagaaatctgcaaattgggcagagttcaggacagacagttcttctttgcctccgtggagtgttagctggggtggcttaggttggaggacccactttcagattggctcattcacatggccagtaagttggtgacggctttcagctgggacctgagcctgggatgtgggccagggttcttggtttttcttcatttggacctctccacagctgcatgggtttcctcacagtttagtgtctgggttccaagaataagcatcatctattagaatagtgcttgctttataattgcttattgaatgaatgaaagaatctcaggttgttttcttgctcatgttggcccatttggcaaatagccactgtaaagtgcaggtttcttcccagagcacggtaatccctggctctgagaactgctatttagagggttcttttatcttgacttgaaggtctatttcttcatttaaccacatttatgtttctaataaattacccccagttactactaggctgcaaaaatcatctctgaaccattcaataaacagagaaaagaaaacctttttaaaatttggaaactaccttgaaaactccccattttttcctccttttagtctcagttgcattgaaagttaacataatgttctgttcctggatctggaaatggtgtaatagtgacttcaccacctgccattcttgagttgtgggttagtttccctaaaatgtagatcttgacaagaggcagatggtgcatgaagtttatttatttgtttattttttgaaaaaggaatacctcttatgaaccaggaactagaacaccccttagcttacattctaacaagaagagagacaataaacataagtaaaatgagaaaattataaattctttggacaaagggataaagtatagtagggtaaatggttttacatgttgaagggtagttgttgggactgtagttttatttacttatttttaattttttttgaggcaaggtcttgccctgttccccaggctgaagtacagcaatgcaatcacggctcactcagccttgacctcctgagctcaagcgattgttccacctcagcctcctgaggagctgggaccacaggcacactccaccacacccagctaattattgtattatgattattattatcgtagagatgaggtttcactgtgttgcccaggctggtctcaaactgctgggctgaagcagtctgcccaccttggcttcacaaaattccgggattacaggtgtgagccactgttccctgccaggactgtagttttaaatggtgatcactgtaaggcaggtgtttgagccaaggcttaaaggagaggagagggttagccatatggatatctgaggaagaacagcattcttggcagaggaaacagccattgcagggatcctggggtggaaatgtgtcttgcatgttcaaggaaaaacaaggtggctttgctaaagagagagtagtaggagatgatgtcagagaggtgagatacagggagaggtcaattgaggtaagacttctgtcgttttaaagatttgggcttttaccatgatagaaatgggaagccatcagaaggttttgagcagaggtgacataataatctgacctagattttaaaaggatcactttagttactatgttgccactagcctgaacctggtaggcaggaagacaagtgtcctgctctgtgtcatctttgggctttataaaccatgttccatctgttgtctcatttgaatctcaggaaaaccttgtgaaatatttgttatttttcatgttttacatgtgaggaattggaggcttagagaagttgaccaagtatcccagacatactcaagtgagcagtctcagagtaacatcttgaacccagatctcctgtctccaaattttgtgctcattccactatttcacattaaaacctgaagatctccctgctcttttcatcttaacgtaatttcagctttttgtgtgtggctctccaagccacagagcagcagcagcttttgaggataagaagcagtttcttttaaggataagaagcagtatggttcttacctggtaagatggcttgaattcaaaattgacctacttgtaccataagaaagcaggtttgcaaggagtagaatagacttggagatatgccattttttgttcagctacttggtatgaagactgagtatctgaaaccacactgtaaggattaagtggcttcataaataatctaaaacagttgttggcttttagaatttaataaatgaaaaagtaaggtaacaattcttataatactttttccagactttcggggaaattgaaatcatttgtgttttattaatccatgcttttcaggaccaatggcccataatgtgagcaaggtttattggtgtaatgattattttgtggcctaaaactactgtgactctttggactagcatgtttctgatcatagagacagctagagacttcttcttttttcttaatatttgtagcttgttttaaacgtactgagtagaacctgatttaagcaattatacaaagtttggttagattgctttattaatattatgaactagaaacagtcaccaaatgcgcattcattatactaatccttactatgattgagtcatttctttgagttcttggaaatctaatttttctaaaattaacaaaaggggacatttgaatgatgcaaaagcactcatggcaagaatctaaaagttcatataaataataattttctcatactcttttatacatttgaccattacaagatctgtcaaattcctttcaatatttgtgatgtcacagtcgtactaaaacaatcttgaattctggcagcgaaatgaagttcttacctgtctttcagatgttaataaaaataagggaaatacaaacctgtagttattcagatggttaaaattagtttctgtgggtcatttcatagagttcaagtatttaaatgtttttttagctgaattggacaatcaacttgtctgtaatttagcttaagagaaattccattttaagacaaaaaaactacagggaatgtaggccaaaaaataataacaaccaaaaacaaacaagtgaaaaacgttaaaagattcttagcagaatttattaatatattacctcttcaaaatatattctagccaatggatagataataaaattgagacccacagactatttggatcctaaattttgtttcatcatgactcccttgttgaaaatactttattgactctgtgtaatgtaaataagataatttttgtgaagctcattgaatgcgtctgagctccttaactcaaaaaaggctaaaagttactgaaatagctatggttaagggtatattgtcattacaatgtgataatcattaccaaagtgggcacttggaaaaatagtgaccacttatgagccaaaccaatcaacattaaaactgatttccagtaagtacagctgccaagtgattatagagcagcctggatacagatgggatagactacaaggatagttaagctcaaagcatttgcctgttaacagccatgaattgtgaggtgaaatgccagtttacatagtgttagtaaaatcattaaaagaacaatgattagtagaagaattctttacaaaccttaaagtatcaatagttctgaattaattcaatttataaattatccataagtcatacaaatagccactttgtactttttcatgtccctccaaactcccccagtccctatttccaaactgtccacttctgttgaatctattgtaaaaatgtgtaccttttagggaactgagataggaaagatgtgaaaaacaggattagtttagaataatggttctcaaacattggtaaagtcacctagactagtacaaccactgcggaaaacagtgtggagattccttaaagaactaaaagtagaactaccatttgatccagcaattccactactgggtttctacccagaggaaaagaggtcgttaaacaaaaaagatatttgctcatgcatatttatagcagcaaaatttgcaattgcaaaaatgtggaaccaacccaaatgcccatcaatcaacaagtggataaagaaactgtggtatatatatatgatggaatactactcagtcataaaaaggaatgaattaatagcattcgcagcaacctggatgggattggagactattctaagtgaagtaactcaggaatggaaaaccaaacagcgttatattctcactcataagtgggagctaagcttgggatataggtgcaccaaaatatcacagatcaccactaaacaacgtactcatctcaccaaatgccacctgttccccaaaaacctatggaaataaaaaattttaaaaaaagataattattaatccagtttttggtgaatcagtgagtgacagtggttatagtagtggtggtttaaatcaaggaataaatgttttcaaagtgaaaggagcacatcctaccacacagttcaaaaacaatcacaaatatggcaggcttgctgagagctttcatacatcatttattgtcatgcacttgtatgattattgtatactgtacacatttttattttacaatgatttgtattttccaatgcgtttattgcagttcagtgtggtagatggctggagcctatcctggtagctcggcgcacaagtcaagaattaaccctggacagggtgccatccctttgaagggtgcactcacgcatgttccgcacactcattcagactggagccatttagacgtgccagttaacttaacatgcacatctttgagatgtgggaggaaactggagtacccacaggaaactcatgcagacttggggagagtatgcaaactccacacagacagtgaccttggctgggaattgactttttttttgtcatcagtgttatcacaaaatgacattgcatgaaccagcattgtttgaagacttgctgtattctgattttttttatctttcatctttgagtcattagcaccaaatatagttcttggaacataataggtatttactacatgaataaattaatggatgaatcattcattctgggaaatgttgtcaacatagtgcagtgatggaattccaatcctgaatccaaatcctgactttcttagttatttagagcataaacttgggcaaactgtttaaactctttgagcttcaacttcctttgagccttcatttccttagtacatagtaggtactcaaaagtggtagctactgttaaaatatactgtatttgcatcttagaagagcatttaacattcttgtgatatctttatggtcaagatgggaaattttgacctaggtggtatttcagttaattcataagtagataaacctacgtttttacagatttagaaggagctttttattttaataacaactcagtacaggatattgatggcatgctgatactttcttggaagaatttcttttgctaatgaggagcctaaaagttcttgattgattagtaggtaagtgtttttaaaggaattgatataaattattcagctggatcctaaaactcagttacacaaattcagagttgaggtgggataggaagagaagcaaaagtaatggttcaaaatcgatttgtgtgaaaggacttagggttttaattacactgggctcaatataaatagagtgtaatataactgccaggaaagcctatgcgatattagactgcatcagtagaacaacagtgtctagaacaaatggaggaattatccttttccattctgtagtggtcatactacctaagaagtactgtggccaattctggacattacctctgagaagcatgtttataggacagtgatcaaatatgctaaaggaacttcagactatgctgtaaagaggagcatgtgaaagaatcaagaaactataatcttgaaaaagaaagcctggggtaagggggatgttagatgtctttggacattagaagaaggcttacttagacttgttctggatagccacagaatccagaactagtatcaaaaggtggaagtttttttgttttttgttttttaaaaaggaagcacatttctagttaaaacaaggggaaactcttaataattagggtggtagagatactggagggatcagggagtgagtacttccaccaaacaggaacattagtatatggatatttcactaataacaatagcggggtcagtaggggttgaattaattgagattctctaaacttaggggaaagttcttaactttgattttattcatagcttactttcataattagaatttttggcaccatgcttgaaagaaaaagtaaacactttttttttaaagttagtttcctaaagaagaaataaaatttcttagttgtcatcacactcttcatttgacttccctcccaaattgctattgttttctgcttctctcatgttttcttaaatactcatcagggtgacttttcttaagtttagacagacattccactaggtctcttacctcatttgtggcaaggtttatattgatgtgtgactgctcaggtaaacctttagtctgaatgatacagctatgacaaaatatagcctcagttgtagcaaaattaaatgttacacaatggctttaattggtggtacacctttgaagagtttgcagtatgcccaagtgctaaagcataccatgtgagaatcactgggtagcaatgatttctgggggtgaagaattgaggagaatggaaaatatattaagggatcagaaaaatattctagagaggtgtgtctgctccccgttttcccccaacactgatttccccaaatttggagacaaactactattatctcaaagaaccgcttttcctttagaaccacaggctccttaactaccctttttcattagccttactttcctcttgcattttatccctccaaatagaatcttttgtgcttctctagggagattccctttgtgttgaattttatgagtagtgtaaattgtgtgggttgcatcataaaacaaagtgcgaacacacacacaaagtcttattgatgagccaagttcctaagcactattaatgagttaaaagtgttaattaaggctgggcgcagtggcttacatctgtaatcccagcactttgggaggccaaggtgggaggatagctttagctcaggagtttgagactagtctgggcaacatagtgagacctcatttctactaaaattaaaaaaaataaaaattagccagatgtggtggcacatgcctatagtctcagctactcagaggggctgaggtgggaggattgcttgagtccaggaggtcaaggcttcagtgagctgtgattgtgccactgcactccagcctgggtgacagagtgagaccctgtctcaaaaaaaaaaaaaaaaaaaagttaagtaggcagtatttgcttatatgtatatattttgttgttttctccaaatgcttatgcctctgaagaggatatacattgatgagtgaagatattagggagggtagggagaaagaatagaagtttttacatataaatacaaatagaagtatttaaaaaatttttttttcttagctttatctgatagcctgccttctggaattgtgaaaggctaacaatgaatttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaagtttttaaaacatatagaacactactattgtttaaacagtttataaataaggtacttttatacttagaaaaattgtttttgatatgtgcaggttaccatgctaaggatttgaacaccttcagtaccctatttgtacttgcgtctatgcctagcatttttgttacgtgcatggatctgcaaaggaattgtggtttgtttcacagctgcatgtagcaggcatatgtgtgacatatttttatttcagctattatttcctgttttttattttcagcatgttggaacaggattccaggagaatgaaccctagtgtgagccctgcaaatcaaaggaggcaccttctaggattttctgctaaagaggcacaggacacatcagatggtattatccagaaaaacagctacaggtaagatggcatgcatctatcttttggcctaagtgatttaatgaagctgaaacaagagaattatctgtagtataacattgcatctaaattgttcgtgtatattttgagtagtagaacacataaattactgaaaccattaatacattttacttttaatattgtaaaattaaatttactttgaaaccttttgtagttttaaaattcctatagagatgtaatcttaaaatctcagtttgtgtgcattaatatacatattgaaatatatacatattatatataatgtctttaataattattttatctatcatgtgtttatacatataatacatctaatatttgttactgtctcacctgtggatggatatgatatggtggaataacatgattgaacctatttgcagtcattaggtaaaatcatttatactcatttattgtgatctttgttgaatccctcccttgttgcaatttaataatgacttgataaatttccatattgcttgtcaatagcaaaaggctttaattgtataaaaatgcaatttctatattatgttaactagaagaaggtatagtggacatttttatagttgtatactttttgataaacatttccctgtgttatttagaatttgtattagagccaaatggagccaggtccttgactaacaaggcaaagggaggtcacagtatggtaactattgcacagtataatgcttgaaaattattacagatttgtttacttttatctctttaaggatttgtaggttgagggcaatctttcttcctgatttttactgtgttacatccatactgttgaaagatgatcaccacaatcctgcaggcttgtctccacttagccttcctgaaaaaactgttatttttgtggagtacagtatgccaagtcagtggaggacccaaaggattttatggcagtagctgcaacgcaacatagcaatgatagatgtcataatgttggaaaacatagcatttcctgcttttttacatgccaaaattcatcatacttcttaaaatattcaccttgatgatctcttaacggtgcccctgaatattggtagagtttaatagtatatttaattttcataagtaatttgtgcaggtttgccctacgtgttctataattttgaattctgttagtgtccacataagatccatcaaaaattaaatttaaatctaatagcctttggatttacgagagttgagatagcgtcttgctaaagaatagaacaagttatggattgaatgcttgaaattacagttcaggtaagctttacaagaatattatttattctgcactaactgcagcaagtagaagccttccacattagcataagataacatggtggctcccagaaagcatagtagtctgatcatactagttcaaactaaaagtctgaatgactttctggctgaaatttatcagctttcagagtagtacatgggatgcaagctattttttccctcccttctccaaagtcaccattgagtgaataatctgggttactggtcttggggaaaaaaaaaaaccaaaaaacaacccaggaaagattatggattcttgattccatgcaagtcctttgaaatatttttcagcaacttgagagatttaaataaatgtcagtccattaatttgatgttcttgattttatcagtataaatactgaataaaagataccaaaaaatgtttgtgaaacatttgaaagcacctaatattactttgttctgtgttctgaactgaattttagatgttttatctattttcagccgtgatacctatacattttttttaatgcagcttactttatgtttctttttctaaggagagctatgagacatggttcaaataaaaaatgagtagattctaatcccatagtttataatattgtattagcctatcatttagtaattaactgcttatattttttcagtcatagaaatgtgtggcatataaatagtatgaccatataatgttctatcaaactgggacactcttaagaaggaaaggtagtgctagtaataattacatcagaataccagtactgctgtcttggataaatgagaaaggatggtcaccctatataagatgtcacccagaactgatctttactccaagaattctcattaactctagctccctagcactgtcctttactttatttactttaatgatttatttgttgaatttttttctcttggcataaaatgtttgcaagcagactcgaactctgactgttcctgggctaatgttggtctaattgtctccagattgtatgttggctgattttctctctcctttaactccacccaatccttgtcctggtatttctcctatcagactttttttttttttttccaaagaatatttttggctgatagaacaaagccagttagcacagatgtgcagaaatcattactagagttcagatcacaaatatattttcaaaagcagttttggacttttctcatggactacagtgtttgtatttttctaagtatgcaggcatgatttttaaaataatgcgtatgtcatagatttataagaagaggtgttaagcagcctcctcttagaggcattcagatttatcaaacacaagacagatactttttttccttctcactcaatgcttcattttaggctgatccttttgtgtttgcattcattacctgtgcaccaacatgtctgttttattccaaacaacttaaacctacttaacccttacagccacaagagaggacattgagaatattcctggtgcaagttgcagggaagaatgttctatatatcctctgctattgtttcttttctctcgtgtgtggcataaatagctatctctaacttttaacttgaagttagccttccactctgccagagttatttctgttaaggggccagtgctttctgccatcttacttgccctttcctcagcatttggctgtgtgggtcatttgctccttgaaagactttccttttgtgttactatggttttttagtttcctttttttattggctgctgcttcacagtaatctttgtgggctctttttttacccaactctcaaggtttggaactgtaaactttttttattttctttctgcctaggtgactcatctataatttcatgcacagttcatatctatatgtcctgatgactctcaaatttatgttttcagtccagacttctcttctgagtctccagagtcacatatccaatagtctctttgacatctctgttttaacatttcaaacttaacatgtgcactgtggaactcagttcctctccctgttttacttccaaccaattttctacaactgtgttttttcctttccattgcttaagccagaaatcctgattcctgtctttcaacaagtgttgttgatactcttccccaaaattgtcttgaattggtccactcctctccgtctctgctgccacaaacctagtccatgccatcatcagttcttgccaggattgccatagctctttcctaatcagtgtctcagcttccccttttgcctccattgagtccatttttggtaccatggcaaggtatgaatgtaaattgaaatatatcacttctttatttgaaacacttttatgacttcttattacatttagtaattccttattatgacctggtcttttattatgaccttattatgattcctttccagcctcatcctgttccctctctacctccccacttgcttgcaactcttcagccagtggtctttttaaagttctttgagcccacctttcccccacctgcctcttttatgcctagaatgctcttaccccagtttctatagaggcggcgtcttctcatcatttaggccttgatgtaactaccatctccttctcggaccattttatctaaagtatatactaccattgcttttccatttcaaccatttgtttgtttctttcatagcacttactagagttcggattattttatgcatttattttcttctatttggtccatcttccccattaaggtctttggggacagaaactttgattctctcattccctactggattctcagcacctagcacaatacctggtgcacagttggtatgcagcaagtatttgttgaatgaataaatgaaaagtgtgagtctcactatgttcagttttatatgtttacatgttttcttttgagatattagcatatctagttttctaaatccagatcatcctatataaagaaattcaagagagatgcaagctttgttagtgagagagattaagattgcagactgaagagcataaataacagtaatatccccatctcaaattctaactttcaactccagttttgctccctacgtcacaccttggatatgaattcacatgatctacatcagtgcgatggctaggaaagtatatatttttgaagcaaatggagtaactagttaatgtcagtcactctgttgttttattagtgattcacattcttccatgatcccatagtttatattcggcttttcaactctttcacttttctcctgccaagcattttatgtctcaccctatccttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataataccacttgattttcgcctcaattaccccgttactgtgttactacctctgtaccagcagcattgtgcatgtcttaagctcattgaagatatgatgaaccatgtgttattgtatcgcttattccaaattaattgctcaataaatggtgattagacaaatgtgaattaccatcctgtctctgtagaaaatcagaaaatgacatttcatgtaaaataaggttttgtattttatactttatcttgcagtatattctgtttactatatttttgtttccatgaaaagttaacactaatgatgattttcttatagcaaacttcttaggaatttaagatacaaggaaacaaattttgtgcatccatgtttcagatatgatcattctgtttcaaatgacaaagccctgatggtgctaactgaagaaccattgctttacattcctccacctccttgtcagcccctaattaacacaacagagtctctcaggtgagtgttgtagattattgcagaaacatctgagttggttcccatgtttagttttggaacctagacaagtaattggtcaagttcactaagtgactgagagaatctctgaattatttgtggataactgtaggcatattagttgtccagtttctccaccaacctcatggagatggtgatgggtctattttatgtgatagttgcttacttaaatatgtcttctttaaaaactacagaatgaaattaatattaaaatttcatggtgttaggcttacagttggtaacattcatagcagaaagtacctttttcttccaattaggaagataataatttgtgggtatgtgattctggagatactttaccgttagtacacacttctttatcaatttttcccttgaatttttttttcctgtgattttggaccttacccttaaaacctcaaaaactacctcagattttttgtgatatgtagtaatcaactacagttaaacatagtttaacatcttcacagctgctgtaaaaagtaagcaaaataagggaagttatatatgagctatgcttttatttcgtgtgttgaaaaatttgaatttttttttaccccaggcaattgagttcattctttttcttctcccaaaagagcatgattttcaagaggttttaatgcatctatttgttgttaggggtcctatgacttgttaagttctctacaatgtgtctcaaatgtttgtgtttatatagcccaagaacagaaataggaaatactttttattttgttttgttttattttattttatttttagacagggtcttgctctgttgctcaggctggtgtgcagtggctggatcatagctcaccgcttccccaaactcccaggctcaagtgatcctcttgccttcgcctcctgagtagctgggactacaggcacatgccaccatgcccagttaattttttaaaaaaattttctgtagagacagggtctcactgtgttgcgcaggctgatctcaaactcctgggctcaagcagtcttcccaccccagcctcccaaagtgctaggattacaggtgtaagccactgtgcctggcaaggaaatactttttttggtggaaaaaccttagcatccagtgtttatatttgggaggtatttagctgtagttttctttgaagtttgaatgcatggttgacaggtttaccatgtaaaaatgcatgtcttattaaaaacaacgttaagtgtcaactttttcaaatcaaaaagcaatattgagtcatcaggcacttggaatgctctttggaacctacaaatgattagattcatttccacccacagggtgaaacatccatttctatgtttaattaatttctatgtttaattaattaaactatattttataggttaaatcatgaacttcgaggatgggttcatagacatgaagtagaaaggaccaagtcaagaagaatgacaaataatcaacagaaaacccgtattcttcaggtatgtttctgtttgtctttgaacaatagttggcgtatttgttggaaggcttctcccagctgggttactctcttccctagaaggttggtaaacttgagctttagcctcttcccactgtctcctgctgcttccgatgcagctatcattgccactgaagtcctcctcccaggttttatagcactagtttaggttttatagtattagtagttccctgatcaggcatcgtgctatttcttgctctcaccttcaaatttgctttcaagccaggagttcctatgcatggatatctatatcaaatgtctttgtcacaatggtataataaataatactgcttatctcctcttttcttagagcttttcaaaaagagaatgttaagacctggggcagtttggaaatgaagacatccatttctgaacttagacatttactactatggtttaatgacaggtcttacttagaatctgttaagtgggggttccatctcaatgttgtttgccacaaaacaccattaagtcattccgtcattcatcaaatatttgttgttagaatttagactagcaactggcatctgcaagttcccaataatgagccaaggactgttcttgatcctgaaataaagtaatgggtatgataaagtccctaccttaatggagcttacactctagtgcagagctaaacaataagcaaataaataaatacacaaatacactgaaaattagagctaagttctctaaagaaacacaaagcagcataggaggttagaatttgaattgagaaatgagtgactagactgagtggtcagggaaggcttctctgaagaagttccactttaagacaacattgttaaggtaattaatgctagctgttataacagccccaaaatctcagtagcttaatggaataaaattttttcacttgcacaaaatttgacttcactttctaggattgcttttctccaagcagggagtaagggatccaggttccttctattgtgtagccccaacaacttgaaattctttgcttcttgcttgagatgttagggaagaaagagtttggtggattgtgcaaaatgttttaagaatcaggcctggcttttagccaatgtttagttggctaaaactctgtcactttgcccaaactactgttagaaagactgggatcatgtatctttctgtgtgctcgagaagaagacaagggtttggtgagaacattgcttttgccataggcagaaaagtcactgaaataacaatgtaaagatttaggggaggctgggcgtggtggctcacgcctgtaatcccagcactttgggaagctgaggctggtggatcacgaggtcaggagatcaagaccatcctggctaacacagtgaaaccccatctctactaaaaaatacaaaaagttagccaggcgtggtggcgggtgcctgtagtcccagctacttgggaggctgaggcaggagaatggcatgaacttgggagacggagcttggagtgagccgagatcacgcagtccagcctgggtgacaaagcgagactccgtctaaaaaagaaaaaaaaaaagatttaggggaaaatctggagaaagagcttccagacagagggaacagcaaatgtaaagaccctcaggaaggaacatgaagaagctgagtacgactggaatgcaggggctgaggggagagtggtagatgagattggagaggcagcagatgtaggctcatagcaaacttcataggctttgatgagaactttgggtttcatcatgggtttgaggggatgccattgaaaggtttgagtaggggagtgacttgatatgatttatattttaaaaaattagtagttgctacataaagtggaccatggtggggagtatgactggaagtagggagacaagaagccattttagtgggctaggtgagagaaattgttgtggtccatactggtgtggtagtcgtgaaggtggcagaaagtacctggatgccaaatatattttgaaagtaaagctgatggaaattgttgatataatgataaatcctatgcttaggtactggatgattggtgataccatttactgagaccagtactggggaaggagcagttagaggtggaagtcaagaattttaagtatgttaagtttgttatggctattaggcattcaagtggagaagtcaagtggacaatcaaatatctgggtctggagtttaggagagaggttgaaactggaagtttaatttgtggtgctactagctagagagaaataaagaggaaagaaaacagagtgaggtaccaagttctgggccatctccaacattacaggttgaaagagaaagaggaaccagtacttgaaaaggaagaagagtagctggccagtaaaataggagaaattgtagggatagtggtgtcccaaaattcaagcaaagaaagtttttaaagaaggggatgtaacagttaattacaggggctaagagagctaagagatgctgattcagataaagagtgagaaattacttttggaattgaccatcagaacttgttagtgaccttcgtgaaagttctttcattggagtggtgatggcaaaagccaactgaagtggattcagggaagtaataatagagggggaagtgaagaaaattatttcagggtgatccctatacatgggaatagagaaatggagtagctacaggagtcaagaaagagttttatttttggatgggaaatatttcaccaggtttacatgtttacatgctaatggaaacatcttaaactatttaattatttcctgactaattggaagcagtatgtgttatgttctaaagtacattaaaaggataacaagaaacatgggtttttaaccattatggaactgttttcatacataaaatgagggctagtctaggtgagctcaaactctgacattctgaaattctgtaattatctactgtgtgcttctcttggcctctccaacttttttcacctactatagtaggcaactttattggttgttaatactaatagaggctgcagacagtcattaacaatgtcacatgtaccccaaagtcccaaagctgcttattggcattggtatgtggagcctagtacttcaaaaattcatgtctgccaaagcctacacgtcagctgctaccatggtcagaggaaaaatggaccctctctcccttctgctttccacatctgaagcaagtgcatcttattggcagaatctaaattatatccagagctctggtggcaaaatagtttgagcgatataggtttcaggcttccatcctttgctacacagaggaagagcacaggagtcaggaatagatcattgccagtaggtaatcccacacagctagtataattaacttaatgaaaaattagattaaaattcttgccctaaatgctttttttttggccttatcattagatggaacttgtcatgtttttctttcctagtcattaaatgaatagagcatttactgtggaaggggtgcttggtattctttattcttaaaggaattccaatgcaagaaaaagaattttgttttaattttactgtctttgttcatttggagatgtgtagtttaaagtcttatttcattctgtgctattttgggtacacttctttctgtagggagcttagatatgctcagaaatgtgagaatcttagctactatagaagggaatgatggggaagaatctgtatttgtcagtagtatttgtcagtagtaaagaagttcctggttagaggaaggagaagaattattctgcttttatgctgttgtcaatgccaaagcatatcaagattttaaaaaaattctgtttcttggtgtaaagagcctgtaactgctctcctttttcttttctcatttcaacctttttttcttccggttacctctttcagttgctaagagtatcccaaactcttataaaatattctgtaattttagtgaactgacatttctttgaaatatctgttgtatttaagcattatgtcttataaaatattctgtaattttagtgaactgatttctttgaaatatctgttgtatctaagcattatgtctttgatttgacttgtcctgtttcatagttctaccctcttcctagactttgagtttttagagaaggtaaaggggaaaattaatgaaatatctttcaaaatgaaggcaaaataaggacattttcacatagagaaaaccaagggaatttgtctccagaagacctgtgctataagaaatgctaaagatattttttaaaagacttgggtaaatgataccagatagaaccccagattagcaggaaggaagagcatcagaatgggcaaatatttgggtaaaaagaacaggactttttaaaaagaaactatatttatcttatgtgtgtgtatttaaatgtctttaaaagactattgtctttttaaagcaataataatggcaatttattatggggtttacagcttatatagaagtaaaatataagacaataagaacacaagggggggagggataaatggaataatactcttaataaaatttttatgttgttcgaataatatttcaagattgactgcagtaactgatatcaaagtataatctctagagcaactactaaaagctaacataaagaagtacagctagagccaggcacggtggcttgtgcctataatctcagctactagggaggctgtggcaggaagattgcttgagtccaggagtttgagaagctgcggtgagctgtgatcacatcattgctctcctgcctgggcaacaaagcaagaccctgtgtcttaaaaagaaaagaaaaaatatagctaaaaagacaatgtaagaaataaaaatggaatactaaaaaatatgcagttcagtgaaaagaagacaggaaaagagaaacacataaagaacaaatagaataaattaaaaatgcataccaagatggtagacttaaatccaaccatattagtagttaaattcagtgggctaaacacatcaattaaaaggaagaaattttcaaactagatttttttaaaaaggaaagatccaactatatattgtttataagaaataacactttaaatatgaagacactgacagatggaaaataaaggtgaaaaaggatgtatgccatgcaaacatgaagcattaaaaagctgacatggctatattaatcagaaaaagtagacttccaaacaaagattattctaagagacaacaaaagaaattttttattgataaaaggagcatacaaggaagataaaacaattctaaatgtctaggcccctaataacaaagcttcaacgtacacaaagcaaaaagtgacagaacttgagaaaaagatctacagcataactggagattttaacatcctctcatttctgtgtaaatgcctctcacatttttgtcaattatgatcttttgctaaacccatacagctgaaaatgcaaaagctcatgactagtttttcagaggttccttagttaattggtataaatcttggataggtaaacggaatatctgttttctgtttgcctgatatctctgtaacttggcttttcctaaggcctacccattgctttctgagactagggaaataagtctggcttctttcaaacttctttgctcatttcatatgggccaaagtagcactaatcatttaaaattcaccagttaatctgttcattttcaaccttatatttatcaactagctataatttagttttggttttatttactacttactggataactatgccagtaagtatagtattttattatttaactgtgttcttcttttcattttattggtgatttttttcatttgttgttaaacagagcatttattgaacacctacaatatacaagacccacattagatttttataaaatgagatccttgacttgttacagagccagaagtgggaacccctatattcatctctgcatattggttccatccaccaaacaaaattgtttccttttcttttctcccttaaacttctgtacatgcttctgttttagcgcttatcgcattgtattgttttcctatatctgtcttcccagttaaactgcgagcttcttaaaggcagaagtcaaatatttaattttgtagcttgggcacatgtaggtgctttgattactgaaagatggatatatggacacagtaatgaacaaatgattaaaaaattatttaaaccattgtttgacagggtaagattactttctaatgaaatagaacttggtaatatgcccttgaagtctgataccctgacaaaccgcttctgaaaatcagcttacataactaccagggagaataaaaaggcatagtgcaaagcaaatgctgtgtgaaagacaggtttccagtgtagcatatgtgggccactaatgggtgtagattgaactgttctcttgccaagagtcatcaataagaactctttaatgatggcttagttcatagatgtattttggcatgaagatctctgtgtttaactcagtaaacaataggatctagtttcattatggacttttcatacttcttaggaacttgtcattgggaagataattattttagacaagcagacattgttatatgttcagtaacacttatatagcttggtcataaaatttgtggtgcttggactagcttttgggctctttctttaaacttaatggaaagtgccttaaatgccttaatctccataagacacttctcccagactagaatggacctaaagagttctaatatctgtcagtgtttaattatttgaactgaatatgtcagaaatcttagcaatggaagtttaacaaatttaagtatagaatgaaccagtataggaagatttcatataattttgtgatacagtattaaactttttttttttttaatattccagggtgctctggaacagggctcaaattctcagctgatggctgttcaatacacagaaaccactagtagtatcaggtaagacagtgcagaagctcttggccaaggaatttaaaatagctggtattttaagaaagttgaaattcacacttccctttcaccttaaatttgttctcatctatgagttttatattagtcatatactctaagatatatatatatatgtatatatatatataacatactactgagcagttggaataaagccagataatttcaaaagttcaactctcccaaatcccttaaatacaaatttagtcagaatgctgttccatcataattttgatgaaaatcttgaatacccatagctttcttgcccttgatttgcatctgtttcatgaacctagggaagggaatgttattttttgagtgctctgtaccaggtgtcctgctgagtgttttacatgtattttatctttaaatccatgtaataactaaaagtttattttatatatagaaaaactggtcaaatcatttattttttttgtaattttcagagtcataagacctagtggtagactcagaattcagatcatagctgttttacttacaatgcatttttcactacacaataatacttaagattttgaaagatttcaaagagaatgctgtatctacaggtttaaatgtcttcaaagggaaatataatatgggaagcaatatggtgtcatggttaagatgctagctttatttgccctgttgggcagagttcaaattataactctacctcttactttgtgggctcaagcagattacatgcaattgaagttttctcatctacaaaatgctggctgcacagagttgatataatggttaaattagataatatatttagagcacttagcatggtacataagtgccccccaaaatggtaaatgataatgatgtgatgtcattgacaacagtatcactgaagtgaaatttgaggatctcagcttctatctgtagctctaccacacatttgcagttcacttatatgaatttaacatttacttagaatatactgtgtgccagtgttctaggcactgagaaaaaaatatagatagatagatagatagtaaaaatgaagtcaaaagctattttattcattatactaataactgagaattcctattaaatgacaatgagcagcatatcagcaatcatgaatgtttaaaatcctgagattgtattatcctgttgaaattgataattcaaatatgtttaaataataactaatcattctctgctaaccagaatatatcattcaattacatttattttaaaaatatatcaatttttggatgcatggttataatggcatggtatttcttcattagttaaaatgttttagtgaattacagccaattttcattatttgtggattccatatttgctaattcacctactaaaatctgctaaaatgtatttgtaacccctaatattagcagtgcttttgtcatcatttgcaaacatgcgtagatgctccctggtgaggttgaacaaggcagtgttctgccttttagtctcagctatataaacaaggtccttttcacagtccacatttttcatatttttgtgctttttgttggtaattttgctgtttgaaatggccccgaggcatattgctgaattgctgtctagtgttgctaagccgaagcgggctgtgatgtgctgtgtggagaaactacgtatgttagataagtttcattcaggcatgatttatagtgcagttggctgtgagttcaagttagtgaatgaataatatatgttaaagaaggtatctctaaacagaaacacataaataaggttatatatttatcacttaacagaaatattgtaaccagaggcttgcaggaacctaaccctgtatttcccccaggaggatggtttaggattcactaattcattgctggcagtgactttttagaacataactatcacaaaatagcaagaagcgactatatattcaaaatattgtaatcagaaatggcctagtgaacaaatggagttatttcaaaggaaattcttatgactcatttattacttccatttaggtcagtctttttctcctcttaataatatttgattgatacatacaagttttctctttgaggaaaaatgaagcatttttacaggatccctttaactcttccagatattggtcctaaaccctagaaaatcctgaacacattaagaactctattagaatcatttgactgtattttttggggcatgatgtggtttgaggtattatcattttagtttttaattttagtaaggcacatacatggtacttttaatatcaatgactagcagttgttgagtgactcctatgggacaggatccatgcttggcacttgacatataacatctccagtaacagtcctacaagggttgtgtggttatactctttttattgaggaggaaacagtttgttcatggagggcaatttccccaggagtgcccacttgagaagtgaagcaggaattctaaaccaagtctgcttgttttcaagtcctaagctttttccacctttttgcacagcctcgtaggcaagcataccttcatatattcgacagggtggtgaaaaatgacttttcctcagatttaatttgtattactaaaaaaattaaaaatcgttcaaacctatgcagaaatctctctattttctgatactttcattatttttacatgctttgcaatgtacttgaccatctagtacattttagagccttgattcagaaatcagaattttagcataagtgaatgggttcttataaaatatcctgatccttgggctttacaaaatattgttataaaaattactgccaaagtgcaactaatattttggttgagagagattcttagaattcagacatagccttagaatgggaagtattttgggaaaacaggaaactttttattttagtaataccttatatttttcttactttagcaggaactcagggagtgagctacaagtgtattatgcttcacccagaagttatcaagacttttttgaagccatccgcagaaggggagacacattttatgttgtgtcatttcgaagggtaagttcatcttgaaagaatagagcaaatatttttgagtgcttgccgtacacaagacattgggctgaatattgtggaaaatacaaagatgtgagaaataggaagcaatataaaataaattatgtgagtggaacagtctaagtactgtaatatatgctttactttgagctgttgagtattataaagatgaacatggaattggtgtcagactatgagtttgtatttaggaaatataaactacttgttgatttttattgtttgtaatcctgatagccatgctgtttataaaaaaaggaaaagtaaaaacataaaaatattctatttaggcttttcctatttaggcttttaaaccaattcccatttggttattgagaaacagacttctgaaatgtaggtttgagatggatcatgggctgattattaattgtggaatgtttggatctatgttcctaagaatctctattcctcttttatctcttcttaattaaacatttggttggtgaagaatgtgttagataatcagttagcttatgtaaaagtaaatgtttatactagcacttttgaatgttatgaatgttaggctaaatggaaaaaatgcatagctgtttatatttcatctactttttctataaaatgaaaatattttcttcatagaattgccatgtgaatatctctgttagagtgctgtaggttaacccaggagcacatgaatgaattagaattcctcagtggtggtttctatcccaagctgttttttctttctttctctctgtttttaaacaagagaagggacctcactgtgttgcccaggctggactcaaacccctgggctcaagtgatactgagtagctggctttcttttttttttttaagaatacactgggtatggttagaagtaagtacagttgacccttgaacaacacaagtttgaatgaagcaggtccatttatatgtggatttttctcaaccttagcaggatgccaaacccacttatatgcagggccaacttttcacacatgtagattccacagagctaactgtgggacttgagtatgtacagatttggagttatacaggcggctctgtaaccagtcctccacatatacagagggatgagtgtctatactaacaatagaatgagcaaattcattctctgattattaccactcactgtcactgaaattctcagttaactagttaattcttttcctaaggtataaatatctagcagctcaggtttttaggaccagagaactttgatacttgaaaactagggagatcaaacatcttatatattttcagttattaatcaaacatgctaagagatttggaacactttagccatagcgtctcatgatcactgccttttcacaaaattccctgtgttcaccttactctatcagacataactggtatgtttctgtacaggaccagcctcaaagtttcttttcagcagcaagggggcagctgagaacaatgtttcctgcaaggctccaactgtactggtctatgaaaacaaagtatttcccttactattgacacaattatgttcaaagtaggagaaaaaaagtaaacttttaagaagattcagtactatgaagaagaaacctgctgggtgttaaaatgattgtgttgaagtatattttatggaagttactgtaggagaatgtttttaacactcaaatagacagtttttctgaggttcaggataattactgtattatttgatcaaaacagtataacagatattagaagtaacacttgtcaagccatggattgaagtcatggttagtaatgtttttctaagggaagagaacaagtattttttatagagaagacaatcctagcttttttttttttcttttgagatggattctctctctgttgcccaggctggagtgcagtggtgccatcttggcttactacaacctccacctcccaggttcaagtgattctcttgcctcagcctcctgaatagctgggactatagccgcatgccaccatgcctggctaatttttgtgtttttagtagagacggggtttcaccatgttggccaggatggtctccatctcctgaccttgtgatccacccgcctcggcctcccagagtgctggaattacaggcatgagccaccgcgcccaaccaatcctagctttaaacagactgtatttttataaaagacagtgaatggcggtttaaaaaatatatatgcattgcatttttttgcatttgtaaaaagtgatttctcattagtttgctataaaagtgctgttagaaaattattgatttccactcctccctagtcccttgatgttcattcaggaagactgttaggactggctctcacacaattactattaggagtatgtctaacattctgtttcgatttttcattttcaaattactgatttatcacattttggtgttttatatcaaggaagagtaaagacaaatgaactgaattagataatagtaattaagataacatcctttttattttttttgttttgtttcaatagtagggaaaaggaagttaattttatcttgatgactgtaaactatgttatgggacaggaattttgttctttaatacctggattgttctttttgctcttgctgaaatgaaaatgaaataataaattacctcatgcttggtcttctttcatctttcaatataaaatattctaacagtttcattaaaaaggtgagtggcatcatttcttgtgcagaaggatgtagactttttctcccacttaggttcttaattttattggcagaaattattataattgatactacattggaaattcagaagaagattccagagccccaggtttcggcttagcatgaaccagacatttataacaaagccaataagcaagctatgttattttattttatgaatggacatgtatttaacaaaatattttaatatctaaagatgtagaagtagccattgactgtttcgtactgttatttaagccactctctcccaaacttacactccctcacaccctgcattcctgtaccttttaatctctttacagttgagcggttgaaattattttctctaaagcagacacactcttggataactactgagttcctgttatagctcagcaagaaaaaatgcttatgatcccagtactccagacaaaggtccaaagtgcttctgttcttttgactctccttaaagagtttttaccaccaacatagtaatctattcggctttctttgcttagttccagttatttgtagcttattttcctgtaaatactttgcctttttctcctctctttgatttgtttgttttagtatgatttggagagggaggttggagaataactttttctcaaacttccaagtcactttgagtgtagaataactgatacattaataagaaaaaaatccaattaagtttaatgccttttttgtttgtttgtttgtttgttttaagagacaaggtctctgttgcccaggatggagtgcagtggtacaattatagttcacttcagcctccaactcctgagctcaaacagttctcctgtgtcagtctccagagtatctgggactacaggagagtgccaccacatccagctaatttttatttattttttgtagagatggggtctcactttgttgcccaggcttgtcttgaactcctggactcaataatgcttattttaaaaatacttttgtggccaggcgcggtgactcacgcctgtaatcccagcacgttgggaggccgaggcgggtggatcacgaggtcaggagattgagaccatcctggctaacacggtgaaaccccgtctctactaaaaatacaaaaaaattagccgggcgtggtggtgggcacctgtagtcccagctactcaggaggctgaggcgggagaatggcgtgaacctgggagacggagcttgcagtgagccgagatcgcgccactgcactccagcctgggtgacagagtgagactccatctcaaaaaaaaaatgcttttgtatgatagtctatttagggagggagggaggaggttgattaaataatataacaaaattaattcaagagctaagacagaaacaaatactcaggaaagctcaaataaagttaagaagaagatgattttaaaagggcagaaaagaaacattgagaagaaagattgggaaatgatattaatttattatttcaatacacatttaaataccatccttacatgtagctgtctcatccactaatatataaggaaagaatttcttcctggggcagtttttcattaaaaacaggttctctttgaatcagatggctgtgaatgtcagtttgccatattatctctacttgtttaatatttttcttttgcaaatgagatggatgcctactttgggaacattttttatttctattacattttctgttttcagtacctgtctcaaattgtaagtaaacacgtaaagtgtcttttcatcagtttcaaatacatacataatattacagaagaatctgagctatagccatatgactgcctgagagatgtctctttctcctctctttccaagtattttatatattctagcaatagtaccatatttgggtatgcaccccttactggtcccttataaaaattattaacactgtcatatatacggcatggattataagggtagccttaagtaatagggacttattgtaagttatgtgagattaaagaagcacaggaaactggctcagaatccaaataatccctctgtgcttgtgcttcattgggtggaatgtatactagtcttcatggagaattggaatagtggtttattgtcatttctgatttgacagcagctccagtgattccactttagtcttttttttacactttactgattcatactcctcaaacacaaagatctgattgggtagttctggtcaccatctcttacgcagagaattactatggcagctttggcttatgatccacagttattcatttgtgacaagagaaaaacctggggccactcttctgagaaaatgactttggcaggcactgggagcttcataaactactataccacacagcctgttttttttaattattattcttttttccccgttcttagtaagtgtgcattaaattctttcttgtattggttcctaattgtttgatctaaaaggcccatcttctcatctatatgataagccttttgaaggcaggaaatatcgtatgcttttgtgactacccctgacactcagcaatgcctaccactgagtgcttactgaacagaatggttttagacatgagccattgagagaagtcacagtgatggaagtttgttgtttttcataatcatttaaaaggtttttttttttacattgttttgcttaaagaaattggaatctattttactgatctaagaagtaatataagctgtgctgaatgccagtagaaagtttagttaaagatgatctctgttttgtccatttatgatttgcactagccagatatcatcagcttattcttgtctctgaatctaagctgtagagctaaataattcacctgagtgtagtgtttaacagctttctatgtcagtaagtagaactttgagatacttgcatcttcatttaaaattatttgttggcagcattttggagtagattgttgttagacctcactgatttcttttttggagaagggatgggttctactatttgtacagattcaagcagtaggagccagaaacttgaaactttggaaacactgtaggaaatactgtgattattgcaaaaaaaaaggttgactagtggtgttatttgttcaaaatgtttgccagaggtttagtcccacggatgggcataaaaacgaatttcaaaaatagcaatgatattttctaacttaatacctagattaatacctaacacatgaagaatggcatattttcttaatgcctgttatttatttcttagaaatttatgtttagtttatatgcatatataaaaattcaacatatgtatatatataaaaattcaattgtatgtatatatataaaatcttcagaggcaggaggaatttctttagtatcaaaggaaattcatttataaagtctacttcaaaagggtacagctccttcttttgtttctgagacctcaaaacttgagtgtacacatagatgttggagtttggccattttcttatctccactttcatggcctttgagccaaattctagctggaaaaaaaagtgaatagatgagtttggaaagatacttgcattttagaaaagggtcttatctcagaagagagatgttttaaaaaaccttcttttagaaggctttttaaaattaatttttagctttaaaatatattctcattcaggtctaaagcacattataaaaaaatagagcagagttgactgagtaccctaggttaataaacttaacctagatttatttaatcattatgccaataatgttctttttatatgtccattttctatttcactttattatatacaaatattaacacttcaatgtatactacctttgtagtttacaaacctctttcacatacataatcttagcaattccttacatataatcacaagtattcttagtcctattttatggctgaaaaagctgaagcaaagagagattaagtagcttatctaaggacacaaaaatggtaagcattagaactagggcaataattgatagattctaatttaatacagtgatttttttttctttacattgttgtgcttttttctttatatctggcacttttagatgtattacagcatatgtaaataaattaatctaaccctccaaaatcaagatatttcattgaaaaatctgctggacagttttggcagattcattacacaacttcaaaaattgtttgtttgttaattacctgattatgtttgtttgttaattacctgttaattataattatagattaagtactttaatagattatgctttcataatgctggagaataacttaatggtttgaaatattatagtatagcttcagatttcaagtcagggaatagaataaataggccttgaaagtttctggtttctttttaaaacagtgtctgaaatttccaacatggtggaaaagaaatgtctttgctttgtcttaaaaaggaagtagtttagcaaaaacagaagctgttttaattattggtattctagagcttctcatagaaaagagtggggtttttgtgtgtgtaaatacattttattatggattctgtatatggcgtgctagatctttgagatcagaagcatttgatctcaaactccttgttaaatgtgagttactgttgtgtggttttagaggattcaactatttgttctttgtctctataacattgctagctaacataaaaacatgttttttacttacacttttcaatcacaaagtctaaaataacttgctttatgtttgagaaaagattgttcagtagtctgtaagtagacttgtatatagccacaaacagagaacttataactcaagaataatacgaagtcttcaaaattctcagaatggtgggcagatccatctgagtcatgataatttttcaatggttcttatttgtttgctctatttggtagtcttattattatgaaatgtgtttttcatatgcatttgtttaatctccccttttcaggttgtatgctttctctgtgcagggataaagtctattcattctgttttgtcttttacaagatctattgcaatgcattgcaggctcggcagagtaagtcctaaataaatgttgactactcagaccactaactgtttatttgtgttgtttacccttattttttatgtcctactcttcaaaagattactagaggtggggtttgcagaaacaaaggaggacatttttctcaatgaatgtttaaaattacttcggtgacttggatagcaatgaaatttttaagaatatatagtcagctttggtgtgggtggactttttgctgtggaatagaataattcctgaaagacttctaaagttactttgaaaaaaggcaggaattagggtgggaggtgggagaggagcagaaaaaataactattgagtaaccaggcttactatctgggtgaccaaataatccatacaacaaacccccgtgacatgagtttacctataaaacaaacatgcacatgtacccctgaacttaaaataaaagttaaaaaagaagaaaggtaggatttaatgattgatagcttaaagttctcatcaaattttttgtaatgagggaagaaaatatttccccaaagcagaactgcattcccagaaagaacatttcttcacatcatgaatatgtgaggaaaaaatgtattttaaacaactgataggtacagaccctaggaacctgcattctagccccaatgttgccactcagtgacatctgctatgtgactttagacaaatcacttagtccctctcatcttcagtttccttatatgttaagtgataaagttaatgtagatttgcttttttccttctggctccagaaatctatagtttttatctgtgtgtttgtgtgtgtgtgtgctttcctcttagaaagctgtagtattgctttaaactctttgaagttactaagtgattcaatctagtggagtcagtgtattttaagagttttgaaaaacagccataacaaaaacaacaaaatgtgaagttacaaggtggggctataaattaatgagtttgttttttgaatagctggcagttttgtaatttatttaataacacttatacagaacacaatacgataatctttaatctttataattgagataggtgcagttatcatcattttacagatgaagaacctgaggcagtcgtgtccattgtgaactccaataagaaagattaaaaagaaggaagaaaaagtccgctgtagaaatgaaaaaacaaatttatccattgtgacatcgtttagaaatagcagtcagaatttaaccaagaaagtctggctctatgttcttgatcatttccctctattgcctgtttaagatatccaaatatcatatctttgaaggtagtcaacttggagtttaattccgttgatctctcttttcaaaacatattttgagttgtttcgggatcattttccagagactaagacaaagccctgtggaaaaccaagccacatgttactcaaagtaatagtgtaggaggaacaagagccagcagggaaacacagaggaaattattagaaatataggagaattggaagagtacagatgaaggaaaataaatcaacttgtttatgttattttaaaacctagaggtcaaggaagagttcagaaaacgaggctgtcagtggtatcagatgttatagcgctccctaagaatgagaaatgaaagaaactcatttgtcttgtgtaaacattaaaatcattggtaacttgagattacatttattgtagagtaatcagaacagaatccagaaaagagatagaagagaatgggaaagaaaaacaatggtttggtaaatctgacactggaaggaaatggagatagcctagatatagataaggagaagagaactaagagtgtgtatgtatgtgtttgtgttaaggacaggagagatatagggatagggtataaggtaaataaggactattgtagttagtttatatacatataagaatagagtttatgttttatgcttgacagatgttctaaaggaaaataaacaagtcattgttcctcctctgtattgttttctgtttaaagtaaaagcatggagaaagttgaacagtttttgtttatttgcagtaggactacagaaaagaaaaataaaagagcgtatggaattaaaaccagatttttgaaaaatcaaatcatatttaaagtactgcttgagatatcaaaagtcttttaaatcttaaatacagagctggtttttaataatggtaaagagttttcaaaatgttaaagtttatagaactatttctcatttaattatatgtaaatggttttataattttttctcacattaagttagaaaactagcaaagtaacctacataaaatttggtataacctttcttatgatgtcacaaaacttaattatggaggaagcaattattataattaggaaaaattgatgacttatgatctgactcaggatcaaggtctgaaacactcatgtcatttcctcccctctcctatatagtatacagtgatttgttcattttggactcttaatattttaacttttgacaccatcagcaaatctaaacactgacagttggtgttttcctgaaaaatgttaaggctaataattgtgtgatatttatttcaacacattgctgctagtcttctataaagatctcattatgggtaggctttgaagagatatccagttcataatatgggcatcacactggaagcctgcaagatggatgattggctgagagtaggagtgtagtttctaaataataataagtctgtttcccctgctaggaagtaccctgagggcaggaaccctctatcttagtcatgactttgttcccaatacatggtatatcaggcatgtagcaggtattcaataaacattgaatgaataaatgaacaaattaattagataccaaatccatcagtttgacactatattctaaattagtttatatagtcaccgtaatgtgataaagaaattgtgatagtctagtttactgagcattgttatcaggaccatctgtgtctcatgtttaagtctagaaatcagtctttgaaaatgagtgaattcaaatgcatttttaaaagtctaagtgccattttgcatgagggaaattatatacctagtaagaatttctctgggtttcaaagtcagaacactgatcttggtaatacatggacagaaaggattatttttcagttagggtgttaaacagattgtgctatcattttaacctctggaatgaataagccccagatttaataagctccttatgtataagatgcctgttataatgtgtctgtaatgtcctagaaagatgagactacccctgcatagtgcttatttcttgcatggaatgaatttaagataagcttgtcaaattttaaatctgacatagactatcttttgaataatttatttggagtcatctctgtctgattataatatgccctaaaataaatcttgaaaaattaaaatatatcatacagaataaacagtctacatgtaacagttaacagttacatgtaaagtgttattcagattacattttacaactatttcttttctgattccattttttattgaatagaagttcaataaattttattctgttaagaatgagtctgtcttggagagggtcagtgtcacatatttactttgaagttccttaaagaggttagttgaattctccccccaaaatgtgctttgaattagcagcttttgaatatctattctagtagaggtaggagcaatatgaactagagagaatgatatgcaataaaaataataatttttctttgactttggaatgaggataatctaaaccacagccatgtaggcagacattttctgatgtatgtaggtatgtttgcatgtctgtctatctatccatctccttgttttctatatatttgaccctaacctttcaggctcctattttgccatcaggtccaaaaccaaactgagcgataagagagtggagatccttaaatcagtggttctcaaactttttggtttccacattcctttatgttttcaaagaaacattaatgagaagagtagcattttgttaacattaagaaaaacctctttaataactggcttaatagaaaccagctggattcttatatctgttctttttggtcaaaatatatgaagaaaatccagcctcacacagagatgtaattggaaaggaaggactattttaaaagcctttcagataattgtgggtattctttgatgctacaccaaaatgcaacaagaggtagtttcttaaaggttagttgcaacacggaagccaaatctgtgaacttttagtactctgaaattaaaatccattggttgatcttgcactttgaatggatcttttacctgtgcaaggttttgttacatcatacattggtcatttgaaaatactggttcactgagttatgcagatcttccaaatgttgacacattttattatgtattaaaatgtcacattctttaatactatcacaaatcttatcagaaaagtctttaaatattgtgagcagttcatggtagcagatagaagttttccaaaattctagttttcacttgagggttcaaattttatcattgtcaaaaatatgtcagttttccttgaagtggtagattcactaatttattttcaagaacatatctgtcagatacccaaggctaaacaactataatttatcagtctttcaagtaaaagtggtgttccatgaagaaagtagctagtgcagctcacaactcagttacacaagtggttttcctctagacaacaattgtactttgatatgcagcagaaatgctttatgtgtatttcccattttgtcgtacagaatattaaaaagacttctactcaagggtcaagatttcataaaattaataacttttattgcttcatcaaagacttccttcaattacattgactgtgtgtggtatgtgcatgtatatgaacatagggcagtaatatgatgaactatataatacagtttgatgttgctgtcttaattcatgctagggcaccatcattgcttttgcatcatcagtgtaaatatcaacacagttgtttcaagataaatgatgagatttaagaaagttattcaacactgaatatttcagtactgttagtgtttgttgccaagcattcctataaaaggtctttgttgttgattacttggggctcatactgaataaatctaagcaaaacataaagtttatagattcttccatttgtaaaacaaaagcacaattctgtagttgagatattaactcagccttcgtatttgcaactaagtgtaatttgatgaattaacatatggttggaaagtgtcatgatttcttatactgacttttcagcaggcattgagcaaggtcgattatccacaattttattagtctctcagctattatatgcactttttcagtcattgcattatattaataacttacaatgtaggatacttccgtggtcttttcatttccagtatgataagctgtaatagaatttttttttagaggattcttcacacctgtgtttaaaatatccagttccattttctttgaactctacatgattggtttcagaatgacatcacaacttaattggcaccattatagtatttgaaagattttgttgcataagcgacaagaagatagattattcatatgtctgaaacaagagaaagatggctttcaatgtatggtcattttttattaacaattttgaccagtttctttgctagattccacctttccgtgagtcataaaattctcaaatatatcagttttatcttttctgtatcttatatgtagacagtatagttgtgggttaaggaggcaagttttctaatctcctgtcttttaagccagcaattcattcttaaatataagaaaagtatgtaatagatttttatatgaaatattaaaatttaagaagctgtagatagatttagaaaacttttccaaaaagatttaaaaataatattataaaacaaaacaaagtatacattcttctttgttgtatttagatagaagtttcagtagtggagtccatataactaagctccataataatgtgtttcataactttctccattattctactactagatcatagaaggcttgtttctcttaaggtttagttttttcatgcactcagaaaatagtttttcaggaagtatgtactgagtattctgaggatatgcaaggagcatgggttccagtgataaataatacatagtctctgtgctcagggaacttatagtttagttggtgctaaccagataaattagcaaaataattgacagatatagtaagcatgatgaaaacacacaatggactcagagaataacaaggatgctctcctgagacagcgacatttagctgatatctcaaacatggggggaattcaaggattccaggcagaggaaagagcatatgaaggcagttaagtaaggcaggaaagagctttatttgaggcactgaaagaaaaccaatgtgacaggagactagtgaatgggaagggggatgagtaatgaaaatgaggtttgggagattggaaggggctagttctacaaagccttatgagctatagtaagtagtttgggttttattctgagggccagcaaagggatttaagcagcagaataacacgaatgatttagttcgtagaagatgttcactgctacatggacaatgcattagagagagacctattaacagtaggagcagagagagcagagataccaattagaaggctttttcagtagctccggcaaaatgatgatggcagcaaagtgatgaatggattctaaatacattttgtggatagatttagtgagaattggagagatattagatgtgttcagatttctgtcttgaattactaggtagaaaggactatcattttttactaagatgaaaatatttggggggcacggtaatatgtttggtataaatgtggagagttatttttggatacatttaaatttgaaatgtctgtgagacattcaagggaatgtgtgcaattggctctgtgaatctgggactcaagagaggatagatctgagctaagaagagtaattaagaattgtcagctcatacacatttatttatttatttggagacgagtcttattccatctcccaggctggagtgcaatggtgtgatctcagccccctgcaacctctgcctcctgggttcagatgatcctcctgcctcagcctcctgagaagctgggattacaagtgtttgccaccacacctgactaatttttgtatgttttagtagagatagggtttcaccatgttggccaagctggtcttgaactcccaacctcaagtgatccacccacctcagcctcccaaagtgttgtgattataggcatgagccatcacacccggtcagcttacacacattatctcatggatttacatgggaataatggagtcatcaagaagagagtatatagagagaggagggttcaggaccaaattagattttgaattggagaaggatgagagcagcaaaggacggttcaggaccaaattagattttgaattggagaaggatgagagcagcaaaggaggagggttcaggaccaaattagattttgaattggagaaggatgagagcagcaaaggagactaaataggagcggtcagcaaatagggagaaaaccaagagaagagacttttgaatggggaaggagtggtttattcttgaatactgttgagacgttagataagatgaaggattggttttcactggatatgtcaacatgaaagtcactgatacacttgacaagagccttttagtgatgacatgaaacataaaagttaaagatggattaagtagtaaggaagtgagaacagcataactatttaaaaatgtttgcctataaaagaaaatagagaaaaggtagggttttgtcttattttcaaactctagatatcaattatatattttaaaggaatgaacccatagataggaagaaagcaatgttaaaagagaagtcgagtccttgagaaggggcaaaagggtggaattcagataacaggtggaaggatggccctttgctagtaaggcaggacattatggtagaggcaagatgagttcatagataggaccttaggttccaggaagataaagagaagacacttctaacagtttctgttttcccagtgaaggacatctcaactgatgtcatcagctgaaagtaaggatattagaggaggtgtagaagatttaagcagagaggcacaagtatgaagtagttgtcttggccagtgggatagtgagcctactagagacatttggattgtgaggccttggtggggtgtcagtatgccgtatgctttaaagtcaaatctctgcaacagaatgccaggtgtagagttacagttgattaataagacacagcccctgtactcaaggagtttgtaatctagagaatgaaagacatataattacaatatggtgtgatggttgtgatgaacaaggtaaatatagggtgtcataagagcacacattaaccaatcttggaggggctgtcctatgcaaggaggtcttcatggagacctaacagctaagctaagacctgcctgttctgcaagtaccttacttaaagctattacataatagctgctggggatgaaaatattctagaaggtatgatagtcacactgtattattatatctttatgcagtagcttttatttctgctgacatcatcaggcatctttgaaatttcttttttttttaacacttcgaaatgctgtgaagcaaagtatcatccctctctttcctcaccctcttctcttccttaacacctttcttcagttctagctgttggcagctagatgcaacttaataatgccattttgttttcatttggcatgtcattcatcattttcaaaataaataaactttaattttgtgctgccacaatcaggaatatttgaacatttagtgcttatcttgggtatctgcccttattactttctgaggagctgccctttatagcaatcagggaactataccacttggaagactaattgtctttatacaaaaataaaatccttgtgttcagatttctgtcttgagtggctggtttgaatctaattttctgttatatgaagcaaagatttattatttaacatagtttcaaaattaaaattgatagtgaaattttatgtgccatgcaatgtcatgtgtgttcttttaaggtgaagattcattttttaatagctttattgaggtataattgacatataataaactgcacatatttaacaccacattttatgtgtgatatgtatgtgtgtgtgtgtgtgtgtgtgtatatatgtatatacttatataggtgaaatcatcaccatagtcaaaataatcagcatccccatcagtcccaaaagttttgtttctcatgcccctttgtaatttttccctgccctctcaccagtcaactgatctttctgttactacaaattagtttatagttttaaaaattgtatataaagggatcttaattatatatattttccttccagcagaattattttgagattaatccatggtgttgcttgtatcagtagttcgtctttactgctaatattctggtgtagggatatagcacaatttactaatatattcaccttctactgttagctactacaaacaaagcaactgtgactatttgtgtacaagtctttgtagggacaaatgcactcacttcccttgtgtaaatacctaggagtgggatggctgggttatatagtaggcatatgtttagctttttaagaaactaccaaactactttggtacaagtggttgtaccattttacattcccaccagtgggaataagagttgcagtgcctccatatccttggcaacacttgatacagcctatctttttatttttagccattctaatagaggtatgtagtggtatctcattgtggttttaatttgcatttccctaataactatattaattttgaccaactttttatgtgcttatttgccatccataaatcttctttggtgaagggtctgttcaaatctttcccgattttttattgagttattttctaatgattgagatttcattttgaggattttgtgtgtgtgttgttttgtttagcagcttagaacacacacatttattatctcacagttactatgggtcaggagtccaggcatagatttgctgggtcttctactccagggtttcatctgaaagtaacaatcacagtcttggccagggctgcagttgcatctcaaggttttactggggaaggttccactcataagttcacatgattgttggtagaattcagctcctcgtgggatgccgaactaagggtctcagttatttgctcagttggagattcccctcagttcctgccacatgggcctcttgatatggcagctcacaacatgacaacttgcttcatgaaagccagcatggaagtgtttatgtttactggtttattatgattaacaaaggatacagatgaatagcccgatggaagagatgcatagggcaagctatgtggaaggggtatggagcttccataccctctccaagtaggctaccttccaggcacctcctcatgttcagcaatctggaagctttgcgagttctttatgtattctatatacaagtcctttatcaaatacatgacttgtaaatattttctcccagttttttgcttgtatttaaatttcctttttagtgtttttcaaagggcagaaattcttaattttgatgaagtccaatatgtcagctttttattttatggactgtgtttttatggttttaagaaatatttgcctaactaaaggtcacaaatattttctcatattttttttcttaaagtcttacaattttaggttttacatttaggtgtatgatccattttgaattaatttctgtatatgtgcaaggtgtatatcaaagttcattttgtgtgtgtggatatccagtattgtatgatattcaatgctgtgttttcacctaatagcttttaaaggaagaattaaagcaaagccaagttaaataggttataccagactgttagttttctttgtgttatccttgactttgttaggttgcacattttgctggaacttcttaaaacagtatcctatgattgaacttcttcaacctcaaatttccagtctttatacttaaccaatgaaatgttatttatatactctttggaaacataacatatactgtagataattataacaaaagtgtaatgggtagcagaagatattgccaaaccaaaattctggagaccagatgagacaaacacataatatgtgcctgtatgggtcacagtgctaggaaatacactgaaaagtgaacaaagaactaaaaataagcctcttataagaaaagctgctacttctgggctaatctattagtagtttgttttccttaatttgaaaaagagcttcagaatcagactctagagtgaatcttttaaaactatatatattatgcatgtatacacatatacatactctatgcattggcttagataatataaaaacagcacaggaatagtttatgctgtagtattgtgcagtcttattcagaaataagaaaaatagtttttccatttagctgtgagtcattactttttagtttcgtggagaaattaagttttagtgggggtcgatacagcttttttttttttgtagaaaatcaggtagcatgggctttggagtcagacaaatctcggttttaattttcagtgtccttatctctaatatagtaatattaatagttacctcttcctgggttgttgagaggtttaaatgaaataataagttaagtactggcacagtgcttaacacataataggtattcaagatatgtatacttctttatcatcaggggattgaccttggaagcatatgggtacatagaaagaacccataaaaggatatgacaaggggagaggagtttgttttcattagatttagcaaattcattctttcccccaactccccagaaaaattcattttaatgctattattttccttatcacccataaacagacagaaaattggcatgtttcgaaagagtgttaaaactgcaagagtattacatggtatcattacactaccatccattatctaactgggtttatttatgaaggttagatttagataatttagacttaccctttttccattttgtggggaaagagaatcagaaacttgaaaggaagagctcttccaaacagaaagatagctagaatctctctcaatagtctatataatctcttctaataatctttagcaaaagtgacttttgagttcttttaaatatttcctgtattgattctaattcagtgctcatttcatgtgatgtctatagaactacagacttagattacagtcagaaaactgagtaacagcagacaccaggttttcagctgtttttagggtttattcagattgactacatcacattcatttggatggatttagtgacatcaattgataattgtaaagaaactagcctttaatctgacattttcatattgatattagataggagccacatgactatgtcatgggttcattcacaagatataataaacattattttcacttgtagcataaaagcagtctttagtgttatcttagaagcattaaaacacacacatatataaaatcatatagattaaaaaattctatcagcataggttctgtaattgttaatagatgtaattgcataaggtcgctatgcattatttctcattttcagatgaagcctgtcaccttgacatttttatatataataggaatccacaggttgttaaaaacataaggaaattaagataatttgaattcagattataaaatagttcaggtctattctgatgaagcaatgtcacttaggtctgaggcttttgggtcagcttttaaaagtttatcttatttttcattaaaatatgtatgtataatactctatcatgcaaagagaaatggtcaacagaatttctgtgcatatatggttgctggttatttgaaagccattctcctcctaggattatttgaccaattttgtattcagcttagattagggagaatatagtgtctccttaggtaaaatacttactagaaccaaaaagtccagattaaattgtttttatttttattttactgcagttttgtgcagttgacctgattttaaaatataaaactaggaaggcatatttttcatctaccaaaatgtgaatcttactttcattttgaaacaaacacctctgctttaagaagatgaacggtagtgataaatacaaaaacgttaaaattttttaaatgaatagcgtttgttgatctttaaagaaaacataaatgtgaaataactttagagcttaaaagttttcttcctcaaaccttttaggaattgattttattatccaaaacaactttattcatactaagtgtgactatctgaataattaccttacttttatagttttttttttaaaaaagctcttctaactgtaattatcctcaaagaattggattaagaaattcaataattttctgtcattagtccagcgagatatttactgaatagccattacgttcctggctgttaacactacaaggactccagcaatgagcaaagcaaacaagcccttgcttttccagagcccacattctagagtcagatgctaaacaaatacacagatacatatataataaaatattggtttaagtgttgaaaagcaaaatcagagtaagaaggcaggtagtcattttaaattaacattgagaaatgtttccattttaagcatataaattctttggcttctctttttaaatttgcttttgactgtttgttgctggcgaaaattatttaaagtaattaggaactcatcgtaaatattttgtacactactctaaaaatctaattccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaataaacagtaggagcatgagtcagagccagcatcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaagaaaaagataagttgcttgaaagtcccatctcttttgctagtcggcttctgtctgataaaattttattctgttttgcttcattgtttattcattcagtagatgttcattgaacacttactgttaccaggcactgtgctaccatagacggtataaagacaaataagctaaaatccttgttctcaaggaatttattattgtagagaaaagtgacttgtaaatccaaaatttcatactgggataggaactataaaagagacatcctgcagaatactgagattataaataaaactagtatgtttgaagcatttagtgtcctagctgttttatagaagtcatttcatttaatcctttcaacagctttatgaggtagatatcattacactattttacttgtgccaagagcactacattcatcaaggaaggaggaggtagtatcaaatttttcagaaaacaagagagttggttatagaaggatgagtagggtagagagtaggaggaagatgaggcagtgtggcatttcagacagagaggtgaatatgtaagcacacaggatgagtgagagaattgttggaatgtagtcagttctaggaaataaaagatggcagggtccagatcatgaagtttggttcttaacctgtagaagacagaaatatgatcagacttgcatttcaggaagataactctgtaattgtttgcaattcctgttaaacgaagaaattttctccagcattgacttatgtttattaaatacatataaaaactaaattctagaaacatcttatacagttatacatcacttagcaatgggatacattctaggaaatgcattgtcaggcaatttcttcattgtacaaacgtcatagagtatacttacacaaacctagatgtatatctttgtttatatttattttttcatatggaaaaccaaatttcttagccatgttactgaatgtcagtcatttcccttacttgatctgcatcaccaacattaagtgccatgtatcagatttctatatatgttccattataatctcatgggaccaccatagtacatgcggtccattgttgacagacacatcattatgtggtgcgtaagtgtacttatagttttacaactacaaagtgaagcacagagaggttacataacttagccagtgtcacacagctaataagtagcaaagtcaggattcgacatgttaagccaacttcatggacttaaccacagtcctgtattgccactcctcttcatttaaaggcatgcatgcacatattagatttggagacagttctagagacactgaattggcaactacagtcgacaaagagacattgcagcaagtacctctacgttgtttgtttctgtacccttaacttgcagtggtctacaagaaagaatgaaggaagggaagtgatatatttgtcaaccctaactacattgtaaaatgaagctttttttttttctttttttgagagggagtctcgctttgtcacccatactggagtgcagtggtgcgatctcagctcactgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcctaaagtgctgggattacaggcttgagccactgcactcggcctgaagcattttatgatgctcactaccaagtgttcataagcggtaaataaagcccttgggctaggtaatgtaagatccattgcaacctggagatgaagaactttgtaaaggggataattgttatcacccatcagagcatcagagttttaagatgatctagatttagtcccactaattatatttctcctaacttttatagacagagaaatcagtgaaaaatatgtatttctaaggattaaatcccaatccatagctcaaggctacctttatgtctaatagttgtgatataatatgttgcttagaataggttctataaatggaattcacacataggaccccagaatcgcttcttcacagggtttcagagttggaggacatataaaaggataaatcaatccataaatctctaagtattcctaaaagaagagtggtgtgtcagttattggcaccagtacatcatgaatcctgctgggctgtggagaaaggagaaactaacctgaacaagactatactctacacagctgtccctgacattctaccacctgttagcattcagtattaatttcatggatcaaatcaaggcatgcaagtgcattaaataactttttaaaaaacaactgctgattgctgacgtctatgagggaagaaaaattaggggctgttattttcctatcaaccatcactctcattaacaagaacaggaaacattacgaataaataaaactcttacatcataccagaaaaaagaacagctgaatcccctaaaggatttcatattctatcatcagacaacgaaagaaaataattccatataaatggctgcatgaatcattgaaagaaacttccctgcttttttaaaagagcaactagaagtatttactttttgaaaatagagtaaccatttgttaaaccgtatataccattgaagatgttttgggtataaaagggaatttccataataattacatagtaatcttttatagccaaagttatgaagaagatcaggatttgggaaaattgtggtcaatatttgattttccttttctgtttgatagccttatctaaattcccctagcttgaatgtagtaaatatgagtgtgtaaaaatgtgtatctaattcacctcttgggggaggtttaatgtaactataaataaaaattctttccccaggttaaaaaaaaagttacatagtgtttaattctaccttttctcatttctctatatccaaaactatcaccaagtactgttaattttactttataaagctctcttgatatgtctcttcaacctcatcaccactgctttaaatgaggcatacttcctcatttggattatggcagcagtctctcttcctttagtctctccttcaaatccacctccatccttcatatcatccatcatgtatttttccctgcctaaattccttggttggcttctattaaatccaagttccttaagcatggcaaacaggggccagcttccacgagctggtccatacctctcctgccttatttcctgacactttcccttataccttgagatccagcttgccagtatttccccaatacctccaccgcatatacaaccacatacatatacacccttatcccctccctcatgtaccacccatatataattctctttaccgcatcctttatcacactcctacaagccttgaagcaatctgaacacagaaaccatctttgattttcaactcctaattgggactgaacatacttgtcttgaacacagattgctgccttgttagtataggtatcctaatatggcacatgtgtatagttgaagctataatgcattccccaagttccctttcaggactaaagggttatttcccaacagctggaagtcctgctgccagacagccttcttcaggaattgccttgtccccaactcaagacaaccctgaaggacctttcccagttttccatggggtccactgaggccttgagattgtactgaagtcaacttctccctctgctgtcgcttcccttccacaggtgtttatcacaagaacaatccttaataaacttcctgtaagcacactctcagagtcagcttgctggggaacccaagctataacaacatgtttatcttgttcacactttcttctgagttctaaatcatgggaagttacagttatccaaaatcttactaattggaagatcatttcatcagacgtgtattgagcacctgcttcatgtcaggcattgtgccagatacaatggaaacaaatcaagacttggcctctgtccttgagtttacagtctgaggtgacagttacatatgaacctaactgtattaaagcatcttgagaatctttttgattcaaatgtcaataattttagtataaaattcaaaagcatggattttgtggtgttacaaagaacaaaaggaaaatatttcaggggaaggaaaatgaatataaataagtagaatgaaattttagaagagcacagaatttgtctttataattctgaaagcctttagggaaaaggtaattttttcactttttattttgacataatttcaaacttacagaaaagtcacatgaatactgaactcccatacaccctttatgcagatatatcagtttttaacattttccctcattctgtttctttacacacatacaaattatttttgtgaactctctgagaacaggttaaatactacattatatcacttcataccttaaaaatgtagtatttcctagaaacaagggtattcacctccataaccacaatgcagttgtcaaattcaggtaatttgaccttgatctttaatctacagtccagattcagattttgttaattgtccccaaaaagatgagtttaggaagagtcatataacttaacatttgtaatgtaaattaaagatctcggaagtttgctaacctgatttaaataccacagtgaaatgaaccacttctgattttctacggagaaagcaagggttaggtccaggttacctgtaaaggtgtgacttagggctccccagaagtgaaccttgctctggagaccccatttggtgaggttcttttcaaaagagattgtatatttttgacccagggattgtcgatttgttgagctcccatgtaagtatgccgccttgccattgacaggtcttcacaatgctttcttaaacgacattctttggaactgtctttcatagtcaggcgacccgccagccaggccgccaggtaggtggaagggcggcttcgggaactagatccggctggttctctgctaacatgtggtcctcgatgctctagcggattggccccaaacctcagcacacagagctttggtagggctggggatgcaggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgaggatctcgtgtccaccttctttcctcagaaggtcttggagctgaatagccgagttcaggagctccggctgcaagacctgtccagaatccattcggtgccaacctcggagcccctggccaccccaggcaacaagggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgcaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagcaccaaccgtgataacctatactgatagcctttctccaccccatttgccttcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgctatccgttgaactttgttcaaacttacagaaatgctccttttacagcatcatttttctttttttgcgaggaacggagtttaaagggatatgtttaggtcattgtatgcctccagtttaacagattgaaataaaacttggttataaaattttgtgatggcctgagtgtgcttatctgagctttaattttcggatgtggacaattcagatgataatttcctacttcaggtggactcatacacttgatatttttcaactctgatgggtaagaaaagtaagcaaagagtaatgtattttaattattctaaacaaatggacatctacttcccttagaatgaaaagaggaatctgtggaaaatgacttccttccataatcttctatcatctcaggatcttcatttctttttacacaatttagaattccttctgtatatccgtttgtctctttaagtctctgctaaatccatcaagctgtgtatcctataatactttttcccccagttgattttcattgccctttctttttgtctcttagatatttcttaaagtccctcattagcatttccctctcaggttatacaggtcattctttttttttttttttttttgagatggagtcgcgctctgtcatccaggctggagtgtggagtgcagtggcgtgatctcagctcactgcagcctctgcctcccaggttcaagagattctcctgcctcagccttccttagtacctgggactacaggcgcatgccaccacacccagctaatttttgtatttttagtagagacggggtttcgccatgttggccaggctggtctcgaactcctgacctcaggtgatccacccgccttggcctcccaaagtgctgggattacaggcgtgagccaccgcgcctggcgggtcattctttaaagaccctaaaatgtggctttgtgttcttttgctacgtcgttgaggggaagccattgtcttctcaacagtaagctatatggttggtatttttaaagttcagcatttccagatttcatttgcaggtaagataaattactgcactgtgagtctattctaacctatgtagattagaaaaatcatacactggtttagcggaaactttattttctttctttctttctttctttttttttgagatggagtttcgctcttgttgaccaggctggagtgcagtggtgcgatctcgactcactgcagcctccacctcccaggttcaagggattctcctgcctcagcctcccaagtagctgggattacaggcatgtgacaccatgcccagctaattttgtatttttagtagagacggggtttctccatgttggtcaggctggtctcaaactcctgacctcaggtgatccgccagcctcagcctcctaaagtgctgggattacaggcgtgagccactgcgccccgccacggaaactttattttcaaagtaaactcctgaaaaatgataacaagtgaaactattcttttgtcgaccttctgaaaagcctgagtctttcaaatctgtgcttaaaaagcaacaacagcaaaaggtattgcctaatagaaagacgtcttacttccttccccttcaagtaaaaagagttctttttattttccctgtaaggtgttctatctgattcagaaaagtgctgggaaccctaaatcagttcataccatttgacaggctttaattgcacacaagtgtataatggacaatgtaagggaagaacaaatgttgcttaatttttcaactaatgttaatcatctaagacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataataaacttaggaactggtgttacaatatggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaaaaattactgaatcgtttataaatttttctttggttattagaggcaacatttgttttgtagtcttttttttttttttttttgagacagagtttcactctgtcacccaggctggagtgtagtggcgtgatcttggctcactgcatcctccacctaccaggtttaagcaattctctgcctcagcctcccgagtagctgggattacaggcgcccaccactaagccgggctaatttttttttttcttttttttttgtatttttagcagagacggggtttcaccatctcagccaggctgaccgggaactcttgacctcgtgaaccacccgccttggcctcccaaagtgctgggattacaggcgtgagctgctgtgcctgtcctattttgtagtctttatgaggtttacatatttatatagaattcttaccaagtagtctcaaccattaatagataactgtgtgatcaatttaagtgatttttaatttcaggccagatgcagtggctcatgcctgtaatcccagcactttggggggccaaggtgggcagaacacttgaagtcagttcaagaacagcctggccaacatagtgaaaccctgtctcaagcaaaaattaccaaagttagctgggcatggtggtgtgtacctgtagtcccagctactctggaggctgaggtgggagaattgcttgaacccaggaggcagaagttgtagtaagctgagatcatgccactgcactccagcttggctgacagagtgagaacctgtgtcaaaaaaataaataaataaaaagctttttaatttcaaaagtaccatctcaatggtcagaaatttgaaaagtataaaaggagaaatcacctatggtttactagcctaacaaaatcattactatttgtgtgtgttttacttattttaaaggatgcatatatgtttttacatcattgcaatatagtatatgcctacttttatagaggataaacatctgcatttaaatccaatctaatattataacttcgtttgatagatatcccctgattcagataacagatacatccattcccccaaatatttttaaggctctgtttcctaattgtgaaaatgatacttgtctgaggcaggaattgtgattagagtatggaacatagagatcaagtagctgggaggaaatgtgcctatatgactgtgagaatgtctagatatttagaatagggttttactctgcttttaggttggggcttcataatagctttagcaacatatctgatcattttattactcagtgctttttccctccccctagagcatttaattacctctaaaaatatgtacaagaaagcattcatgccttatactgattagatgaactgtttcagctttcatgatttggtatgagtaggagggaattctacttcctctgtcagcacttaaacatttctggaaaatgctgtagtgcattgacatcaggcatttttaaaaaattactgatctttgagaaaaaataaaggacccagtgagttacagaaatagatgctggaccatccctgttctctgcattagaaaactatactgctaacacatagaaataactgctcaccttgaactgaaattatccatgggaagccaaatacatccgtctatctatccatcaatcgatagatagatgtatttgtctcattctgtcgcccaggctggagtgcagtggcacaatctcggctcactgcaacctctacctcccggtttcaagtgattctcccacctcagcctgccaagtagctgggactacaggtgtgtgccacaacttttgtaattttgatagaaacagggtttcttcacattggccaggctggtcttgaactcctgacctcaagtgatctgcctgcctcggcctcccaaagtgctgaaattacaggcgtgagccaccatgcccagcctccatattggatgattatacatttgtatatatttttctttgcttgctttattttgatgagtcttcaagtcagtagcagaattttattagtgaagtgtagtaatcccagttactcaaatttaaaatgtttcactagtaaactgaatttaacgaattctctttcatagagaatgttgtgttatttttccttattggtgaaaacctagctggtgcagatgaacaggaatcgaacctattatcagtaaaattagattccttttacaatttggccatttattttagctttattatttaatctcatttttacaaagttatgcaatagtatattggaaaaataatattgctttgaaagtgtgaagtatttagaatttcttaaataaatatatagtttccagtttagatgtttgagatttagaggtgtacttttagccccttgttttatagatgaagaaatttagaatcagagatatatatggcagcacacaactcatctgtgacaaaacaaggtctagaagtcaaatcatcttccatttcaggctagtgcacttttcactgcactttactatgttctaatcagtaaataaaattacattagaagagagttctttcagaaatacgcaaaccagtaaaatttcaacaaattaacatccctttcaagttgtgtgttatttttttctgcaaaatgtaagagaagttgaaatgtttccaactcagaatggactataatatttttactgaattaaatattatgtaaagagctgggctcggtggcacacacctgtaatcctagcactttgggaggctgaagcgggcggcttgcctgagctcaggagtttgagaccagcctgggcaacacgatgaaactccatctctactaaaatacaaaaagttagccgggcatggtggcatgcacctgtagtcccagctactcacaggctgaggcgggggtgggtggatcacttgagcctggggaaacagcgatttcagtgagtcaaggtgccattgcactccagcctgggaaacagagcgagaccctgtctcaaaaaataaaataaataaaaatattctactggccaactcctcccccaccttctaaccttcagcaccaaagaactgctacatagatttgtcatggctgctgctcctaaaaaacctacagaataaaaggggaaagaagagctgtagttttctgttcgggaggaagcctgaaagggtcatttcccaaaagaagtttatcttttagagctggactggtcagtacagtagtcactagtcttgaaatgtagctagtcctaactgagatgtgctgtaagtgtaaaatacacactagattttgaagacttagggtgaagaaaaagtaaaatattttaataacgcttatgttgcttacgtgttgagtgataatattttggatacattaaataaagtagattattaaaattaaatttatatgtttccttttacttttttattttgtgtgcccgaaattttaaggttatatatgtggcttgcttatatgcctcacagtatatttctattaaacaacactgctctggaactaagatttctaaggtaactgagatgatccttggagttgagcctaaacctgctcttgtggtatattttggagatgtgggtttccattaagtatagatttttttgactcctagtaaatttttattgattcgtcatctggttcataatgtacaattcagtaaaagccattcagagagaggctaaacattgtaagccaaaccttcttacagtgcaacttggtcttggaacttagaatgcttacaggaatggatggctagcatgtgctttatgcaagccttttaaatatcatatccaggcttttggtgagagactagagtactaatattctgtattgctaattcagggctgctccatatgctttataaaccaaatagagggtagatttagcatgaatattgagacatttacccagtgtttttatctggatgaaagaataacgtacctctggtgcctcgagagtacctataggcagttaggctttttctcaaggagcaatatttgaacactcaattaaatccccatgatttcattgaattcccataatatagttatatagtactcattgtattctgtgtgtgtgtgttttttttgtttttgtttttgttttttttttgagacagagtctcactctgtcacccaggctggagtgcagtggtgtgatctcagctcactgcaacctccacctcctgggttcaagcaattctcctgccttagcctcccaagtagctgggactataggcgcacgccaccacgcccagctaatttttgtatttttagtagagacagggttttaccacgttggccagaccggtcttgaactcctgacctcaggtgatcctcccacctcggcctcccaaggtgctgggattacaggtgtgagccaccgtgccaggcctgtattctgtatttttatgtatatcctcactaaataagtttcttgagaatagtgtagggttttttattcaccctttttccattatggtgttttgcatatggtaaaattctaaagtattctgaattaaattgagctaaaccaaacctggatgaaactaaagaaaatcgtttctcccctttcttattagaggaggcactttgttacaacagaggatatatgtggataagtgtacccaggaatatgtaacaatgttgagacatctacaaatctgattcagaattaaacaaaggccaatgaagtttctacactgttttctggcttctaattaaacatttttttcatatcacaataatataaatattttaaagtactccaggcagttctccttcagtattcccaggatgtcattaagcctattcaccctgcaacagctgcaagttattccaaacatttgtactgaatctttacactctacaagcccatttgaaatcaactgtgtcaccctattaacagcttcagtaattctctattacttttctaaccaagagttagggagaaataagtctagtatatcagaatgaagaatcctgaaaattgcttttcaaaaccgattctctgtggtcacgaacataatgtttttatttacccttccagattttggtacttaaaaagttagtttcttaaatgtgtaaaatttagatcatttgataaatgattaaaaagaatttcccttaagtttattaagtcttatttggtagtaaatataaaagacaaaacattccatgtaaaaattatttcatacattttaaacagtttaaataaagtaagtgtagtcaactcaaaactccactgccttattcctctgggtcttgcatatttattggtggaaatttttctctgctatttttttacattttacattgtgggataggcacagagttattgaacctatgacctatatattccacagcttacttcaatgcttctattaggcacccgtccagagttgaagaaacgtctcagatcacagcaggttctcaaaaaatgtcattttgtttagcttcatttcaatataacattgatgagaaaaaaaatcagttcccagctgggaccactgtctgtgtggaattttcacgttttctccatgtgtctgcacaggttttctccagtttcctcccacatccttataacttttgcttcacaaacatttattgacttaacttacatcactacgaccaccatcacttactgattcaccaaaaattgcataaattatcttacttgtttttattagtttttattaaatgtatagctcacatttatttcaatatttaatattagaagtgcttggggtctttatttagaagtttggtgatgtttttatagccagaaatatgctgtaggaacgtaactctcatttatatcaattaggctatcataaaactggtttcctttatgtcatttcgcttaaagaatttatggacgacgtgaggaatagtactcaacttttgcttataaataattaacagatggcatgaaaaataattaacagatgacatgaaaagagacctcttaggaagcaatttttacgagcctgctgaactgggagttaacattttcaataagaagccattaagtcaaatataatcttttgcatttaaactctacatcattatattactagaagtctaaaaaccaaacagtatggtaggaagaataaaatgttacttatgaatataatttctgattatacttttagaaagaggattaaaagtattgacaacaaatgaagtcagaatagcttgattaaagtagtttatttaaagtatctccttaatgttatagtgtatgctaattatttgctttgcatatgtacacatcatgacatacatttatgcattagctgagacatgttcattctgtaagttttgtacaaaactaatgatcttcagttacacaagaacatttaaaagttttacatttgaaatagataattaagcaatgctgtgtgaaactgaaaaatgaaaactttgattaaaaaaagtattttcaaatataggatagtacatgtatatgagaatacttttttgggtataatcttagtaacatcattatggtgttatgtaaacatatgacatatgacatataaaattatagtagatagatcactgtgttacccacttacacattcttctgtcgtattaagcaacaaacattattcttatctataataaagcagatatttctgtctgtcatacatatgaaatatttgtatgtatttattggaagtaatttttaaggctagtctttttttataatttcaacttttattttagatttggggtagatgtgcagatttgttacattggcatattgggtgatgctgaggtttagggtatgaatgatcccatcacccaataatgagtatagtacccaaccagttagtttttcaacccttgagtagacattgctccaaaggaagatatacaaatggccaatagcacataaaaatgtgctcaatatcattagccattagtagaaataaaaattaagaaatgtttaaaatatttaatgttttatttgaaaaaaaaaacaattaaaattttaaataacatttttaatggaaaataattatatctcccaaagcaaaaaaaaaaaaaattagtgagaagagtagcactgttttacagttttgcagatttttaatatgtgatttaatggaagataacaagattcttatatatttctgtattcagtctgttgcaatatattgttttagttgaaatatatgaagaaaatctaccctcatgcaggtaagtagttgcaaagggaaggagtactttaatagccttttcaaataattgtgaattattgttttgatactacataaaaactcagcaagtgggaatttctttaaagattagttgcactatagaatctaaagccatatcagtgatacttttaccctctgtaacattaaaaatccattgatctatcttgcagtttgaatggaacttgtacccatgcatgattttgtaacatcattcactgctcatttggaagatactggttcactaagagttaggcagatcttctaaatatgaacatatttcattatacaatgtcaaaaaatcacattcattaatatcaccacgaatcacatcaagaaggtcatactcatggtggtagatacatggtttccgaaattcggattttcactcaaaatcccaaattttataatttgcaaatactgtcaagtattttctttgaaatatcaggcttactgcatttttaaaaagtgcttaatgggttacccttgcctgaataacaataattcgccattatttcaagtaaaagtggtattgaaaaaagtgggttgttcagcttgtaaatcattcacccaagtgctttttcttgagatagccattatgcttcagtaggcagcaaaacagttttttatgttcttgccctttcatcacagagaatgttaataatttttactgcttcaacaaggatattctaaactgaaattggctttaaaatattttattcatttattcatttgttggctgattcattgttactgtatgtggcggtgaagaatacagtgactgctagactagcttggtgccactacatagatttatactaaggcctagcagtttggctttgctttttcaccaacagagtaaatttcaacaaagtgcaaaaaggcttgaaaatagtttgacctgaaagggtcttagagattcttgcctccttagggaaaaaactagttaaaaatctattataatagctctcctttagctagtttacattataaatcgtttgtggttacctactatatgaaaggttgtagtagatcctggggattcaccaatgaacaaaacagatgaaaatgtctgctgttatggagctcatggagctcatttataaagggtaacgatatataataggtgttagagagaaaagtaaagcagagaaaggaaaggaggtgtgtttggtgggaatgtgtgtgtacaatttaactaaggtggctaggaaagacctcactgagaaattgacatttgaatgaagatctgaagtgggggcaggtaaaggtgtgtgcctctacaaaggccacagctgaggccgcccttctttatctacctcttttcatctttccaacttccagaccttttttttctgctgataactcataccttttaattaaactttaatttaatttaatttaatttagtttcttccaactctgctctccaccacttccttgcccctagcacacacacaattaatcagcacttacaaaaacaaaaatttacctctttacaaaaggtacagggatagagtagaggctttgaatacttgtgcttcaattatttttctcctgtcatcttttatattaaaggaaataaaatataggggtgtctccttttcctggttgaattggtagagaatatctatggcagttagtgctaatgtttataaaaaggaataaacacaagtgagatcatgatggagagagaccaaatcagtagggaccaaattataaagagatttcatttctaggctaaagagtttggattggtcatgtgtgcctgtcatcctttatttcattcagtagtggaacaatggctctcaactatgtggttgagggaataaacttaaacaacaaatctaaatttcctatatcagttgcatttaactgttgcgtttcctcagggacttcactctcctcaaactttttggtccctttttttaaaaaaaaaattattgaacacttataagtgttgaaatactaacttgtctaatctttataaacaatcggtgcaataggtgttgttactgtccctattttactaaagagaaaatgaggacacagattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggcccacctcagacttaccatgtaagaaattgtttttcaagagttgaggaatgtgggtatttatattataaaatcctgcaggtgattctgatatgtatcttttgttaagaacttctgttttagaaggacctaccattggcactgtttttgcttctgatcccagcttcctatgattaaatgctttctgaaagatacatagttagtacagaacttaatactattatactattctatactattttaccccagtttgacttttaagctgttaccacctgaaatttaaatgaaatcctttttagaacaatacttgaccaaacaatttaaaaattgtatttcctacaaatgcatcataccttaaaaatgcactttaaaactgaatggaagccaggtatggtgactcacgcctgtaatcccagcactttgggaggctgaggtgggtggatcacctgaggtcaggagttcgagaccagcctggccaacatagcgaagcactgtctctactaaaaatacaaaaattagctgggcatggtggcgggtgcatgtaatcctagctactcaggaggctgaggcagaagaatcacttgaacccaggaggcagagtttgcagtgagctgagattgcgctactgtactccagcctgggtgacagaatgagactgtataaaacaaaacaaaacaaaaaaacaaaaaacaaaaaaaacaaaacacacacacacacacacacacaaaactgaatggaaactgagaacttactgttctatttatgatgaaagaaaactggtaggctttagaaagtacaccctatgtgatatgaaaagtgaactcttctagattgtggaacagctttatatagtatcatacctccatctttaactaggattgcagctggcaataaagctcagcttctaatgcgagcaagtgttgagtttggctattttgttaacccaagatcctgagagaaaatttgttcactgatgtacataaagcatattatggttaaaatttcttattccactttgtagtttgccttgttaagactagtctttcctaaaatgtgctttaggggcattttatagtcctccatatttctttatgtgacgccaacatcaaaattgctttgaaaaggatcaagatctggagtgaaggctggaggaatagctagacactgaggctcatgcaaggagagttaactttagaaatatatattacatgaaacccctttttttctccccttccagaaatttgtagaatcattgatatgaaagagttggctagtatatctccctgtgttcccttcccaccctgctgtgctatccacacaaacacaagtggcatttgaggtaacttttgagattctgctgggttaaaaaaatatatattttttgtctcaacccaatatgttcctttttttcaacaaaaagtataatgattctcctatatatctatgtttagctttttgctagaagtgtttcctaataacttttctcaggaaacttgttgactcaatttactgtagtcatagagcctcctacctgaccccctgtggtctgctttggtaacacacctgtaggaggcaatgtaatcttcaggaaattcacttcctaccagtagtcctgagtaaagtgaattttctaaaatgaaacatcttgtaaacattatatatgacaaactcccaaatggttaaactctttatgcatttagtgtttgatctttttccttaagaagacttttttttggattgctgtcctgttggcactcaacaaattacaattgctaataagtttcagaggccctaacttattttcctaaatcatatacttcccagtttttgaaaaggctctctattatagctaacaaagttttgaactttgattaactcaagtgtttttgttgttgttgttttgttttttgttttttgtttttttttgagacggagtttcgccctgtcgcccaggctggagtgcagtggcagcgatctcggctcactgcaagctcagcctcccaggttcacgccattctcctgcctcagcctcctgagtagctgggaccacaggcgcctgccaccacgcctggctaatttttttgtatttttattagagacggggtttcaccatgttagccatgatggtcttgatctcctgacctcatgatccatctgcctcggcctccgaaagtgctgggattataggcgtgagccactgcgcctggccaactcaagttattgaatgaagtaatatgaagcacatgggcagagacttcctggtcctatacctgtccaaggcatgtaaccaacattttgtttaagagctttccctagggagatcaatcctgacctggtttagaaacattttttcctgaaactctcatgaaaagagaagaatgattttggatgctactgtcttatcggaaagtatttacaagaaaccattttgaccaagaaactcaaaattaattctggtttttaaaaagagaggcatatattactcttagattgaaccttatgaaattactgatatttgactcaccaaaatgacagttttttatggtccaacctaatactttttggtgttaataaaaggggaggcagggttagttgggcagtttgtgggggacatcctacagagtttgacatgaaaagtatatcttaaatcaaaacttgaatttgtacttattaggatttcaagctcatttttcctctggtgaccttgccagcattatcagatttgtattaagtgtcaaaagtttcctcttgtcaaagtgtaaaccttggctcattcttgggccatctgttgtacactaatagttttgatttattcttctggctgacatgcgtattaatggtacagatgcaagctttatatttccttttatgggtctgtagttttattgcatacattagtggcacaaatacagcattcatattagctatttatatgaactatttctagttttggggtgactaatatactttgcttatgtttttactatgctgagaagccctgtatcgtagacattttaatagactttaaatgattacattctacttaattttaccacccctaattttgttttttgtaatttttattttcaggatatgtcatgatgtatgtctgtatatttttatgatttcaaattcccaaattgccattgctttaatgaatgagcacatttggtttttgatcaggaattactataactactagaaaacaacactagtgcaaaatgtgaatttagataaataactctgaaaggcctacttctagttgatgctttggctctgatttttgagggttaatatgttcttcaacttctttgacagcttgaaagttatgaaatagagtgatagaaaacaaaagctctctaggacagggacataggttagagaaaatttaatacaaagctgtttttgaaataaggctaggtgctatttttatttttgatctgcttttaacagtttcctatattggaaaaccaaacccatctctggaatccagtggatatgggccaaatataaaatgttaagaggctggtgttactattggtctgctatgcaaaactttttccctaatagaggtctgtgttgatctgtgtgaaagctgctcagtgtcacaagtgcagcctgagtttcattcatttctaggggaaattatgatagaaataacattcctttctattaaagataaagggctccaaccttgagccagagttttctaatacagtagaagccatcttatctatatagtgggtactagtagatagtctgttaataaacaatactggctaaaataattttttaaaaagatatgtatctttatttcatttgattatattaatgtgcactcattggctagttttgtatgcagggccaatttcttttctttgagtccaaatccactcttcagagttccatgttgccattcttgcataaactatactcacaaatcagcaaccataatttccagtcttggttacagttactgtatattggaataagaacttaaaggtacttgttaagcaatctgagggcagactattatgatttttatggttgctttgcaaggagagaacattttaaaacttacctttatctttttgctctcttttcacactattagtttatgtaatattttattacacaattatactaatacaattaatgaaagtagtcttgaaaaaagacacaactcaactagtcgtgaatgttccctgtgctatgggcaccagtcagtgagttttatagggggaatgggaagggtcatttaatcagtctgtactctacatagatacgtagaatcaacatttgataactctcagtagggcctgaattttattgtgagttaccataattaatttcagtggagcaaaatgtggtccttttcttttgataagccagtctccaatgcttttgttttcttaaaaagacaagaaacgtaactttgaaggctgtgttatacactaatattctgttggtttctaacaaattgcttggaagagggaattgggagaactatatgaaagtagcatattttctcatgcacaatattgcacaacattagaaaactgatgctttattttcatggtgaaatgttttgatgtttctccccgccccctcccctccatgtttctctaactttttctgggaataagagtaacaatacattgattataatatttgtccacatgatttcattccagaggaaatcctatagtatctaagccctacggaaagcctcataaagacatttcaggagtccattcgaagatgtcttaaaattaatgacattgttttgagtgacagtgccgaaatatatttctttctatggcaacattcttattctactatcctttttatttttaagtagtttcatttttgtcactgttgggttattttaaacgatttaattggagggaaagaaatacaaattcatcaaattttacctccagaattgaatttccttcactagttccttaataagtatttaagtaaaagggggtgcaatatcaagaagactaaattataaatatggtttctatgctgttaaaaaataacagtcctgtccttaattaaccattatggagattcctcttgaccaaatacctttagaactgtttcacagatttataatttaactagtaatttggtttaggtttaggtttaagtgacagaaaatccaaaataatagtggcttagataaattataagtttatttctgtctcatgtataagtttcagagatctaatgatagctacttaatcatcgggatccctgtctccttctgtcttcttgctccataatcctcaacttgcagcttctgtctcatggaacaaagacggctactccagctctggcagtcatatctgccttctagctagcaagaaggagaaagggaaggaggagggaagccttccaccattaccaccttgaagaagttgccatttcttcttacagtccgttgaccagaccgtgtagccttatttggttgcaaaggaggctaggaaatatagtctttattctgggtggccttgtgcccaactaaatatcacaagtcctgttgctattttaatgttacagaggaaggagagcatatattgggtaagaaaaaaaaaaaggctgtttctgccacaattcagtttccccaacaaaataaaaacttggatttatattctttaaaagaaaatatcctctgtagcacagtgctgaatacatgacaggacactgtgctcagtaaattttttttaagtgaacagtaagggccggtcacagaggctcacacctgtaatcccagcactttgggaggccgaggcgggcagatcacgaggtcaggagatcaagaccatcctggctaacatggtgaaaccccgtctctactaaaaatacaaaaaattagccgggcatggtggcgggcgcctgtagtcccagctactctgcaggctgaggcaggagaatggcatgaacccgggaggcggagcttgcagtgaatggagatcgtgccactgcactccagcttgggtgacagagcaagactccatctcaaaaaaaagaaaagacagtaagaggccagtaaatatttattgagtgattacagctcctttgtttctgaaaatgtgactcacagtactaatgatctgaaaaagagtaagatgaacacagagagaaagtaatgattcaggattcattgttgtgaggttcaagaaacatttattttgaggaagtggaggtaaatattcaatgaagttaactacattgtcccagatatatagataagatagataaaatgtatatattatatagacacttatttttattataagatatgtactgttagagttggtagtataccagctttggttccctgcagtctgatttttgggcctcttggtaaacaagtacttaaaaactgttaccccagtttgcaaacctttaataattagagacaaggcaggttaactgtaataattcgtatgcatgcaagatatgattcttctttttcataaatcatacctagtttttagctttctgctgcaaaagtaactagtttgttagaaatttagtgaaaagaaaaagtaggagacattgtgttcagaagatcatgtttaaaaacaacaattagtatggcatctgtatcttagcaggaaactcagaattaagtctgagcctgaccttaacccatgaccagtggaatctaagtttgtttatttttacaatagccttaatttggggcttgcaagttttttggtttgttttcacattcaatttagagaccctgaagcagtattttaatgataggaattaagctatgtataactttcatggcttgaagatcagcaaattctgttttttcttggttataatgttatcttaatcagaaatgtgtgatctttgtgtctaacaatgcacttaaaaaaacaaaacaaaaaattcccttgctgcaatgctggaattctaacagaatttactcatcttctctctcctccccaatttttaaaaacatgttctcatggaaatgttgccttgaattacacaaaatacaagcagttactggaaatgttttctacacagttctgttcatgtatatcaatttcaatttgtttttcactttttagatttttttcttagttttgctgataatcacacttcataatcatatcaactttgaactttgaagttgtgttgaatttttattgctctcagctgtatcagatcctactttttgatgagttatttcatatagtaagtttgttgaatgaatggtgaaacaatgaacacaggaacaagaaaagaaagcaaaatgcatcaaacttaggtttagttttatctccagtttaaccatgctcccttaaatggaaatgctaatatacttctttttttcttttttctgtaacagttcatatgtttttgctaggaagaagaggagttactgaaaacagtagttaatatcaaagtcataagtcatttataatcagccttagaatgcctacagatgtatatacatttttcaaaacacttatactctgccttttctgaagccaagcttctcttggcttattcttacttttagtacttgtgtgctggaaattagaaacctcagatgccctgcacagtgtaggactatacaattgtgctaggcatgtatttataattctttaactcttctaccaaactgtgtgctttttaagggcaaaaactgtacaacttctttagcatgcacctgtcacttgcaaataaatgtctaattctgtggtcccttcaaagggagaagaggaggctaagcaggcaaggctctaggccttggccctgcttcagtcagaatctttcttgtacatgttgataatttctttcttctacagatagaaaattcctgggataagaattttgatgggaaaaagagtttattgcctttaaaaaaaaagtttgagaatgactgtttaggggagatactctcagtatcttgtgacattatctagtctagcccccatcattttacaggactggaaactgaaacacagaaaggatacgtagtcttgtccagattatacagctatttagtggcagaattagaattaaaatcccttgtcttgactgcttgaccagtattctttatagtggtgctacagcatatgtgttgtaaaaacctaggagttttccaagatcactgcatagtgcctgacaacggtagacactctgtaaatgtgtattacattaatgaatgaatgattctaagctggtttgtagttaattaagccaacttcaaataaaaactataatttttcatcatcccaacgaaatattgacctcttagaagccctgaatttggcctgttctaggactaagccaattgttatatataacagattgttctttgttaattttaggatcacctgctgttaccagctaccacccataacaagaccacaagaccaaaaatgtcaattgtgttaccagcaataaacataaatggtaagttgaaattctgatgtatgaacaatatgagatttctttgtttaaccaggattctcttcattagttcaaagacatttaaaatgttcagttaaatgagtatatatccgtacattatttctgaaacatttttccactgttttattatttttaagatccattattcttttaaaaaaaattactacatccctaaaagaaaaagtagctttcttttacttacaaaattggaaaagctagcatcttgactgctctacagacttgcatctgcgacccttctagtcataaatgtagtgtaagaagcccctgctgtgttctgacagtgaatttgtaaattagatttttggaactcaaagcagtttcctgtgttacctaaatgttgatatcatcctagaccatgccacagaagcctgtttatgtttaattgataatactgatgagtttgacactgatagtattactattgcattttgttatattactagccctggacattaaacaaaatacaaataataatataatgcacagatgttaaggcataatatacctgcttatagtttagaagaaaaaaaaagacaagcacaaaaatcactgtactccaaagagaaagtcacgtaagtaatatgtgaggtactaagaaatctagtgaaaagagattactttcagcttgattcttcatggagaagtgaaataactcactcccattaccagttgtggattataaatgagcacagtgtatgttattgactaattgctttctctgacacattatattgaaaatcggagagttggccatctttttcaagtttgtgtatctcacataatgtaggtactagtaaattttctgtctggtagcaaaaacctcagtatatgaagaagatggaaacgaaaagccctttgaactaacctgcagtcgaaccagttcacattttgattgataaatataattaaaccttcaaatacaattataaaacaaaacactagaattttggggggattccagataagtttcaataaaatttagtctttaggggaaaagtggtattcatcatacattttaagaccatagaggaccttagaatttcatgatctgtatatagacagcttattagaaatgcttaggaagtaacttcatagacataaacataaatgggctttttgttaaagcataaaaattacaatatttacttagccttacaaagacattcagaataagtttaagaaaaacagtaacattgagaagaacatctctttcttcagtaaagacatacctttgaagttactcatggaataatcatttactacctgaagaagaatatattccaaagtgcattttattacattccaaagaatgtatttaggaagtctcacttatactcaatctataggtacctaagtttctctgcctaaactagaatagaccaaagggtcagcttatgctcagaaaggctattttctaagctttatcaaggcagaattcacttaattttgttcttctgatattgggttcttatgcaagagaatgcctggtcttattttgtaacagtgagctatctttatattaagccaaaaccaacaagatgctgtttgactatgtttatcttggccaggtgactgatttttgaagaggagcctttcatggatttggaaaaatccagtcattagaggatcattgtctttttaatctgtttcagactctttgtaaatagtctttttaaaaacttccctttttaggataagtcctattaaaaaatcaaaattcaaattcaagaaatattgattgaatatataccgtgtttcaagtaccatgctacatcctcagccttttctcttaacagtcttgctctgaggatacttcttaaattagagcctgattttttccccttcctcatgtacctcaaagtctgcagcagggcaggtggtatccttgcttcccactacaactttcaaattatttctccttcagtccccttaacatcttgcaaatctgtcacatcacactttactcctctaacccttatttgttgctgccgtctactccaccttcactgacgactcctccactgcctctgtcatcctgctgtctaacttcagcatccgcatagaggagtcattagtactctagccttttttgatccagtcatcttttattccgcgccacctcagcctcccatccatatggtcataatctagaccttatcatcatcaacagcagcactctctttgaaatctccttttcaggcatcccactctctgactgttacttactctcttactttaaaactcacactccaactactctcttaacttacaagtctacagtcctttgaccctgccacttcttttctgtgtccatcacatccttaatggccatacattcctccttacccagcttaaattccatggtcctgtcaccactctcttgtgaacaccccttacttcctggctcctttcttaggtcccactttcttggaaaaactgctttctaggtaaacccagctcttctctctatgcctgctctcaagcagctgaaaattgctagaaagtaccgttcagtgagaacaagtagattcacttcaaatttgtgaccattaatttcaaagggatatttaatatgccagtcattactagtaaattcactttccctctctctgaaaaaaagaatttctcaccttctcttgtcaaaactccaacatcctctctccccaccccctcagctgatgaactcaccaaatactacactgagaaaatagatgtcatcatgcaagagctacatcatgtttccactaccaccggcccagctgcatctacacccacaaactctgccttccctcttgttgcactgaaagaaaagtctcttccattgggttctaaatcccagctttgctacttgctggatatgtatcattgggcaagttaattaacttttctgtacctcagcttcctcatctgtaaaagaagatattagtaataccttcctctaagagttgatgtgagaatgaaatgagtaaaaaagctttaaatagtacctgactattttggggttagctgctgttttactgcaataatcatcattgccattgtccttaagacatcattgccaacttctaaggtaatttcttccttttggaccctgactcctagcacttctcacagtgctcaaagactttactctgcatttataacattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaagcagttctcccacttcagcctcccgagcagctcctgaacacaggcacattccactcccagctaatttttaaattgtttgtagagacagagtctccctatgttgcccaggctggtcttgaactcctaggctcaagtgatcctcctgcctcagcctcccaaagtgctaggattacagacatgagccactgcacccagcccaaaatgtcttaatattactgttacctctggtgtagggagacttctttgacttcacatcctatttctctgttaccctttagagcagaactctcaaaagacttacactcactgcttctacttccttacctctgattctgtcttcttttcacccttaccaagcttttgccatttcacttcatgaaatgctcttgcccttccactccactgaaatgctcttgcaaaacggaagtcaatgacaaatatctcgccaagtcaaaggtcatgtctccatggtcatcttacttgacctctcaacagtatttgacacagctaactattccctcttttttttagtccacccaattcttatttttaaaaatttcaaatctatagaaaagttgacagatgagtgcagtaaatatctagagacccttaaatagataccaccaattgttaacatttttctatatttgttttatatctatctatgtacactcaccagattttaaaacctatttgagagtgaattgcagataacatggtgctttacccctaaatatttgaaaatacatctgctatagaaaggactttctcttgcataaccacaataaaatgatgatactaaaaaaaatttaacattgatacagtagagttcaatgtatagcatatattcaaatctctccattttcccccaaaatattctttataactttttgaatatatgttccaaagattatacattacacccactcatcatacctctttggtttcctttaatctagaaaagctcctatcctttttactgtctttgatgacatttacgtttttaaaaattagacttatttaggtataatgtacatacaataaaattcaccaattttttgtatacaatgtaatgaattttgacaaaagtaaaccattgtgaagccaccatttcaatcaagatataaatgttgtcactacttcaaaaaattccctcatgctcctttccagtcgttcccctcctgtacatttttgacatcccttctttcttgaaatatgttattttctaggctttcatgataccatgacttgtctaggtttcctcctgtatctcctcagtcagcttatccagcttctcctcttctgtcaggatggaatcttgtttgttatgttcgccacttaccaccatatccccagcccctggaacagtacctggtgtaggaaaccttgaaagatgaggcactttcatttacattaactcatgtcatgctgagctgccagttaagtgcaggctaactgttctttattcaaatgctgggatcatgtggtgtgaatccattggtcaaaaaggaaagataagaaggacaaaatgcatgggaccagaattatttcagattttggattgtttcagattgtggaatatttgcatatacataaggagatatcctggggatgggacccaagtctagacatgaaatttatcatttatgtttcagatacaccttatatacacagtctgaagataattttatacacaatttttttttttttttgaaggcagagtctcgctctgtcgcctgggttggaatgcagtggtgcgatctcagctcactgcaagctccacctcccgggttcacaccattctcctgcctcagcctcccgagtagctgggactacaggcgcctgccaccacgcccggctaattttttgtattttcagtagagttagggtttcaccgtgttagccaggatggtttcgatgtcctgacctcgtgatccgcccacctcggcctcccaaagtgctgggattacaggcgtgagccaccgcgcccggcctttatacacaatttttcacaattttgctcatgaaacaaagttaatatacattgaaccatcagaaagggtcaggtgtggattttctgcttgcggcattatgtcaacactcaaaaggttttagattttggagcaatttggatttcagatttttggattagggatactcaacttttattctctttattttttatagataatgcctcaagaaagtaattcataccatttgcacaaccactatatagcagagccaagatttacatacattgtataaaatatcttctaattaattatattgttaattcaatattaaagacagatgtgcaaggattgaaaatatttgggactccaaaatttaagatagattttataccattttattcctacactataaggtgggaaagattcattgggagcagtataacataatacagtcatttgaatttgataggtatatgtttgttgaataaaagaataagtaaggtaaatgttatttggtgataactttgtgaccacttgaaaatattttactagtttaataatattttatataattaataatagttagcaagcacagattagtctaatcttttcaagtgtaaagtaattaaaacatatactaggctacctttctaccacattgagatttggacttcagagtgaattgaaattattagcctccttttcagcaattgttctataaataaaaccatgcaaaaagttgtcctataggaaactataattctataggattcttcaagacccagagataaatttctttggcttattagacttatggatttgacaaattatattataattacataatgtataatctgaagagtttaagttatgtaggcacaaaaagtttgagtacctatttattgaaagagcagagacattgtgaggctatccctaatatcagagttgttcattctgagcatataagggtttgagaaagttgaataaaatacattttctgtcatttctgagtttaaaagttacatacaacttggaaacaaaaatgagttgtggaggtgatccctctctctgactcaagtggagcttgtaaaattttggagagggtggcaaaggatagaaagtgaagacagaaattcagattttattgagcaactggtttatgtaatatgctggatggggatatttgtaagatgaatttgattttccaatttaagcacagtaaattacatttccaggtcaatgtctggtcttaaactgtaacgtattatgattatactttgtggttttaagccatggaagaaagtttcagaaatcgctaaagagagtaggatatgggtgtgaaattaatgccatttagaaatcacgtcatatcatctgtgttctccatgccagttttatttttgtaatttattgttttttactttgcattctgtttattatttaaattcctttgtttcataagagagttgaaaacaggttagtgaagctgcaagaaagtaagtctttctttgtctgaggaagttgtcacacaagattattgaaataaaaatagaatgctaggtatgctttgaaaaggcttttttaaaaaaggattgcatggttggtggaacagtggatgatggactaaaagctactgatttcttttttttaaaggattttggaagttctactagtagttactgtaagctaacatttcctgctttcaaattatttctacttatgttgtggtaaaactgttcatttcctttctttcactcttggtaaataattgaacaagatagagcatagaaaagggggtttttaatttgattttttagtgatatgtttgttttttaatggtagatagctaaactttgtagatatctttcataggggaatgaattctatgaacaagccatcagcagatatgtttcataatttggccaacatgttcattgatttgtttttactgtttcccttcccttctgtgtgccaggtacctgtttgtgtggtacatgtgtaataaaaataaacaactgtttataactgttacttgaattaagggcccacgtagatgaacaaatgactaccaggctaaactgtaattatatttaatctcaaggtaatttccatccatataaagaaaatctagaagagcttaatagcaatggttgcaaatactagtgccagcacatgcaacacatttttagttggagaggtcgtaacagaagggtaggaagcaaaccaaccaaataaatgtgttggttttaaaaataaaagaatattcatataactgcttttgatgatcacagttttttggactatcccaaggcaaatatatttggaaaccgtcctattcattctgctcaagcagcctggtttcctaagcaggtcgagagtttttccttttattcttctcaatatatttctccttaaaggtctgcaggttgtctattttttttaaaaaagtattatctaccttgcattttcattgtaattcatttcatttcagtttcatataattgcatccagacagttgaatggagtcttcacttaaaactatgttttaatttttaaaaaatacataatcatagttctctttctctctctctctctctttttttttttttttttttttttttttttgagacagagtctcgctctgtcgcccaggctggagtgcagtggcgcgatcttggctcgctgcaacctccacctcctgggttcacgccattctcctgcctcagcctcccaagtagctgggactacaggtgcccgccaccatgcccggctaattttttatatttttagtagagacggggtttcacgatgttagccagggtggtctcgatctcctgacctcatgatctgcccgcctcggcctcccaaagtgctgggattacaggtgtgagccactgtgcctggccatcagttgttttttgtttgttttattatattgagaagtccacagcaaagaatcacagtgaatgagccagttgctgtgttgagtcaacggcttaagagtggctaaggccgagattgcagaaattcttttggcctttcccagatgatcacaaagtgactgttgcagttcaagccatcatatttgtattacaggcagaaaaaaggaggtgtctatcaagaaagcagacattttccagaaatttctagaaagctctgcttatgtcttattgaacataaactgtgtcaactatttaggcctggcttcaaaggaggctcagaaagataatattttaactaggcacattatgatttgaaaaaaaatttggagtctttttagtaaggatccaccctcggcctcccaaggtgctgggattagaggtatgagccaccgtgcctggccatccgttgttttttgtttgtttgttttattatattgagaagtccacagcaaagaatcacagtgatgaaccagttgctgtgttgagtcaacaacttaagagcagctaaggccaagcagcagctgcttgctgcagcactccatcatatgctaaattggaattgagcaaagtgtctgggaagagacagtaaagagaggattcatgttgaaaagagaaataaatatttatttattgcatgggatgcagccagatgatttaggtcattaatgagttgaggaagtaactttaaactatcaaacataagaataatacaatgaagactctattaagagattattaatctggctaagaattgtatatagaaaaaaatgaagagcgaagatgagctaggatagatactaggatagatactttggaacaatctcaagatgaggtgattcaaagcttggaatgggaagaaaggaaaaatttccaaagaaattccaaaggaaaaatctatagcatttggcagctgatgatttataaaggagagagaaggaaaagctgattccatgattttgagaccagaccactgagagactagtactgccattcaaagaaatggataaaatgggagggacagtgtgagatttatgcatcttgaattagagatgtcattggtgggtatttttgtgtatctcttgtaacagattggtgtgtatttctgtgtatctcttgtaacggaataccaagtaattcttgactgatgaatttcattttctttcctttttgttagatactaccagccccctcacaagttagtgtccctttccatctgttgtattgtcttagacttctcctcattcaccaccttgatgcttttacaagataacaaagcttatggagataggcatggggcagcaagaaatatagagtgggaatctgcagagaaaagaaagatgagccctctttctttgcttgttttccctgtttgtttgtttgttttttctctgctttgccttgggcatgattgggattactgagattattcctcttgtctatattgttgcattagtattttaactggtgtccctaatttattatttttccatcttaattcctacaattcaccctgcatactgctgccaagatgagtcatccttacatactgcttttgttatatcattatccttcttgagaaccagcggtggattttcagtgtctatcagatgaaatccaaatgctttagcctggcatctaaggcccaggacagtctgtccccacattaccttttcaactcagttctaaccaaactgttctactaacagttccttgaatctgtattcattagttcatttaaaaatactcattcactgattctcctttatgcctaatgctggagataccaacatagaataaggtacccatgatttgtactttactgtagcctctaagtgcaagagacagaagaaaacaaaaaaaaattaacaacccaaacaaaacaattgcagcttatgacagtttgggagaaagaaagaaatatggtcccttcatgaaatatggtgggagtcaggggtagagaagacctttttgattgggtaatgaggggataacagttaaaccaagatctgaaggatgagaagaatcaactgtgaagagtcaaggggcagaagattccaagcagagggagcaacaagagagcagaggccctgaggctggaaagaatgtgttcgttttaggatttgtcagaagaccagtaaggctagagtaggacccagtagggagaggaaggaatgatacgagatcagatcgggaaggtaaacaggggccacatcagacagggaattgtaggccacggtgaagagttgtgatttatcaatatagtgggaaggtgctgaggagtttgaggtgggaagtgacttgatctgatgtacatgtaaagagatcactctatttttgcacatgtggtgtccatgtcttggattacctgtcctcttccctccaggctatctcctacccatccttcaaaatccagctgaaatcctaccacctctgcaaaacttttgctttacttctgtggaccactagaatacttctgtaggtcctagaataaatagtctttcctccactgaacatccttaatgtaaccacctctcatttatggctttatctaacactactcaaagataattaccttgaaggtggtggtgctttttttttatttaactgtgtctcttcctcctcttcatcccatgcctaaagaaatgctctgatacttaatttttaatatatacttagagttgggaaatttttgcctttttatgattcacaaaaaatagctgttctatagctgtatcttacctccctcatttcctctggttggccttacttccctcttatttcttgaagtcattagtgtatccatttttaactcttcccaaaccattagattttctcccacttagcagagcctcttctgaactctctactataaggtaaacctggaaataaatagatttcttaagtggaaaaaatagggttaatggtagagctgcctttatatacttggaatgttattactttgctaagaatgattattgtgttgatgatttattggcagttgcatgggtaatttttccatgaatagtttatattcattgtatttgatttactaattaattatttagtttattagaaccttcacaagaccccagaggtttagattcaatcagcttgcattgatccttctaggatattagttacttctttgacccaaaggagccagttgctgagccccctgtacctaagtgaccttcagagtcctgttagctttcagtgagatcacattcactctttctgccttatggcaaaaatctgtttctactcaaacagatggtttagctttcaacaaataaaaactagagatcagcatctacttaagccaacagagttggtttgagcctcccactaactctccaaagtctgttattttttattttttaatgttaagctcctcctaatggatttatctttgtacggggaaatcaagaaccttgcactttgtcagaagatgagccacttcatataatctcaagtttctatgttttagaagaattgcttagtaagcacaggttcgactgctctgcgttctctcttttgcagttacaccaactggaaacattggggatcataactttctgtggagtgttacataggtgtgtcagcagttacatgatactttctttgttatttaagacatctgcaagctgaggatggccagtgtcatttcagagatgtacatgccaaagacatggtagttttcattgacattgggaaatactccttctcttgagcttttacaaataaaagttagagagtgctaagaaatccacatatttaaaaaaatctagaatcttgacattgaaaatataaatgcagattgttaattatatgttcctgtgttaagaaagcattcttgctttggggatcttgagtacatcagacaaaagttgcctttgaactcaaccaagtatccatagagatatttgcctctatatgtattattaattttacagaaacaaatgcctagcttaaatataatatttagattaaatagtgagacaaatgtaacctgcacaatagtttgctgctaggaaaggaattgttaggaaggccatataagcagtttctttgaagatacctaggacctatctctttcttttcactctattatgtaggacagaaccttgtgggaaatgtgatctacttggcatcattatggtatggattaggacaaagaaagatgcattaatattcctgtactcatgccataaaatatcatggttaaaaaggctttagtacaaagttatccatggtaactcccttcgagggattggattcctttctgcaacatgttgctctgtggccaaccagtttagatataatcaccgccatgtatagagactgcctgctttaaatagctctggcaatttgtaaattgttccttttctgtctcttaaatccacaggattatatataaatataatatttcttccacatgacaaaccttcagctgtgtgtatactatataccctctgagtcttcacatcccaagaccttccggtttttggaagctattcttgtgacctgggttcatggtgcctcgattctggtcattctcttctgaatgggctctggtttttccacatctgttaaagagggctgatgaatgctgagcatagtggaggatctcctaattctatatagtgtatttctattggtgaaaccaaggtgtttttttctagttacatcatacattgtaccttctgtcaaatatagtctttagctttttcatatatgttactaccaagctttttaattttatttgctgatttggatttttggcctgaatttagaactgtgtttttatcctgattagatacagtttttcattaagttccttactcaataaacattcagagaaggcttccctaagtccatggaataggttaggatcccttcccaactttatgtacccagaatactccaaactttcttatttttgtaacattcatcttacttgtaatcagtagttatcatcaacttccctgctaaattggaggcttcttaaggttaggaccttatttattcaatattctttgttattcctactgcctgacaagagtaagtgcttaatacatagtagctgctcaaaaatgtttgttgaattgaattaaatatatgaagtatctatataagccaggcactgtccattgtatctaagaaaaaaatgtaattaattaaatgaacacacagtgaaatttgaactgaatcttcaatactggccaagtgaatgaggcattctgagcatagggaacagtataagtagggatatcagagaaagaaaagtacttagtccatttggggaattaaagttggactaaagtgcacatggatcaaggtacagatgaagctgcagaggcaagcagaagccagttcatcatggccttgtgtaggacatgatacagagtttgacttaagcctctgagtaatggggaactattaaaatattttgagcagggaagaggcacaaacagagttacatttcaaaagatttccccagcagcaacataaaagatagattagaggggattatgcttttatagggacaacagttagaaagttatcatctaggcaatagatgatgggtagttcatatttaaaaaaggattctttctgtatactatctattgtgtgtaacaaattactccaaaacctagcagctgaaagaaaacaaacattatctcagacagtttctgagggtcaggaatctagggccagcttagcagggtgattctgcttccggatctctcttgagattgaagtcaagctgttgactggggctgaagacttgattgggtctcagggatgtgcctccacattcactcacgcagcaggtggcctctttctggggctgctcacaacatggcttccccaaagcaactgttccgtaagagtgagaaagcaagtgagtaagagcactcccaagatggaagccactgtcttttaaacttaatcttggaagtctcataccatcacttctgctgcgtgctgttggttacttagaccaaccctcgtacattgtgggaggggactgtacaagggtatgaataccagaaagtggggatcatttgggggcatcctagaggctgccttccatgctgcttgtcaaagaatgtaaagagtaagtctacaagtccataatattttgatggcttatggagataagagggcagaacactccacctagaaactatcctattacctagagcaggtaaataaagtcatttgcttgactgaaaggtaagagggttaaaacccaccattctaaatgtcaagtaatagttacgttgcagtctgcttagttttatactataaattatgatgatttggttccatgtttttttttagtataatgtgattgctgttcagctttatattcagcgcatagcactatgccaagtaatgtacaggtttcaaaagaagactaaaatgtgattcatgccttcagagagttaatttactggaaaacaaggcatacatagatcatagaaaatcttagaccccagagaaaacttaggggagtttaacacaacagcctcatgaaacagctaagaaaacgggttgagggaggtgaatggctgatccagcccagctactgacagagctgagaccagatctcagacctttaggtctgtaggcaagcattttatttaaatataaaatgtaatttgtttacgataccaagaacattcttttttaaatataatgtaaaaaacatttatagagacagggtctcacggtgttgcccaggctggtctcaaactcctgggctcaagcaatcctcctgcctcagcctcttaaagtgctgggattacaagcgtgagccaccacaccaggccaagaacattgtctgaggacttaaatcatttttctatttgaaatcagaatgacttagtatttgatgtggggaaaggcaagacataaatgtgttagaagacatttctgtcttctcttgaaagaccaactcatcctgtcactgattactgtgtgactttgagctaaattacaacacattagtaaatacagaagaaaataatgagcaatgccacatcccttgcattttttaaagcaaggaccaccctaattgacagtgagatctttatattaattttcccatttaaaatagataatattcagtgttcgatgaagaaagaattatggggtagattatgaaataataattggaatactattactgttaatagtaaaaaatgtctgaactatactgttggaataataagagtagaaatgagtaaaattaagtatttacaaggtttaaagtattttggagttttgtttccttttttaaaaacaaaatgctttttaactgttcattgcctatattaccaaatagttttaagttgtacattcaggttcagctccccttttttgagtacccaccatttatgttaagtatattactgggttctttaacagatataattgcatttggtcctcataaagcctatgtgagataaacattttccccattttacagctgagataactgagaaattaagagaaccacaactgaactttctgcatggtcctttgaggtcatttttctgaaaagcaagtgctaacttttaatagtgtctttagcctttccctcaggcaacagcgtatgactaagtcaagacagcagaactaaatacgagtttatgttaccataatttcagagtaacagctactgttttatgttctggtcatctattacataaatatttaatactgagcacataatttggcatgatggcagcaaaaagatgtctatcctggagtttccatgataaaccagaaaggctttttttccccaccagtatgttaaaatatggagaaataaattaggagatggtaagctatagctttcttatcatcttaagtttacctaattaaagcactttaaaataaattcattccatccaaatttagcagccatctattgcaaagtttgcttcctttttccatgacatttaaatatacaaaagcctttttttttaaaaaaaaagcattttttagtaggtaaatgtcagtcactttcttaaactagcctgtcctagaccaacagaccagttctactttcaaaacaaaacatagcatttaatagtaaaaataaactgtcttctcactaatgaatttactgtctgcatttccatagatgtggccatgtgttttcccaggaaaactggcttgaactcaaactaagatagctactaagatccatttagacaaagtgggctataaacatgagaaatcttccgccccctattctgtgtttggttaattttgctgctctcatacattctagcaatgtaccattctgttctcccttttactccagggagcctcatttggcatatagttagtcatacgcatacacctttgaaaacagtcaatgtaactcccagttattaagaacctgatgggtgctaggcattgccttatgaactgagaggtacaaatatgaaaactatataaaagctcctgccccagataaactatgatacagaagaacatttgttagctactttttaggtgctgtgtatcaatcagttttcttagtttcaggtgacagaaactaactctgggtaacttaagtagaatttctaggagggccaaagaatctgacttggaggtacggtaaacaaaaacaaagtcctaaattacaccacagagctggacatagaccatagcttacatcagtgatagtgctgatcctgaactgtacttccagaaccaaagccatggctggcccttgcaactagataccactccttctaggccttctagggccacccttctttccagaagagtctcctttgcagtctggagctggtgcatctgtgtggcagagcctaggccatatgcctgtaccctagttacaaggaagtctgggaaataaattatctggtactttatacacttaactagtaggaggtcagctctatctcacaagataggaggttctgtaaacctaggtatgcagtcaggcactaagtggccaaaaacttctatcagcagcattttgaataatcagagaagattcaacacaggagatgagaaccaggaaacaacaaccaaaaaagaaatatggtgagtttggccttaatatcacaaaaagatgaaaaaacaatgtgttcctaaaccagtttacaaacccacagttagtgaaaggctaggtgatagcttatattctccaaagttataaagtcctaaagaatgtagcctctacttgagacccatttggtctgtgcaggtacaggcactatcatctctctctgtaaagggtcagtatgatgtttaggaaagcagcccacatttggagtcaaagccttttgttcttaccctgcgcagcccttaaccagatgtgtgacctgtaagcaaggagttcagttagtatcctcatctataaaatgagaaggttgaggtaggtgatctttaaagttcccccttggctctaaagttctatactttgtacatgataggccagtgacaactaatgtttttactcaagccgattgtatgttttagaaggcaaataaattatgagcttattttttgatgacagtacattttcataaacccaaaataattaaatctccacctcccacttagtttagttgttttgggttttttaaaacaattttattttcccacacagtacagtttaagcattcaagttgcagcaggggaaatactcattgaatttgtcatcattatttttggcttctatctttatgagagccattttagttttctagtttcagtgatctattttttagattttaagctacaatatattttaacatttgagtattaaattgcatttgtcataatgaattagaaccttacgtttctttcaaaaatagctttatctcaatatgaaatgcaagattattcacatttattataaagaggagaatttttgagacattctatatccactggtcagttactgttttgatttggtgatggaaaatcatagcaaattgtacatttaaagtaaaccaaataaataactttatgcagagatagagattgaagtagccatttggagatgagaattttatctccatgccttcaagaaagaccatatgtaaaccaggtcagaaaaataaaaattacaccatatttattttaataggaccatcttagaatacaagacataacacaagagaatttatttctggaatgacgtgaaggaatttattatacaaactgctccatctaaaacatgttcctaaaatgtaggttcgtagaattttttttttttttcccctggggacatagtttcactctgtcacccaggctggagtgcagtggtgtggtcttggctcactgcaaccttcgcctcccaggttcagtctctcctgagtagctgggattacaggtgcacaccaccatgcctggctaatttttgtattagtagagacgggagtttcaccgtgttggccaggctggtctcaaactcctgacctcaagtgatccactcgcctcagcctcccaaagtgttgggattacaggcgtgagccaccgcacctggctggttccaagaaattctaatatttgttctgtttttaaggagaaaaattattgaacaacttacctctaaactatagtcctttaatgataaacactactgttaaaaaattcttataattaacataatctgatattgttacttaagtctttgaagaaatagagaaaaactggctaacatcccttatgactgcatgtttttatatattaaatagcagtatcgaattgccttccactatctttttcagacgaaataatatatatttaaaccttgcaagccttatccttttttatacttcttttttctagaacagctttattgagttataattcacataccatacatttcacccatttaaaatctataactcagtggtttttagtacaattttagaacatatcaccccaaaagaaacccatccccattagcagtgactcctcattcacccctttccccactccagtaatgctgagcatctttttatgtgttactggccatttgtatatcttctttggagaactgtctattcaaaacatttgcccattttttattggataatttatctttttattgaattataaaaattatatcttctaggtacaagtcacttatgagatatatgacttgcaaatatttttactcattctgtgagtttgtcttttcactttcttgagcaagccttatcttgagcaagccttattcttaactctggttaaattttggttttctgaacattttgctaaattttctaaaggtctccagttgtggagtagcctgaaatgaatactttattttttgaaagtggaactaaactctaatttaagtctataatagaaaagagtaattgctataggaaccaacattttttttggttgtttaccctgtgccaagcattgtgctgagtgctttgcaaccctaaaatatagggttgttattcctgttacatagatgaagaaacaaaggcttgaagaagttaagtaagttgcacaaaatcaaaaagtgctaataaatggtcaattggaatgacaatgcaagttattttttttgaccaactttcacattttatgtggggtgtttgtattccactattgtactttttaagacaatattattttacagcctcattttccatccactacaatccctagattttttcaggcatattggaaccgaatcattcacttctgtctctttaaaactggaatttcttggtttctgaaccaagaaatttgatttgatttctatagccttttgattttttgactgtcccttccaaattggccctttttaaacaaattataacaattttcaaagctaaaaaaattctaaaggtaaacttgccattaaaatgattaaatgtaaattgcagaccattttaaatgtctttttgattagctactattaagaatttagctgatctacttcattaaaatgttatattagctcaatgaataattatatatttctgtgtaacaaattacccccaaaactttaatggcttaaagcagcatttgttatttcacagtttctttggtttaggaatccaagtagagtttagcaatgtggttctgctctaggtctctcatgaggtttaagtcaggctgctggctggtgctgcagtctcatttttggggaggatctatgtgcaagctcactcgtatggttgttgggaggattcagttccttgtgagcttttggactgagacctgcaattcctcactggctgttggccagagttctccctcagttccttgccatatgcgcctctctatgagacagcacatgacatggcctctggctctgtcacaatagcaacacaagagagtgtccaagatggaagccatagtatctttgtaacctaatctcagagttgatatatcatcacttttcccatattctactcattagaagcaaactattatgttcagcccactctctatagaagggaaataccaagggtatgaacaccaaaatatggagcttactgagggccatcttagaggctgcctgtcacactcagtgaatctattgtttaatcatggagaatccaaaagtcatggtgtttttatatagaacgttgatatgtacagttccatcctgcaaacaagtgataattttatctgaaaatatataaggaagtctctccatcctaaaatatgcatatgtgtatatgtattatttttaaagcatctttagtctgcatatacatttgctacttattaatctgttttatcaagagacaacattaaagttgtaagacacaattagaatagaaaattttatgtgtaactttatgttctccccttgacttataaagattgctattgaattttagtattggaaaactttggccaatgtaaagatgattttaatttgaacatgtacaacatgcaaaagaatattttttctccttaaatcatactttagaagtcaaccctaatttaacaaaataggtgatcctgaatggactttaattcatttattcagcaaggcttattgaattactcttctaactcatcatgagttacactcataataaaagtctgcactcctaattttggcctcccatagctcagtcaatctctgtctatgtttccagtttcatttcctattgccatctcccttaaccttccactccagcacagtttttcttgctcctccccatgttgatgctcatgcatgcctcagggcttttccatcttcctgaaaacctcttacccagatcgttacatggctcgcttcacttcatttacttctctgctccagcatcactaccataaagaagcatcccaccagcactcttcacaatacagcagggaccatcaaaaagcaagagacacaataaaaatgatagttgaaaagattaatctcatgacagtgtacaagataacttgtacgtaaacaggctggattagacatggatgagtgggggccacaattaggaactttcacattcattcaggtgtgaattgataatgatccagttatgaccaccttgggcatgagtaaagctacacaaacattctcccaaaaccaggtcttccctcggatttgtgatgccggtaaattgttgccaccttcctccatcctcctctaacagagccatttcagaaccaaaactttttaaagaaaagtttgaaaaaaataagaagcaccaaagaattagcaggaaatggttaggttttaggactagaaaccacaatgcagtaggggctctgcaagaggaaggagtgagtgcttcaaagtgacatagcagctgtgtgctgttgtgcctgagactccttccaatcctagatgtttcctagtggtgctggcaaagcttctgttggctgtaccacattctttcccaatccaactccctctatgtaaagtctcataattctaaggatcctgggttcaaatgtaagtttcttccgtagtagttaccatttgggtgtttctgcttcttctaaactcccttctaattgtttttcctcttgtttttaagctagtgattttttcccctgtattttacatatgcttatggaaagaacagatatgttttcatggcacttagcatgttataaatgcattgttttccatggagtaagatcattctaccactgagagcattaaatccatgttcctaaggtaacccatgttttcctagaaacaggggaagagtcatgaccaactttcacattgtctgctttgttcttggggtatcatccattgtgataaccattcccaagaagtttcctccccaaaacagaattacttctctgcctacccttgattcaagtgacctttcattacagataatctggttttatagggaaatctagtaggttctgcactcagttgtaaagaaagacagatgcaaatgggtttcagtaattggtacaacattgtcacaaagctctttagattagcaagtacttataaactaggtggaatattttttattccatgttgttaataagaatgccctaatcctctttacacacttgaaaatatccagggaatgcagagagagacagacagagagatagactcgtatgtaatcatggacttttgagataggtaggtatagatgttcctgtaaactaagcgtttgtagcctcccaaaatttatatgttgaaatccctaccatactgtgatatggagcctttggtatgaggtcagaggcttcatgcatgggattagtgctctcataaaataggccctggagagcttcctcaccccttctgccatttgaagacacagtgagaagatgaatatctgtgaaccaggaagcaaaccctcaccagacattaaatctgccagtgctttgatctagttcttctcagcctccagactgtgaggaataaatttctggtttttataagccatcctgtctatacagtttgtcacagcagcctgaacagacagagacaagtgtaatcccatcttttccttagctgtattattaggttagtgcaaatgtaattgctgttttcgccattttaatggcaaaaatcacagctacttttgcaccaacataatatttgctcacttttctctgttgtaattttctcatatgagactgtaggaaagaatgatttaatatattctataaagtgcctagtaatataataggtccagcatatgaaagcattcataataggttctcagtaaagagtggcaatgctcgagcatttctaaagaaacggaattgattatattccattcctttttcagacagttataaatgttagaaatttctttctgttactgctccagaatctgtgcttttcaattattggttctaattcagtatttttaggcctcagagaaaaagccttaatgccgtcttcacgtggtaggctaccaggtctttgaagatggccattttgtatcccacatcttctccacatctgctcatagaaatacagtttcttcatttgctcccttatggtttaggttcgaagcaactcagaatggaacacaacgctactggtgtgttaattagcaggtgagaatggaactatcaccttttttgttgtgttcttaacacaaccttagttggcatgaatttgaggagcagttatatttcacctttgacttgtcaaacttacacttgactaaaacctacagatgtttttctttttaattttttttaatttttaatttttgtgggtacatagtaggtgtatatatttatggggtatgtgacatgttttgatacaggtgtgcaacatgaaataattacatcatgaagaatgcagtatccatcccttcaaggatttatccattgagttgcaaacaatccaattattacactctttaagttattttaaaatgttacagatgtttttcaaacatgtctctgttctaccctatctctctcatcatatatttgtatgggattttacattttgacatattaaatttcatcttgttggagtttgctcgttttcttcttacctatgaagctgttttgggaccctaactatgacagtaagtcacttggctatgcacttaatcagcatgtgtttaatatccacactcacatttttataaatatttaacaggaagggaaatttatacctccaaacccactctaatccctgaactccaaatgcatgtaaccaactgcctgttaaatatcttcacttagatgattcctgtcagttcacacttaaccaaactgatttccaccctcaaccttctcctgtagtcttctcatcctagtcacagtgaagcatatccgtccttcacattgcacagccaaaaaccttccttgcagtcatccttgacccattttgtttcctcccacatcccatatctaatccctcagcaaactctacttcacaatgcatcctgagtcatacctttcttacttcttaccttcttgcactaccactttggaccaaatcatcagaaatagattcctaacattttctgtatttacccttacattctttagtctttttaaaatattgacgctagaatgaacctgttaagacttaaattatgtcactcctactaaaaatacaaaaattggccaggtgtggtgaggcatgcctgtagtcagtccctgctactcgggaggctgagttgggagaatcacgtgaacccaggcagcggaggttgcagtaagcagagattgtgccactgcactccagcctgggcgacagagtgagactccctctcagttaaaaaaaaaaaaaaaaaaaaaaatcaccttaatgccttttatctctggttacttcaacaccataattaccataaataattcatctctgttggaatatttgtgtcccattaaaattcgtatgttgaaatctcttcactaatgtaatgatatgaaaatcagcctttatgggggtgattaggtcatgaaggcagagccctcatgaatggaattactgctcttataaaaagacaaaggactttgcagggacgtggatgaagctggaaaccatcattctcagcaaactaacccaggaacagaaaaccgaacactgcatgttctcactcataagtgggagttgaacaatgagaacacacggacacagggaggggaacatcacacatcggggcctttcggggggtgggggacaaggtgagggatagcattaggagaaatacctaatgtagatgacaggttgatgggtgcagcaaaccaccatggcacatgtatacctatgtaacaaacctgcacgttctgcacatgtatcccagaactgaaaagataataaaaaaaaaaatcacgccactcctctgttcagaacttaccagtagctttccatctcactcagagtcaaagctaaagccctgacaattgcctgcacaactctacatggttctgcctccccttcccacacatgtacacaaacacatttgcttttctgacctcattttctagccttctacccttgcttcctcctctgcatgcacagagtcctctttgctgtcccctgaacatgccaggcatactcccaccttagggcctttgcatctactgttcgcctgtctggagtgcactttcttcatcccatgcactatgaatcttccttctgctctcatttttgtttaaggtattatatgagactgtgctactaatagaaattatagggctcttttggctagtgtcaagtatagatttgcgttttggactcacataactgaatatgttagaattacatctaaagaaataattgcctataaatggagtattgtgtgtgaagagttagagtcctgccccatctcctttcctattaaatgatagtgattttcacagtatctgagatagccctttgaatatcagagaaacataagagtgtaaagatttcaaggaaatggtcatatttttcagatgagaaaagttcaccaaagattttacccattggtgccagaaatgtaaggcaggcaagaagttagtagaagaaagtcatcacactgtaacaattattttttttaagttgtaggcactgatttccaaatgagttccataaaccactgctatttccatttgtagtatagcaataggttgtgatactaaccttaaaggtctcaagttcaacagcttattatgaggaaagctgccattcctttaagaaggtgagtttctattatctttttaaagagagaattactcctttataaaaatgtaacttcttcatactgtatttcagatctcttgctttttagtaaaacttttcattgcagtgggtttgataataatagtgctcacttttaaaaaattccctaaattttagtttcccctccagtcaccagctcacttttctgtgatcctctttagcagaactccttaaaagactcatctatacttgctgtttcctccttctctcctgctgttctctctataacccactccaaataggctttcatctcgtcgctccactgaaactacttatcaaagtttccatcaccgtcatgctaccatattatcttctccatcctcatcttattcccagcaacatttgacatcaccttggaacactttatttacgtgatttcactgagacctcctgtctggttttgtttttcatcttatttcattagatgctagttctcagtctcatttgactctttctcttctcccaaaccctatacattgaaatatcccaaggcctagaccctctagtctttggcctaggtgatctttttttatatatgtattttaagttctagggtacatgtgcacaacgtgcaggtttgttacatatgtatacatgtgccatgttggtttgctgcacccattaactcgtcatttatattaggtgatcttattcaatcacatggtatataaattacaatataggctactatgacagaggccccagaatgaaggtgcctaaacaagatgaaagttgatttctttttcctataaaagtgtgggagcttgtccaagactgataggatagcttgttagtactggagacccacgctctttctttcctgcactctgctgttctcaacatgctgtctccatcttctggtcccagatggctgcttcagcccctgcatcctgtcagtattctaaccagcaggaagaagaagataggaagtgagaacgtatcccttccctttaggactcagaagttaaacatgtttcatctgctctcatttcattggccagaactgagtcacatgatgataacttgctgaagagaatttaggaaatatagtctttaggtaggtagctatggcttccagctaaaatggagcagttcttttactagaggaaaaagagcgtgatggattttggaggacagggagcagtttctgctgcacatggctttaaatactatctatgagctaatgtctcccagatttgtagctatttcctgagttcaggactctttcctcagctgcctccctaacattctcgaacacctgcctgttcaaaattgaactcttcacttttctccccaaactcctacccatcttaggtctcccaggtgctcatgccagaaacttagaacagtcttgattccttgccttctctttcatccacttttgatccatctgccaatcctattaactttaccttcaaaatggactccaaatccaaccacttctcatcagatctatcttccacattaccaccaatgacttattttaataaaatacatatccccatcctgtttcttacttccttaaaaccttcctctgtctccttattgcctttgggataaattctaaaccctgtgtgaaccaactctttctatctctctggcctcattttcccattttccacttatattttgtatttcagtactacctagcacaacacacctcatgacttgatgtatttactaatgcttatccctctgtagaatttcccccacctcagacctggctgaagaatcccttagtctcaagtgtcacctccttcagatctttttttttttttttttgagacagagtcttgctctgttgcccaggctgaagtgcagtggcacaatcttggctcactgcaacctccgcctcccgggttcaagcgattcttctgcctcagcctcctgagtagctgggactacaggcatgtgccaccacacccagctaattttttttgtttttttttagtagagacagggtttcaccatgttggccaggatggcctcgatctcttgaccttgtgatccgcccacctcggcctcccaaagtgctgggattacaggcgtgagccaccgtgcctggccagaaaatgttctttgtcatctctccacctccccaggctaggtaggcaccttcctctttattcttgttgcaccatatgcatacccgtatcacacctatcctggatgataccagtttacatagctgcctcttttcctagatgcaagtgccttggtcaggggcaagggcttactcatctctcagtgcccaacacataatagctgctaagtaaatatttatgtaattgaatcatattgatcatgggaacaaactcccattgggagagcatcacctctgccttacatatctgagaaaagcccttgtttattgtaccctatcaactgaatctgctgggctatatattaaagtgggtattttaggccctgcttaaaaaataaaggttaaattgagcatattcattgctctgttaggattacataatgcctgatagtgcaaaaacatggttgttgactgaactttacagttgtctggggtttgtgaggcccagctatagtctaggtagctttgtgtgtttgaaggtattctgactagatgagtcagtagtttaaaagtaacaagtcactgttggtctgtgggagaagttgtgtggacttagacttgccttcactgctttaaaatcttgctttttaaaaaatcccaagaaaggtaggttctctttaaaaagtttatggcctgtatttgctgtcataaaccaacccagttttcagcctttagccgggctccactcccttagagatgaatggtaacccatataaactacatggcgattctagttgtttttagtcaggaaaagccccaaggtttttattaagaagcccagaaagaagagatgtcaaggattccggtgagaagtactatgttataagaagcagattaggataacttgtcttaaaaatgaaaaagggatgagaaacttgacaagtttttagtgctttcttagcactaaatgatgacttaaagaaagtttagtccttgccaaattttcccctttggaactgtttccactgtgtgatagagatctgccgctacgagcttgtcatcattctcatccactgtcttctttgtcttcttcgaagtcacgtcctactcctcttcctcttatcttttttttttcggcggggtgggggggttttgtttgtttgttttttgcactaagtcatagaactgaaaagactctgggtaatgttttcaaaataaagccacattgtttccaatacaacagctttctctgggttctttcactgcctccttaatgtaagtcttaatcacacttgtattaacagtagaaacactctgcagtatctcgtttcatacagtggtgttagaagcattaactcctcagccctcataccatcacaggaaaacagcaatcattgttaacccccatccattggggagatgaagaaaatgagcaaactatgaagaatgcagtttatttcgtctccataagactgtgaggcagtggaaggtaagggctagaccccaggatggctgattcctagggctcttttcctgtgctccagaatgcagtgacacctttcagttgttgctgtattcagaggtgtgtgttgcatgtgataggtacagtacttgacattattaactcttgcaaccaccctatgggttaggtattaatatccccatgttatagatgaagtctgtgattccaaagcctgatgtctctccactgtgccacacacactgactccacacaataacaattactcccatttcatatcacttgacatcctgaaagtcctccacaaacatcatcatatttaatccttaagaactttggaaatatcagtgattatcacacactttgaaataagcaagtcactaatcaatgtgatcttattaaaatttaagtcagttcatgatgctactactccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccacctccagggttcaagtgattatcctgcctcagcctcccaagtagctgggattacaggcatgcgccgtgacacccggctaatttttgtatttttagtagagacgtggtttcaccatgttggccatgctggtcatgatttcctgacctcgtgatccgcccacctcggcctcccaaaatgtgggaattacaggcatgagctaccacacccagccccaaaacctcatcttgaattataattcccacatgtcaagattgagaccaggtggaggtaattcgatcatgggggctgtttcccccatgcggttctcatgatagtgagtctcacgagatctgatggttttataagcatctggcatttcccctgcttgtactaactcagtcctgcccccttgtgaaaagggtgcctgcttccactttgccttctgccatgattgtaagtttcctgaggcctccccagcaatgtggaactgtgagtcaattaaacctctttcctttataaattacccagtctcaggtatttattcatagcagtgtgagaacggactaatacaacctgtaaggagagtggtccgctggtttcctctccagcctcatcgcctcctactcttcccttgattctctctgcttcagtcacactggtcaccttactattcctcagatactcagggcacgctcctgcctcagggcctctatacctgctcttccctctatatgtaatgccctctccccagacacctgcttgactagctcccccagttctgccaggtctcgaacaaaaaatcaccttttcacacgcacacaaaaagccatcttgctggtcaggacttgccagaccactctttgcaaaattccagtctagcccctaacatgtcatatccaccttccatgctttagttttatccttagtctttatcattttcaaacatactgtgtatttacttacttctctcgcttaccatctgctcactagaatgtgaatgctgtgagggtagggctttcatctgttttgttgttcacttctccactccagcacctgtaacatactgggcacatagcaggcactcaataaatatttgatgaatgaaaacagattagaaaatagaaagtcaaagaagctaagtgagtttccccaaaatgatatggtatagcagcatcaaagctaaaaccaagactggtcttctgatccacatgcagtttggtgctcagttaggccagaatccgaaaaagttgtaagttaagttctgaaataaaactcagccaaataaagtagtttggtgtaatttgcacttttaaaataatttttcatcagttactatatcatagaggatgaagagcagtccttcccttggactgtctccaagcagcaggaataatgagaataagttacagaacttaaaataaacccaggtgtttctgggcctgagattcttaatgtccacaatgaagggaccatgtcagttcagagctcttcacagctctaatcttgaatccatctcatggatgaatgaaatgcctggttttctttgtaatttgttcagttctatgcatacaaggtatgcagtttgttctgtagataaactacacatgggtatttctgtaactctccttttatcatcattaccgtctgtttgattctttcccctacatttgtgcaaaatgtaggcttgtcatctcactgtgttgtattgcaggatcagcaagcatgtcaaggatctcatgtgtcttctaatctcatgcagcctctgctgcaaggaagctctcaccactgcctcctcagagttatccaatgggcaaagaaaccagaaggcaggacgacttaaggccagggaactaaatatgcaataatggtgtctgggggtcaggaaagcaagtgtttgtacaacatggcctggcattctttgtcactctgaattaaatctgcacatggtaatcagacctaaaagaagtgcaccaataagtcaggccattggttatccagctctatacaagttttggcaaagaaggttaaatgcagtgtttggcattgtatctcatcctggttcatttcttcattaaaaattccctctgtagagagtaaaatacagttattttgaggtggtgtccatatccttaggaacaggaggcaccgtcctaagctcctttacacataccagctcttaaatacacaacttgagtaaggtttataattctcatttctattatatgctgcacatggcttatgataaagtgaacctgcaaatgatagcaagatagaacaagtctgcaaaagtaagaatggcacgttaattacagaagttggatcctatcagtaatttaaaccaaagcatttatttgaaaacaaaatgaaacaaaacaccaatgccctcagtcaccttcttattccattcccatttgctccagtaggaattaatctctttatttctccttacccttgagcacttttatatatctgcacttgggttaaaggcagttctattaatttctttgtttggacagaagtttccttaatttaccataatcatcactgttgtcactatgccagtccagtatgtttggacttcacagataagtcttgcagtttccaaaacaccatcccatccttactgcgtttattcttgaatgacttttcactgggagatagtatacttatctttttcaacaaaactacaaatgggatcctaataacaagtttactgtttgttaatttgtgttagatataggcatactgtcatattttcctgtaatttttcatatctggtcttgtgaactgttactagtatttttcttccatatgtattttacctaccaacttgattgtaaactgcttaaagatagaagctatgttatataagcatttcacgcatgctggctcaatgaatcacaaataattgggaatttggttagacatctcatctgaacagtccctgccctgataccaccctgggacattcagcccttggccacctgctttgatgagcacatttctatgtctcctgcttaagtacttacgtaagatgctactgagtacctgacttcagacctacagagtctgtttttgttttgttttgttttcttttgttttgagacagggtgtcagtctgtcacccaggctgtagtgcggtggctagatctcagctttctgcagcctcaacctcccaagctcaggtgttagcctcctgagtagctgggactacagacacaaaccatcatgcccagctaatttttgtatttttcatagagacaggagtactccatgttgccccagctgctctcgaactcctgggctcaagcagtctgcctgctttggcctcccgaagtgctgggattgcaggcgtcagccactacacctggcccctgcagagtctttatcaaacagaagtgaatattaggaggagcctggggaagaattctctttgatttaccttggtgttaacactccagcgatacaactatggatcctccagaaagactatgtttttgctgtatcagtgccacctattaggaattgttccataaaagagcatgagaaactctctggagttcaaaaagtcaaaatgacatccttgctaaaaaatctctttatggtttgagttccatagttacaaccaggaatctctgggaatttggtctccaagctcttctcagagcatgtgttgcatacattctgcaaagcccttgggggatggagcaggcctagtttttggttttcagcagtgtttgttatcttcacagttaaatggaacactggaatgtgatatttactcaattttgcccatttttcattcagtatttataatttttaatgtggcaggtcttctaaaaaaccaacaaaaaattgctgattttgtgattttagtttctaaaacaaatgaaagcaaaaaacttctcgcccctgaactccatccctggctgttacccttcattctctgttcttactctttcctaagcaagtaagatatgacatttattcatcagagcattttatggttaattcactgttcaattttctaaaataccatttggcttcttacctacagagctatagcaccagaattcactcggtatatgtgtaagaatgactgcttccattttccgagagaaatagaaatagaactaagagcagtgatttccttgtgttaaagaaaaattattcatgacccttgttgaaaacaatagagaagactttattcaagggaggctatgggaacgatacaaggattacggcagtggagtcttgcagtgtgggagagagattgggctggagtctgactctgacaaggacaagtagggatttgtagccaaggagcaaggtgtgggggtcagtagatggaaaattactaagtggaaacaccaatgtaagggagattcttgctagatggactcaacagaattcttgctgaaggcaggccagggtgattagatgtcgagggtaatcagataacaagggtggaggatttttgttaaactttagccggattcttgctcaaactggattctgtaaggacagagagggaagcccagggtcaggcccatttgagcagggggcttatggagatctgattagagttagtttaatgagagtctttgtcacctgctgaaaagaattcgtttttatggctcagaataatagtgtaatcatagcaagagatgacttgtctatgtccattttataataattcaaaaatctcaataatttctgaaaaaaagaagcatttgttatcagagtcataaatgttgctatttatatgcttaagtagtagtatatcagaattcacagaaaggaacaattatttagtgtgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtctcagcctcccgagtagctgggattataggtgtgcgccaccacatctggctaattttgtatttttagtagagacagggcttcgccacattggtcaggctggtctcgaactcctgacctcaagtgatccacccccccgtcagcctcccaaagtaccttaagccattccttttgagactctgaagaaagggtacgttcctaatgtttttggtttggattatcagttcatggcagagcagtgccttaattgtacttggtagtgaccactactagttgttcaatcatgaatcctccagtactttttatctgaataatatggagatcctttcttagtactttgttagacagcttttctagatcggtttccaatagtagcgaaagagaaaatcctttatcccatcttttccagaattaatattttctgatcacttcatttgcaagagtaaagtaaatattgaaaataccaaagtgagcttcagtcatttataagaattgtttaaagaaggcagtcatcagttacttttttcacatgattgtattgctgagagtagtatctgcattagtctcttaagcaagactttaaaaaaatcctactgttgtccccacctttatttttgaaagataaacttaaaatttacatttttaaaaatttttaaaaagtaaaattttaaatgactcaacaggtgattagattccatctaaggatgagattgaattcacgatctcagattctcaacatatatttggccttacctattgttaatgaaacttgcctgcaaggagggctgcatgttgcagaacttaaacggagcaataaaactatttataaatccagacacctttatgaggatgtttccttggtttcacttatgtaagccgacaaaacgatcagttgtaaggaactgaaggaagtaaacacttgaatgtactcaaatgtctaggctttgctgaacattatatgattaaaaagcagccaagttcagcgtggactgagaactgctgacaatggagaacatgagacccagaatggcaaataatgtttcagacattgacttgtcagactggtctccaccctgtacttaaccccattctcacccttttttggaggggaaaggaattatctagttaaaaactgaatctataggacaacctgtctctcctgaggcagctgacttatgctaattcttgcttagctcagtttcttgagtttagcagaggagatcactgtcacccacaccctctttaaatcagcctcctgtggggccatgtctacacaaccaaggcctcattcattcgtttattccaaaatatatttattgagtgccttctgtgtgccaaggactggggattcagtggtgaataaacagataaaaacacctgtccatagggaactgatattctagtgtgattactgctaggagtgtgtctgagttgaattgaggctcagaagtagatgtgtctgagaggcctcaggagtttggaaatgggggtgtccaacctgtttctttgtcctccaacaggctttattacctgtgcaggtatggtagtaagtctgttttgcatttctttaaggaatacctgaggctgggtaatatataaagaaaagaggtttatttagctcacggttctgcaggctgtacaagaagcatagtgccagcatctgcttctggtgagggcctcaggctgcctctactcacagcagaaggtgaaggggagcctgtgtgtgcagaaatcacatgatgagagaagcagcaagagaaagagggaagatgccagactctttttaacaaccagctcccatgggaactaataaatcaagaactcgctcacccctgagggagaacattaatctcttcatgagagatctgccccatgacccaaatacctcccattaagccccacctccaacattagagatcagattccaacatgagatttggaggggacaaatatccaaatcatagcaggaagagacactccctcctatgaaaacacaaatttgaagaacagttgtcttcagtgttatacaaactgctttctgactgcatataagagaattccgtttatggggttttggtctaaaattatagtgtcatgtcagatctcaatcattttaacttaaggcagttattctagcctttgaatacatttttcccctgaatattcgtggtgttgtgtgacaactatccaaaatattttaagattccattttatcagtaaaacatatgccaggctttttaataggcagagagtaatttggtagtatcattcctcttatcctttaaagttccttcatgctctagaatttaattcagtgattccttgtagaagctagcctgcccaacaccatgggcagagatattgcagagaatgccattttgatactctgagaagaacatgtaattcccatgccttgattttaaatgcaattaaagagccatagtttttcagaagaaagagtactctttggcaaacagtagtcattgcagaggtttggtccttaatctgttttcagggtagttatttcatggttactggatgttatagggacgtgcttctgaacattggtttagtttttatgggtcttgaatttcagattgtgacataaaacagttttctagtacatggtgccagtgttttaatcattagaagccagaaagtaataggccattcctcatgttggctgatgaccccaggctaaacctccaagctgtgtttaggacagtgaatcaggttccagggctagttcactcagccttcaaaatgattttttaccccaacccagtcttctcatgggcccctttgtacacacacctgaagttcacttgttttctgtttttgaggcactaattgtaactacataatcagatgtcagtttggtagtctagaaactctatttgaagaaaatacgtaataattttgttagtcattttctttttaatggtgtttcaagaagtgtttgagatcgatgaaatgatattcttttctatgatctaatgaagaaacctcccacagttgtgggcagcatttttggaaaagagtagccaggtccagtgaaaagcaaatctaataccattagtctttgaactttaatggaattagccagatttcctgaaatagtcctagaagactatcaaaagccctaggggagctaaacttgattgaaaatattataggaacttgaccatatatagcttagacctctgtggcataggctgctaaatttcccaagggagaaatgtcattgggtcacctttcaaagagtcattgttgatggttatgaattcaacagataagcttgaggttgaagagaagtgactttgattgtgttttagggacaaggtcttaacaaagtattgtctaaatttgtatttgaggatattagaaatccagaaaccaccatttctggaactattctgcgatggcactttctcaagttggagccaagaatggttgaattttcagaaagcaaaggatttcttgatgacttgaccagcaagtattagaggacagccttctcattgctgaaggttgtgttctatattttcatcatctgctgggtgccaggcactgtgctagctttgggcatgtagtggtgaacaaaacagatgttctctctgaatttatggagtggatagtctagtaggggtgacacacattattaaataagcaaataagccaaagtttaattacactttgtaacagatactatgaaggaaaagaacagatatgatttgggagtgctattagagttttggtcataggagaagacctgaggaaatgcatttgtttgatgatttaccagtattttaaatgtaatttctggtttcacagaacttgagtaagctgcacaagggaaaaaaactcatcttctgtaattcctcccagtttcttaagccactcagtaaatgctgactacggttttgtggatccattttgtggtgtctgttttcctttaggcaatcctccctctgtctaatttggatacagaatctaaatctttatgagtctgtaatagtacctggccattactggtctataatcagtgctcatataattgttgaatgaattagtgaaggttacaaattgagtgtggtttatcagttaaaagtgctctcccaattatctgatggaaccacaaaccttctcttttcccattatgcccctccttcttaacacaggtgttcccagcattctctccccaagagtaataccctatggccccagggctccatctatctcttttctacatataagtcccaagcctacaggttctagccctgttttctcctgcagagtatcagtccccaccccagtttcttactgcttgccagtcctctccactaaaatgtcctcctggaaactcagacgtgtgtgcaactcttccccctttgcctccttaagtctttagaggtcaccttctcagagagtcctcctctgggccctgcacttaaaactgcaagctactctcccatcccacctcaccccacactcaatccctaatcaacttccatgctttttccccccatagcacttattcatcattctctataacttattttctttattttctgtatccaccctctcactctctttttttataagaattaagctccatgaggacaggatttttttttccgttttgtttactactgtgtccccctgtgcctgtcatgtggtaggaattcactaaatgtttgttgaataaatgaatatttaatgttcaggcattatatatatataatatatcataatgcttctattgcattaggagacagtgaacaagtcagacgcttgcactgatctgtactgtcactgtgaatgtaacaaatacagactgatccaagtgttcctggtggtgactcagatatcaggagtgtctttgaccatagatgatgtgattttctgaaatgatagacaattcttgattgaattcagacaaaaacaatgctcccagcaaagtggaatggtggtgagaaaggattctgaagccatactgcttaggtttgaatctctcctgccatttgccagctgagtggctagtcacgtgatgtctccatgtttcatttcctcatctacaacataggaataataataattcttcctcatttaggagcttgttacaagaattagatgagcagtgtttagcacacagaaacactaagtgtttcttaagtaaattattattcagtagcttcgttcctggaaatttagggtatattaaactcatgtaaaagtactttatatttaaatttaaaacagtgagcttctagactaatttagtaataatcaagtttctttttaacctacatgaattatatgagatataagacagttgtcatatgggactgtcctgtgtgtcacagaacggccagcatccctgacccctgctcactaaattttagtaatacccttcaatcatcatgaccacttagagtgcctggaaggttggtggtttttacatacactgttctagcgaggcctatacatttgttttgtgacatcattatagatcatctaactagacaagctctccctatctgaatcctcattgcccagtgtccacaatacccttatcacagtgaacaaattctgctatgtcacagctgaatgtgtgctgtctctttttttccctccctgcctttggacacttcccatcctgaatctctcctgtcagaggaactgtttttaatttatttcagcaaaaggaatacgtggtggtggccagaagctctttgccccatgcatgtgttctcccttaagcctccagaaagattcttgagtttggaagcacttaccccatctgcagttttactgttactcactcagcgttcttcccacttataactgaggggctctagttttaccacgctccctgaccagcttcaatttcaccccacctcaatttttgccaggcacttcttaagggagccaaacttcatttctaaaagtattttaacattattcaattaaatggaacatttataaattggttataagggaaaagatcaatattggagttcccatggaaggtttataagaagaagtgggcctcaaagaattaatagaattggactaagtagaaaattagactgggcagaaaagagcaggaaaggagggggtttgtttgtttgccaagcagagggaaaaaatactaacagaaatgcagtgcatggtgtgtagggatggtcaaaaccaggactcagattgaaaattataagtaagaatggcacagtagagttaacttagggaagttcttggaaaccacagtaaaaacatgacattctaccacttccttgttcattgtgttcccgcctcccttgtttttctgtttgtttttgttgaagaggtctctcgtggtccatgagtgagtggatatttatttaccttccatgcctccacacttgtgtaccccacaccccaggggattcaggcacatatacagcagcactacctgtcaccagcctagtttacacagagaaagctacctctttttagggttagtgtttgattctgaatagaaatctcattatttatgcttctttgcaaagtactggtgaagtcttatcactttttaatattaaacttcatgtaaatgttttggatatttaattgtttatgatcaaggtgtctggctagtgtgttagtcatctcccagctaacagtctcttggcaggccatgcttaattcagttattgcatgttaacaggctgttcaaaattccacattgcctagagtttttccacctccaatgtccagacactttttctggcttctccaaccctctgggcattcagaatcatagtttagtgctcatatttgaagccatttagctctttcctttttatttgcctgattaattttgaatttgaattaatcatactttatacccttttcctgactcagttcagtgttcatctcattctgtttactcagaaagcccagaacataagatttgaaccatttgtgcagtgcccaaatgtgtgctgatggaagagtgaacctttaatgttttgactcccatactatttggttctatttttcctaaataagtcatggtcttttttcattaagtatacatttacaaaaatggttcagtctttgcacataactcagctctcacaattccctaatctaatgttgaccatgttctattttgtcataaaacccatgattttactgctttctctttactagagccctgcatattagcagtgaagacctggtccttaatgaaagtgtggggtccatcctcagtgtctcatatccctgcctgtgttttccttcaggagaccttcctttccttcctatctaagccagagtcttctctgtttccccagttaaaactcgatctgatagtttttattcagactgacaggcaagttgtaggcaacgattgaaggtggctttcttcccaggggtggccagaactcaaagtcttaaagtaaagggtagcaggagcttcatctgccatgattaagaggagttctgggggctctctgctgctcctgggtgcatactatataaacagatgcccagccacccaggggagggacctacaaagatcatgagttaccacgagctgtttccagtttgtcctcctttaattaaaataattagagcctcgtcagtaatgacgagattgcctcactaactgtccaagggtgttagtactaagccacccaaagaacctttttataatgtctcatagagtagaccagagaatgttgctgtgactcctttatcatttatagagatgtggctatgttgggactcctaatggcatgttaccccaaatgctgaactatccagcttgtcactcagaaggagcttcctgacttcagcttcaggcattcacatgctatctggtagagtcgtcttctagcaatgctgatagtttccttggtccagaatttgttaccttcagaagaagagtgtgaggaagagatcccgttctaaagccacctagaccaaacctagcctgagtctccttctggttgggcttaagatgacaatgccattccaaccatggctaggaactcctgagtcttggaatcagatcatagctttacatttccctcaaagcatctgagcttacattcccaggttttccatctcttcttgatatttaaagctttaaaaaaccgcagttatcagtttaaaccataacaggcacgtgggctctaatgacttctgcaggtggtttgggctgtattagagaacctagtcttgatcttaaactgtcatctggattctgagttaatccaggaaaccagtaagaattagtaatgtgtattgcatgtctctgatacatgtgttttccattatttggtcttccacagtgcatgcgcatacacacacacacacgcacacacagcccttcagtttttctaaaatggggagagagggactatggttccaaaaggaaatgactggtgtggtgccttgaaatctgaacttagtcacgtgttgtaaatgaaatgactccaggcacattaacaagatttctttctttcatctcctactttttggaaaaccctttgatgagaaacattggctaacttatagactttcagatttatttctgtaaagataagtaatagccattgcaaagcagccgtacttgtgaaattggagttaagcttccataacagcggtcttaaagaataggtagggttagttaatacacagcagcaaccagctgttcttcctccctgctgagactgggaaagaaggaaattaacttcaactataatggaagagattttcaaaactggtaatgggaaatttatcatcaatgaagactattttaaacattggaacaaatgagtgaccaacagaaatggaggaattatgtattctattggatttaaaatagaatatatcatctgctcaagacacttagaattggtagattagatctgtctaataatttttaactcttgggggtcacagaccccattcagaatctgatggcccctctctccaaaaacatgcacacacaaaactttgcgtatgatttcagggaacttacagactccctgaagtctataaattagacctgaatttaggacaccctggactagatgatctccaaaagtctgttttagctctctaagtgacaagctccacagcatagttgtcccatacataacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctgtgtcatctttgtagaaaggcagtacagaactaggttgttgccggcagttcttccccagccccacaccccgctctggattcatggatgaaaatgcaaactcagatgccatattaagtactcagaattctcccatgttcacacatctttttactgtattgctgtgattgttcagttgggcttgaaaaatattatttattttctcatcagttttatgtctaagtttcattgactacaagttggaagatgaccacccagaattacaaatcagggagtaatttggtcctctccctaaaataaagagcttttatcctcttaagaagtaggaatggagtatagtctgtgtctgtgtattttaaactcatgataatgagttgccccatatgtagaaagcatgactctatatggttttcccattcccttctgtaaatattctctagcttacctgcaagttctgtagactccctttaattccatgttggaattgtacttgacactttgtgcctggaatcaggaactctggaaataaagatcgcctcaatatggaagggaagtgatctctggaaaagagcataattgtcagatgtctataacttgtcagttttcactgtacctcacactcctaatggcaaacctttaaattcatagttggaagtgtcttaatgaagtcagaaatattactgatgaataggagctaagcgtacttggccagggtctccttaccattcacatggaatgctggtccttttgacagttgtttcttcccattgttgaaggcagggaggaggacttagggattcttctctgtattccccactaaaaaccccttctgttccagttgctccaatcagagtaatacactgcacagaaagcatacaagatatacgatgtctgtggacagatgctctgtggcattattaaccctggcagttgctttagctgttgtttagtcaatggaggttgtttgggagctagaattgggagagaacaggtgatcctggcacccagcccacttgtagctctgcttactgactgagagtccctctgcaccccttgaaagtttactgacagttcacacccttaaagcacatttctgtatttctggggctgaagcttatggcagagatgcacattctgttgaatatttattctttgtgtatattcctgtctgcagagaatgtgatcaatgggcaggactacgaagtgatgatgcagattgactgtcaggtgatggacaccaggatcctccatatcaaaagttcgtcggttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggagaaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggcggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaagatggaaagttcgatgtgactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaacgcagattagtgaacgtggattcctgctgagggagtgcatcccataatatggcaataattttcagtttctccaacgaaaagatagtgaaggaattaaatcttttgtcctcccatggttaaaaaaaaaaaaaagctgtgttcatttttactgtactatgcctcttttttcaccatagtagacaattatgtttcatttgatgaattcatagaactggatctcatacagcgatgtcctctctaatgttctacctttcagtttctaaagtgagtcttcctccctctcctacaaaacttttcaattttttgatgtaactcatctacaaatactgtttcttaccccagttgacttgcctttgtcagatttcttcttgttccacactatagcaatcaatttctcttcttccttacaagaaagggaacgagaaattgtagcaacctctcaaggattatatgcagctagttagttttctgcctgtgaaattaggtctggctcctaaataattttaaagaaccatcagcacttctaactctctggacaggtgcctctttgtccaagctagttaaatgctttccaaggaaatcagttcaacttttgtgagcggggaaaagcagggctttattgttgtgttacctgggagtctggagtttgaaaagtgctaattaaccttcctctttttccacattacaaacctttttaagcagcgcagcactccccttagatttggctatcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagaggctgtgaccatggctagtagacagtggcaacatagtcatccccaagatgctaatcttctgctggaactgtcatacgttatcatggtcaatgtaaacctggtttgtgtggggtgattataaatagagtttccctcctctctgtgacagaatcacaggagaaggacccatctcgtggccttcttgttcttagcg

SEQ ID NO: 12676 - DNA, 62957 bp, Human
tttggcagttttgtaaatcttcaagacagtccattcatctatttttactaaagctaggaaaattggtgtaaaattgaatataaataggaacatttttcctaaattttatgaaattactgctcttccataagccaaagctagtttcttctgtgttttccagataaagacactgtaaagcctttttctttctactgaaaaccatgtttgtattgtgacagttgtgcagtttcattgctcttttgctctttttagtaactaatcgtttcctggattgtctctgctggacctttttgctcctttactaaggcaaggtttgtggattgttctgtggtatatctgagaaacggatgctttttactccatatcagagtcgattggggttgctgatgattgtcttagtttaaataaatactctctagtaggtcaacaatacacttacggaaataaatggcaaagattgagggaagaaaaaaatattaatcccaagtagttagtagctcaaggaagaattaggccttatttcaaatcctggtgcactgtgtccaggaataaggactagagaaaatatctacaataaaacataaccaagcaggcattagatttccaattctctaattttgaaagacggaacttaataatctaataacaaaaaataaaatctaataatagtttaacaatcaatgactgaatatttagcaagagcataatgcctggcacagaagttgacagaaaaatgggttacacatggatttagcttccaaataacataacagacatttagcaaattgacagcaaagaatatttttgttttccttataatcctagcacataagagagtgctttgcacagaatgaggggttatgtaactactgaattcatgaatacataaataaatgaatgagtgaatgaatgaatgaactattataacttagtttgtatatctatttaaacagactgatatgaaattttatagataagaggttaattgaaatctgaggatcagagatttgctggagaaattaaatgataaatctcatgaaacatctctaccagaaaaaaacccatagaaaactcagataaatctggttctctgctacctacaactggcataattttgtcctacagtaaatgtataaaagcattctatatgatcccattttaatttatttttatgtgactccattttttcttcatctatcccttactagtaaaatattggttacccccaaccatcagacaatcgtgattggaaaataaaggaagtaaaattctgattatttattccattagtgggtatctctggtagaagttccaggagcaaaatttaaagtgacttcctggtatacctgtctaattcaattacttatgctttccttttctgttattacttataatcattgagattaagtaatgatacagctgaagtgtatttataaaaatagaaagatatacatgtatgtagatagatgttttataattcagagtatatgtactatatgaaaggatagagacactgtaaacaagcttttgattatgtgtatgcatgtggatatacacttgaacaaaatgcagctttctggatagagcacagcagataagtatcataaaaacttttctcagtgtctttatgtagtagaacaaaatgttaaaactgtattcagcctatatcaacaaaattttgcactctctatcgtgaacctgaaatttctctttgaaatcagtgaaacgtgaaaccagggtgtgctcaggaaaagaaagttacttcatattttttcatgggttttcctgataataattgcctgtgctttcccatttacccttagctttgtcagagacccttcagcacttccatagagccatcccactagaggtcacagatcacaaaaaccctacagaaacaggaaaccgaacttcctgagtacgctacaaaacacagaaacctgtttcctctacacatctcaaactggcaaaactcagtcttagcagattcagtgtggaagcagctatcaaaaaggccataaggattttgtccccaaatttcacatgagctaccttgcttcaaactactgagatgaagggggcaagattatttgtccttctttctagtttatggagtgggggcattgggcttaacaacagtaagcattcttggactatacctgaggatgggaactctcagaagactatgccttctgcttcagttcctccaaataaaatacaaagtttgcaaatactgccaaccactcgggtcatgtcggcggagatagctacaactccagaggcaagaacttctgaagacagtcttcttaaatcaacactgcctccctcagaaacaagtgcacctgctgagggtgtgagaaatcaaactctcacatccacagagaaagcagaaggagtggtcaagttacagaatcttaccctcccaaccaacgctagcatcaagttcaatcctggagcagaatcagtggtcctttccaattctacactgaaatttcttcagagctttgccagaaagtcaaatgaacaagcaacttctctaaacacagttggaggcactggaggcattggaggcgttggaggcactggaggcgtgggaaatcgagccccacgggaaacatacctcagccggggtgacagcagttccagccaaagaactgactaccaaaaatcaaatttcgaaacaactagaggaaagtaagaaatcttcttttctttttgttctttctctgtctatcaggtctagaagattgcaagtgaaatttacctcactcccagaaaattatttcaaattcaagatgaaattggatcatatttataatttcaccatttcagttagataaagttattgttaatttatctaatagggaaaaatgaagaaataaaatgcagcaattttgttttaactgaaataatcattcacttttctactcacttatagaggtagttttacttagaatagtcattgccaagcaaactagcaccacggtggctgttagtttaattcaaggatatgttgattgtgttcccaaccatattcacaatatgaaagacaaaaataaacaaataaataaaattggggcttgaacagatgtgaaaattggaatagcagtattataaaaagtaacagttgtcaaagatcgaaacaagcacaccaggggtgcaatcctggcttcagtatggtctagttccatgattttgagcaactcagttgatgtctgtgaacctcagtttcttcatatggaaactacagatttaatacaaggaatgtcaataaaaataaaactttgcagggttctcgttcagataaaaatgaatgaaaagtgcttagatgcatgctcctcacagaataggtgctcaacaactcaaattttgctagtaccatgattattttgagttgtgttgccatcatgaatatgatgaatcagaaaacttatttttcaaattaattttaatttaaagttagagcaatttgagtggttgaaataaaataaaacaaatttaaaggagtgttgttaaagagggttttcaaaagaagtgatagtcaaatcaaaataaacaaagaaaaaatatctgggtgggtcaatattttattcatttaatgctcagagtcatctgtatgtttggaatactagaagtttagtattgcaaaactaaacttacaaatagtttttacatgtaataatacaaagtcaagacaccagacatgtcttgggagcaaaatggggttaaatatcttactaataataaaataaaatccaagttaaaaatagaagttgacacacctgctatgtgaaagacatttagttaaagctgttgctgatataaaggtgagaagaagagagacactggtaagaattctagccaatgaatttacttatttctgtattatttattattcaagtctatttttcactatatttcaaaagttatagaatttttcgaaatatataagtaaatctgattgtaactaaaaaagtattcacttggtggactttggaacaatcccagcttactgtaaaacaaatagtacagattacaatatgttcactttgggacaagtagatttgccattaaaaaaacatttaacagacatgcattaatctttctcactttgggggacaacaggattttatctattaaataatcagaaatgtcatttattgacagctttttctaaatcacttgaatgcatcatttctgttaatcatattttattagaggctgtaattaaatttttaaaaactaattacagtaaaacccttggacattcatgggaaacgattgtgagcttttcagagatgctatagctaagaatttttttttttttgagacggagtctcgctctcttgccaggctggagtgcagtggcacaatctcggctcactgcaatcttcgactcccaggttcaagcgattctcttgcctcagccttctgagtagctgggactacaggtggtgtgccatcacacccagctaatttttgtatttttagtagagatggggtttcaccatgttggccagggtggtcttgatctcttgacctcatgatccacccacctcagcctcccaaagtgctgggattacaggcgtgagccaccgcacccagccagaattttttaatagaaagggaaatataataaacagaaaaaagagacaattcaagttaaaatagcatttaaattttacataccatatagaaagtggcatacagttgtgtcataattagaactagtaactaatagtttgataaatactagtttttaaataaatgctagttgtgttatccaaggtccttgctttcaaatgttgggaacaatttgatgaatatttataatttgcccatcatgtgctagcactgtgctaggctttgggttacacagaatttaaaaaaataataataattcctctgtctaaggaatattccctataaaaagtaaacactaacatacctatcagacttcaaaaaatgttaatatgtgctatgagaaaacaagatactaaaggtataacttgctgaacagaactttatcctctggattttctaacaaaaataatcttaaactccttctatagaaaagtactaactgcatgtagggattctcttatttgaggtcctggagagcctgaggttttcttttagtaatcctttccattaccaagattccttactcattaggccatgcaaatgacaatggcattagagaaaagcctaggtccttcacttttggacacagtgctgctgcaaacccttgatatggtcaaaagaagtccttcgtactttcatttgattggcaaataataataataatagtagcaaacacttatatggcatctgttactagtactctactattgtcagtgaatatattcactcatttaatcattactataactccataaagaagaggaagatttttatcattatttctttacagagggattaagtagcttacctaaggtcacttggctaacaaagctcagggcaaagactcaaatccaagctggctggctttagagttgtagctctcagctcctacattacactcccttggcaggtacagtctcttatcacaagtgggaagataagcgtgaccagttcacttcccagctcgtgaggcttcacaggctattggttgcctccagaatacaatctagatttgttacccagttagtcacacgatgccatcctagatctgcctcctgcctacctccccaacctcatcttccgccacttccggctattcaaataagtggttctctggtacaatatgtgctgtttgttaaacccacctttcttccctgtctgcccctgtgactaacaatgggccctcttttgccatcgttctctcttttcacacctaataataactccaggaagccttctcaggtgaagttaggtggcctttctaatcgctcctacaggtctctttgaattcccctgttcactgcacttacgacactacataataatcataatgaatttgtagtatctttgcatatagggacttattttcagagctagcaaagtctctggtttatagcaggtacacaatcaatatttaatcatactgaatgtgaaatatgaggattaatatgtgaatataaagaagaaagcttcccaaatatttgcatttgtttatgaaaaaaacctggttgatttagaataaactcatatttgttcttttttctaccattcttggaattttataataattcttagtaaaaggcgtatttatgtttattacaggttcttttctagattattcaggattattctggcatatttttgtttcatcttgtagtttttcttctttttttttttagccttgcaggaactcctggccaaaatagacctatggtttcctgtctggcagagtgggtgttagtcaatgaccaagcactttgaaataggaaggatggaaataagaaattaggattagtgtatttatatgttgaacaaatatttgctgaacaccttatctgtcccaagcactgtgcttgtgctgggagtaaaacaatgaacaagaactcctacatgtcctgccttatggaaccaacagcccagtggcagaggtgagaggaggaataacagtgaatcacaaatgctgattctgaatgaagcttaagaaattgtagtgtataatggggggaatggcctaccaattgtgaatggggtcagtaaaccttgcctgagaggataataggtgaaatgaggtaatgatacaatctaactgcctacttagcttttcccacaattcccaacccctgtacacatgtatcttaatttttaccaaatcagtgaatggctagttccataactagaaaccttggatagatctttggcatttttctctcccttctggtttttatctaatctatcaaaaagtcttgttacacctctaatacatcccaaatacctcaacttctctccatcttctacttgccgttattcaccactagtgttctaattggtccacttctttccactcttgtctaccataatccatgatccacaaaagggagggatcttttgaacatttaagtcagattaatgcatttcactggattaagtcttcattattgtaagtgacacattattttaggtactaatcagaaggaaaagtatgacatcatacttgcttaatttgaatttttagatttgtctttcagactttgagattttggtcacatatcacttttgcaaacttaagaaggaaatgtaaatgaaactggtaaagtatttcgaaggcaatggcaacaactgctatctgaccactagtgactgaaaaatgcctttgatttcaagacacattcttgatttcagagatgtatgtcttaaaatgtgtgaaatttggtctttcattcattgtcacactccaagatcactgcacttcatttcctccagccacactggcttcctttctgtttattgaacatgtcaagttaatatctcaaaggaaactttttttgctcttgctggaatgctctttctgcaccttttataatgaaggactcctcttccacttgcacctccagctttaatgtcacctcttcaaagggaccttctcttaccacccaatgtaaagttaactatgctctcacttgccattccttattttgtcacctttatttttttctttgtaggaattatttgaaattattctacttatatagacaatggtgtattttatgtctttccgcaatacatcccatgaaaacagggaccttgcctgtcttattactactctatttgctgcctagaacagtgccaggtgcatagaaagagctcaataaaactctgtaaaatcatggattattagatgggtttggcatccagaggggagatcaaggctagagatataaatttggcaaagcattggtatatagaaatgtattaagtcatgaatgtggatgatactgaaagaaagaaggaccttgaattatgaacggagaatctctaatatttgatgaactgatagtggtggatgccaacaatacagtcttaaatggggtgaccagagaagttaggaaggaatctataaaagtgtggtgtcatagagcaaaggaagaaaatattttaagaaggaggtaagtgatcaacagtgtgaaatgctgctgaaaaagacaaaatgaggactgaaaaatagccactatttcagtttagtgagcaccatgctctggcctgagagaattgaggtatgaaggaaggcaaaagagagccattaaagccaactcaattaaggagggcttttatgaaaaaaaaaaaaaaaaaaggagaaagtggtcagaagccaaggctagtccagttatttatgttttgtgtttgtttcttataatatttcattttaaatacagagggctcatacatatgttaacatgttaatgagaagggtcagaggaaggtaaaatttgaatatgcagaaaaagagggattttttttctgagtttaatgacaaattagaaaattagaaattattatttctgagtttaatgacaaattagaaaattattctgagtttaatgacaaattagaaaattacaaaaattaaccattaaattctgctgtcatactttttttctgctcattttgtgtgaattatgaataggttttagaagtgaattatctgatcagctaaattcttgtgttgttttcaaagttattattaggcctaataacatccaaaatgggttattcttacatgctgttaaattctaaagagaaaccattatactaaagggtattttcttatatctttgtgaaatagatgtctctattacattactgccagtgaaataaacactacataaagtatattctctatcaacttttacccattaatcacattctttatttcattactttgctgtttctactctgttactataaatatatattgcatttcatatgctagaatttaatgagtgcttatatattcctaataattaagtgggaactttttgtattcgcacaacttctgcttttctgaatataaaactataattttaaatttattatttgggggtaaatgctaagagagtcagtttacaggaactggattaagcatagaattctgcatcacggcatccgttagcctgcctttgtggtctgcacgctgggaaagcctgacacctactggaatagaaacagtttacaacgcccggaatatgctcaagtcacagttttgcaaggaagggggaaacaaaaaataaaattaggtaaaaaagagtatgttcaattcccacaggaaggggaatatcacactctggggactgtggtggggtagggggaggggggagggatagcattgggagatatatctaatgctagatgacaagttagtgggtgcagcgcaccagcatggcacatgtatacatatgtaactaacctgcacaatgtgcacatgtaccctaaaacttaaagtataataaaaaaaataaataaataagttatagaagagaaaaaaaacaaatttatggaaaaggttatattaaaggttgactttaagaatcattacttataaaatatatatgttatacatatttaattcgatgtaccactttaaaaatatactacttttcactttaaaattggaaaataggttggatccaaacagcaaactctatgtacatcctgtgatggccatacattcggctcgttctcataaaactttacactgacaatattgtgtatagacagtaatttgtggctgtgaggcactctacagtcatctatcattgaaaactcaattacattcaccacactgttcccactacagaaagcaaataaaattatgcctgacaaaaatattttaattgcaaaagttggtacataaaaaagggtttcttcttaaagtctaaattaaccataaatcaaagtatctaaaattccccataatctgagctttgcataattgcttttcaaaaaattattttaaatatcaatttatttatatgattcttttacaaaactgatatttttatctcagtttgaatactatataaaattttgtaaaaggattaagcatagaaagatacactacaataaaagaaccacaaacataaattattttgttgttaggaaataaaacaatgattttcttaaggaaataaatattgagatgaacttgtcttttggacttttagccaaagctaaatatcaaatgtctaatgctttatttaaatataatttacatatcaagaatcttttcactaagtgtaaattattgcttcccatttttattatcttttttcatgtatatatttcccttgaattattttctcatttatgactagtgaactacatgcaaattatagtctttcaaattaataatttgattaaaaacttctctttttagcttgattggaaaaaataaagatttcaataaatagattctataacactttggaagtatttatgttcatgacttcttaagactgtagagacattctgaaagtttttttttttttcctgagaggcaagcttcatctgaattgaacataaatgatgatgatggtcttctgtattggctttatggaaattattgacttgaaacatacaagcaattatggttaagatgaatttatcaggtcattaaagaagcaaaacaggagctgtgtttctttgtatctgaggcaaaaaaatattgaggccatattatatatatcctcttcaaaaaaaatcccgcttaactctgaatcatttaattattataagcagtgatagcagcaaatattttacttttcttaaaacatttagtctcacgacaatcgtgtgaggtagataatattattgtagatgcttcgtagatgaggtagtcacttttgccagacaaagtcatggctataaattgtggagtcaagatctaaaagcaggtagcctggctccagcgacgaactatgttatgggaaatttttcagggaaatttttctttattttcttttgcttatgcagatgtgcccactgcccccacccctcacccttgcctaattcaggattagaaaaaaaaaaaaaaaactctaggcacagaaatacactctcttctttattcacacctatgtgtgcagttaaaaggagaataaaaatcttgtccagcaggcagaacttcatcatcagaaatgaccttctaattctgatctacgaggtgaaaaaagcatgtattgatgacaactctgatgttgccagaaatgcctcattcccctcctcctctcttcttttcccctttcctgttattttgtcctattttttcatcctttgctctatttcttactttttcttcttcaactctctctgattttgacaagagatatgcaaaattattatttttcactttgtgtggcatttttttcagtatgtatgtatttatttatttttattgtggtaaaatatacattaaaaaatttaccattctatccgtctttaaatgtacagttctgtggctttaagtaggttcacattgttttgcagtcatcactgccatctatttctggaacgttttcatcttcccaaactgaagctctgtacccattaaataataacttcccattgcaccctccctaccatccctagcaatcaccattctattttctgtctctatgaatttaaccacttaagtacatcatataagtgaaactgtacaatatttgtccttttgtgtcttgtttatttcacttagcatagtattttcaaggttcttccttttcaaaggttgaataataccccattttgagtgtgcgtgtgtgtctgtgtgtgtttgtgtgtgtgattttctttttccattcatctgtcaatggacacttgagttgcctctacctttctgttattgtgatacatgatattttaatgacgttctcaaattagggtagtgtgctagggagaacatgtactctgactagtgttgctatctaaaatctgttctatttttattgacttaggacacatagttttcctcagggacttaataattgaaccgttaaaacaaatgagggtttagctgaattttttccctgattattgacaccaataaaaataggtttgttaagatatagttacctttaaaattctattttcctctttaaacaaattattttttactaagtgatattttttaaaaagagagggggggaattatccacatatgtcagacttatagagttgagaatgagatgagcaggttggatttgcaaaaagtagtaaacacttataaaaaaatataagactaacttttatatatttaggatatgttttcccacttatcactgaattgggtggggattttatcactatggacttcaggagtttagtgtaaaatgatgtacaacactattatttcataattttgccattagtaatggtcaaacagttaagttttgtttggttgtattttcatgcaataataatcttataattaagatgatagtatttttcatgaggtaaattaggaataatatgaataaattattctcttatgagggatcaatatttttctctctaaattaagtcccaccagagacttagttcttcccctgaagcatttatgaattcattaatgtattcatatgttgtcatttgcaaactgtagtcatttttaagtacaaggtaaagaaatggacatttgagatcttatactttctcaagtcagagacgcatgggtgggtattaggtgaggtgtgaggggttattactagagtcacctgataatcttatttcttcaagagaatgttaattttcagaagcagctatgtctgtcttgtcctattttgttttcctcttgttcccttttaaatctctacgttaaagggcatgatgggaaacaaaggtcattcaatccataaagtctcccccagaaacaaaatcttctcccacttctcaaagaaaattatataccattggcttggtttatggtggcgattttattgtcttaccttgacttctaatgaacatcctcaggacttggtattttcatactattgtgtcaattaaagccacagtttattaatatgaaagtttaagtatttagcttcttttgaattagatgacaagcaatctattcatctgggttctaagaactagtataactgaataatgttagttcttagattatccctttatttcttgggaaaatattctgtgtggtcattatttaaagccatcttttttgcttcagtcctctctcactcagttcaggataagaattggtatgactgggccattatttagtcaattaatggaagttttttacattagtcttttcactagtttcctgaaagactgagtttctaaaatgtcaaaataaaaaatatagtaaactgtttatttatgatgccttctcttagttcattatccacaagtctttgagttttatgaatcataatagaatcctttcccctctctattttatatgttcaacaagctaggcatttgctcataaccaaagatgtctgcttttccctagaacaaaccttttacctattaacttggaaaatccaaagaatcaatacaagctttttttcagtacatgttgctgcacaaaagcaacagagttattaccctgaaagagaatcccaaatgtggtctgctggatggaaggttatgaccccatggaaaactaaacacttcaaagtaactgctctccatccaccataatcagtctagaaaggtacaaaggattactaggtttaagcaaaatgcttgtctgggatcattgcatttgcctttaaactgcccatcaccattttgccatgcttcattttctatttttaaacctacattttcagataatttggctttaaaattatatttacatttttaatatcccttaatgagcttatttcattggtagcataaacctaattatgagtcacaccaggggctcttttgctgtggatagttcttctaatttaccctggatcaaagattgctgggccatgagcagtctgctgatctgcttctttgtctcctcaactattttagtcatgagattgttttaatatttaggatttcaaaaggtctctgccaggtgacactatcattttgcctcacagagaatgaatatactttttttcttttcaaagccctgagcatgtagtgacggtgatacttgtgttgtttctgccccacactccctcctccacagtcattcagagaatgttcatgtgacaatttaattgtgcttctgttgaagtgagtcagtctcagtaattaggatcatcattgcatttgcatgaggaatctagttaattttttaaagatccctttattgtggtcctctcaattttaaatctttttatttttatttcttgctttttccagttctttgttttacattatttttgcctcaattgtcaccagtgatttaacaacatgtgccagcatgtcttcttacttctttaaggggcctgaaattttaaacatcacattcaaaagaacacaataagttctgtagagctcaatttctctgccttagatgaatgacaatgtggaatgattaaatcaagcaattaacatatctttttttctttttatgtgttgttttctggaatttgtgtatgatgtacttaagtgaggttttactttgtgtttatcctcttggaattcattaagcttcttagatatgagggttgatttttttaaaaaacaattttaggaaattttccctttttttcttctcatgtttattctgcccaatcttaggaccacttcagttttgctcatttatgtttttgaatttttttctctgtacttcagtttggctggtttctattccttatcttcgagtttattggtcttcctttctaaagtgtccaaatttctgttaagaacattcagtccatttttaattcacatattgtatacttctcgttctatttaatggttaattgttttaaagtcatgggttgctaattccaacttctatgtcatgcctgtttttttgttttttttttttctatttactggatttttactccatatactggtcctgttttgctgctttttctcatagttagttttgtctgcttttcatgctgggcattgtggatactatgttattagtgtctggattttgttgtttgcaagcacaaaatagtattcagtccaagattcaagggcacccctatattgacttttaaaatgatatttctgtctggccccctcattttattaatctttaacacattttttaaccatcctagtatccccaaactcagatctctattttctttacttggtgtcttttctggaatccatccttctgtgatgcagtttgaaaattgttcccaggcacaaaactagattgaatgtggagctaacatcacatattttccctcaagaatcatatcactgcattgtctactgcccaacatctgaaaactgttgctttatacatcttgtccagatttataatttttgccataaaaggtaaatctgatagtttatatagccagggacaaaattctctgaaatttatgtttttagtttattatatgaaaaattatagaataagctcatttaactccttatatcaagctaagatttgttgtgaaaattcatagaatttgaagattaatttgaggaaaattgacatatttgcattgggtttcccattaattaacatgattcattggctttttctttaaaacttttcaataaagtttaaaatttttacttattaaatctaacacttcttttgctgaatttattcttaggtacattattcttgttgttattttttgctactgttaatagtgtcttttttaatttgttgttggtacagagaaatgtaactgatcttaattttgtgattgaattaatataaattagtattgtattaactcataaacatttatatttgattacattgctgaattgtctttttaattataataatcggcatctagaccattttgcattttgtttggttacaatcatatccactgcagctaataacagttctttctcttcttttttgattttgaaaccatttatttacttatttacttatgctttactgcacataatttaaagtaatggacccggatctgagttttttatctcagtactaatattaatatttgctacaagagcattcttgcattttgatttatcttatagctaaactctgcaggtttctcattttagctttgatttattcttttctttattttgatcttgttagtgtttccttatagtccctgagtacagcaatacagtaataagttattttctcttatatttaaatattttaaagctaaatagcaatcttacaaggtttctgatctatagtatggcaaaaataaatgtttgtctgtgaaaataattttgatgaaaagaattcttttttgacaacagttttttccctaacaattatgatcttctttaggaattggtgtgcttatgtacataccaggttatctcccacagtgatattggacaaccaggtcacttatgtcccaggtgggaaaggaccttgtggctggaccggtggatcctgtcctcagaggtatgtaatatttcttgaaaatagccactgtttttgcaccataataaattatagccgggaatatataatgttattcatgcaaggtacataatacatagtagggtcaggggatggtagtcacattatgctttagtaagtgaaaatgcagacactaataatatttgcctcatatggtcatttttagaatcatttgagataatgcaatactatatttagcctagtgccttgtgccttataagcattcaataaatgttaattatcatgcttatttctatttttactatcactattacttttactctatatctggtcaacaatcctgtccttaattgcttatgaatttcatgcacagttttgaagatttattattttctcttcatgctaggtcagaaagaagtttataacttggttcatattctaaaattaggagagcttctagttacaattatgcatggaaaagcagctaggtgaagcttttcttcttgtgtctattgtaattagccatgtcatttgattatcattttttaaaaaagtctatgctgttgtcctaaaagatggggctgagtaattgataaattatctgaattcatgtagtcaccgtagctcagctgggggtgtttccaaagagcctgcaataaaaactccaattgttattcaggccatgatggctaatgttatgcaaatagtcatacaaataactcaggcaatgaatctgacacatggcaatctggaacagtgcacaataaggatacataaaatcaaggtgtttcttagtcccttgaggaatagctaaggttcatggtccagagacctaagcacatcttagggatttgggagagctgaactctagttctgttttcagccctcactctctttgtgacaatttccttgccaatacgagacacaaagaatgcattgctaattctttagtaataaaaaatttaccacagtagcccctagcatactgcccttctggattcaaggtgagctctttttatttttttcttttctttaaacaaaccataagtatttatctttattctcgaatcttatcttttttatgccttctgagtgggtgcattcattcgctatttttaatactcgtgtcataattgccactttttcttttattatgtctgagctacatgcaacagatattcagtttgccaaagcaggaacattgaccccaacaatagttcaactaactgcctgagctcatccttacaaactctatatacagtccctttccaaattgctttgcttcctacttagctttaactatgagagtgcagatagtatttcactagacagaatgatttagtgaaataaatgagggtaaatgattagcatgcttttcagatggaagggatcttgtagctcattttgcaactgacaaatagcctcagacatactcggttacctgtcatgttatagcagaaactgaaacgtaagtctctaaaggccggtctgttataatgctattgctccacatgttcacggtttacccatgtaggtgactgttgtctccatatagttgtacgtggcaaactccaggataataacaagggaggctagcccacatgacatgggctaaaatcacagctctaccccttttagatatgggactttgagagagttatttcatctctctgttctttggattcctcgtcaggaaatgaggataataataatgccttcatcataaactaaaatgaaaattaagcaagatagtatgtacccattttacagacccatttgataaatagcaactaaatattaaagtcacatgggtaagactaatatggccaaattgtacttatgacttacatttacaaacacacagagctcacaatttagtagcagtcactatattgattgttgtgttgaactgctatagtttccatatttcttttctgctgttctatggtttcatcttaaaaataaaatttcctcatattacatcccttctctctctctgtccttctctctctctctcagagaaatactatatgacaaaaatagtaggtagcataatttcaaaactttgaagatgaaaaattccatgggaaaatgatagtggttgtcataatttcaattagatcacgaatatccaatttgtttcaagttgtttgatactgatctggaggaaatacagatctttttaaatataacaatataggaaatcatatgaattgaagtagaataaattatctccatataactttaaaattggaatgaaaataaattttaacattgatttagcaagaagtattatcaagagaaaagctataatatctttagaaagtcaatggcaggtatcaatttaaaataccaaataccataactagtaatgctttttgtaatgtattgaaagaaacctaagttaggcaataatattgatgatgaatattatgattataacagccgatactaaataaatgcttgttatattgtaggcattgccccaaaaactttacatttattattccggctgataatttaatgtgaaacaaataatcgatttccctccaattgctcaactctctagatctcagaagatatccaatcctgtctataggatgcaacataaaattgtcacctcattggattggaggtgctgtcctggatacagtgggccgaaatgtcaactaagaggtacactctaatattaataatcacaattctgaacaataagaaactgattctattgaagaaaagaatagcatttccccttttgaaccaaggtaaattaacatgtagccaaactcctaggactgttatactttctaagctttctaacttggtagcttttataacactctgaaatctcataagctattctttaacttctccccccatttttatgttggatttatatgatgagcaaatggaaatctgatgaaagatcttacttattcttaacaacaagctatagaggcatgccttattaaaatatcaggaatgctaattttcaatttttaaataaagtgttattagaagtgactcaatataaaaataagactaccatctagttttgttccagttcagttatttgaaataatgtgcatatgaatgaaatttagtattaaaggacatacaaggtatgtcatgaataattctctctttttcaaaattctaatggagctattttttttttttcagctgaggttttaaggactttctggtggcaaggctgatcaaacacatggtaacccgctgtggcctaatatccatgtgactattattttgcttttggctttaaacaggtttcctttgaaaaataagatacagcatcagcatacatattttaaatgaatgaatattacaagaaaggccattagcagtggtggggaattcaatcaacagtataagagactgtgattaaaaattaataaaactgtggagaaaccgttatggctcacattaagaaaaagaaaattataatacaaaagctctaggaatcctgcattttagttagggatattatttatggttttactagcctatacaatgagaatctacaggcaaatttcaccataatgctatttgttctgggtctggcctgaatttcaaagatgttataaaaattcaatttatattcagactacagaatgaatatgtacttcatttataaccaggtaaaataaacttttaaataaaatataatctatgctgaaaatatttggaaataaggaatttagcatattttaaaaagacccaaatatggccctgatttctgatttccatgaagtacacaaatatatactcacaatggtaaaacatatttgtgtctagaattggtgaattgttaaaagttctggataatatttagaattctgtttctgaaatctgtatttctcttcttctacaaagaaggatatcatgagattattaattccatcattatttcttgatgattcaagtttgtttgcagagcacatttctagaaatttaggttgttattacacatcttattagtagacatgtggcagggaaaaagtctactaatgaaatgtcatggactctagttgatcagagcgttgttgctccgtgcttcaaccttttatacttaggaatcaattctttatcactatggtggactacatacatgtaggaagaaaataccagaacatcactgtaaatatagacacaagaaacaaagactagctgacagtttcaaatatagactgtgtcctgccactctcatttttcaaagtatgatatgaaatatttatgaattcaagtagtttagggattgtctaatgacaccttatatcctaattagaagcaacctgtggataggttttatactagatttacaaatcattgtattaatttccagtggcaaaaatgtcccagaacagttctgattatgaccttctgtcataatagtgtaattggaaccactcataattcaggtatctgctgattaagctgttattgaaaggcctcttttctacggaaatctacaatgggaataatgttccaatggcagatatgcatattgtgtcatattgtcatacaaccaattctaatatagctttgattccaaaatagcctcctgttgctctctgctatactttgaccattctacttttcactttttagtgcagttgtattttcaatggctgaattttctattagtgcaattgatgcactggttgtattaggaactactgtgtcctttgtcccttgaaccttcattatatctctcctgggaggatatttgcacattttccccttctaatagctaaccaaattgcagtaggaagatcttctaaatatgcagggaatatcaccagctcaggaataaattggagctgtttgcaattgtacttttttacttcttctcccccacttttgtacccttctttccatttctttcttttatacccttctttctatttctttggggatgtggatccatctcgaaactgttagaaagagatgtggtgactcagaatacatggcgattctctctttattccacaatatgctaatctgctacgcacgtactttagctgcaactcagataatcaaaatactggtagccacagttctagattaccttataaaaatattcatcatattatcaaaaggaaaccaatttttaaaaatctaaatgaatagaactttattgggggaaaaaaggagtactaagtccaacatcaaagtaatagttctgatatgttttacatttgttatgtcattttctcttttcaaacatatatatttgtacataatgaggagtgagtcatcaaagacagtttgcacaagggttttgcctttagaaaggacctaattttgtgatatggtattcaagatacttttcaaaaagtcagcagtaacatacacttaaatctgttttataaaatttgcaataatgctcttttccagtagatgtctctaaaatattctgaagtggaacaaggaaagtgtgacttgctttaatgacacaaagggcaatgatttaaatacaaatagtgttagattacagaggatgaagaaaacttgtttgcaaatctgtttttaaaaatccagtggctttaatcatcagatcctttataggaaaaaggtatcttataacattctgttttgtactgcagatattatgaatgctgacaaaatgtgagcatgtacaagtgctgaaataaactggcccctaccatatgttatgaatatataaaaaatatttggttttacaaatgctgggaaatcatgcaataaattatataagagctactgtaactaacatttgaatatggggctcctccagcaggagtattttaaaatgcattccctgtagttttgcatatctagttcttcccagcagtagcaaatgctttcttctttgagaaagaacattacctcctctaagagtctttcacaataaaattatgatgcatttagtgaagaacactctgtaccataagtggttgttgcaccaaactgcctacttcaatttacctagtaaatctcagtaaagcttaacatgtacaccgaacattcaccatgcaagttttcacttgatattgagggatcagctggaaatctgtctcctcaagccacacaggaaggttttctggttctgagtgagagagagcaaacatcctcattactgagttgccattaatgacatcctccatatggctcaaaggtctggaaggaaaacaaaaaaaacttgcaaataaaatccatctaattaaaaaaaaaagcatctaataaggaagctgttgctcctactgtagacacttgctgaccttgcttctctaagtcgttgatctgtcaaggtcagggcttccattgcaaggggaaaaaaagagagtaactgtcctgggagaaaagcaaaaaggaatccaacttaaaaaatatattgcattttaaaaaaatctgaaatgcacaaacatctttaaaaatttagttgactgaaataaatgtccttctgtccctgtacctatcgcttagaagggaacaagaaaaagaaacttagaaatctgtcctgtatggaacaaagcaaaggtctgtgctcaagtgaaagacagattgcttggaaaacctagaatctgtggcagtccttgtgatagagaatacatttggggagacagaaagattgctaaatgaaaaaacaaaagagcatcaatcaacgaggctctttatcacaagagagtaactgactccactgtcagagatcctatcagctctttgctgtggctggttaaatcccgtgtaataaattgggatgaatgcaagtactgaactccagtcaacaaacaaaggtagggaaagataacataaactattgaatttgtaaaacaggcatttcaagttttcaacagccttggcagggactccatccaatgaattccggagcaaagagattcatgtgacaattggatctcaaggatctttgtgtgatgcttaatagttgtttcttttattcaggagtacagttttctcacttagattctgaaaaaaaaaaacaaacaaacaaacaataaatttaacaatgctgctaaaagcaaatgggaaactttatgaacatgcatgtgcccacatgcaattacattaatttttgacatttaatactaaaaaagttaatcacattttctttcaaattagtgatgttgaaactataaaatatgaaaaaagcttaatttttctcattttatatatattattttcatatactgaggaatgaatcatcaaattttagtgtgcaggaaaactagattttcacttgatacttctatgtatgtttattttttatctttttcaattgcttgttttttttctttctgacagcttttcaatttactctctcctctccttcttctcactgattttaaagttttttcttacgtttttggttactattttcaatctattgattatctcccgcatatcactgtctattcccttttttaatggaataacattttccaagatcacatgaatgatatatgtctcaaattcttttgaccctgaggtcaatagaaaattaaactttgatgctcttcatttgcttcctttctattcttgacactttacctctcacctaggtaaatttttacttcttgaacattcaggatctttcctagactgggtagcacggagggaactatatcttgatgacatgctcctactgaagtctcaaataggatcctagaagagttaaaatccccccacacatcctcgtgtgtgtgtttgtgtgtgtgtgtatgtgtgaaagagacagagagagcccttgcccttgtttccccagtctttgaaggatgttaagtaaaacattgttataatcttcatattaaatatgcagcatgtaatactttgtaagaagtaaaattaagagacctgattacaattccattataaaatgcaacttaaaataacatgtcactatttataataaagctttaccaaagtattttgaacccctggaaataaatcctgtgtaaaatgcttttgtgatttgtattgaggtctctccacttcgggatcacgagcacccaaaccaatctgcctcttgattatgatgattggtgggaaggggcagcagccacagtcaatattgtatataaatcaaaaattaagaatgtattactttttattttcttaaattagagcattgtctataatacagtctaaaactacagaccaagtaatatacatcataccaaaaatcactcatatcattctaataatttctaagcaatttattgatttctacaaattatattgatgtcgtctttcttttgccatggatgataccagctaaatgatgtccttgtcagagaggtaatttaatatagggaaccctctcaacctcctttaatgatttacccatcagatttagagtcactgggtgacatgaggtctcaataagtttgtaattttattaacatcagttaaattatcctcctgctgaattatctattgggctttcctgaataaaaagtgattgcattcaatttttatcagcacttaaatactgtgtgtatttttgaatgtttactgtctttattattaactaaatcatgaaaattcttatctaaatatcctatttaattagtttatagagctttgttaacgtcattaggccaaattcatctggcagcataaatcaatgaatatttattgcatttttttagttttgtcatataaattttattttcaaacaattcattagaaaatctttttcttacataattggccttttactaatttttgtttcaaatagtatatatacatctatatatttcaattaatatatattcatttaaaatagaatatataagtttcaaatgtatatttatagaatacatgaaatttttatatctatactatctttgatcagttttttaactatctccagtttaataaggggaattttcttttctcgtaaagctgaaaaaggattggcatttctgttagagtgtcatctctgaaaatcagttattttttaaaaaagtctattttccaaatgttaaatttcacaatttatatgaaagtgaattcatagggcttgatataatttacaaaatgcctttttagctgtaacatcacaggctatctttgaagtccaaatattcttccaatttttattattttaatttttagcatgtgctcttgctttccatctctctttccatctttctctctccctctcgtctacttttattgtctcttctttatttgatatatagcagtaaatatgaaattcatctagaaaagatttcaagtgtttacttgataacacattatactttcagtcagaaatatttgaatacagtagcttatagtgccaaaatttttaaaaagcagaagtctatctaaaactttgcctggaactcctggtttactttttcactattattgcacaggcttcacctatgtaaaaaattaaattttcacatacacaaattttgtggaaaattcctttctcaagtgttcatatgtattactacattactaatgtagcattaaagatgtttttccttctaatttactgagatttaaaaaaattaactgctttaaaattcttgatttttacgttttaggaaaattatgaaaatacttgtatatgaaagagttcaagtttcattaataatacttttaaattttattaagttgacttttaagttttctaagaagttgtcttacaaaaagcagtatcataaaactcatttgcaatgatattcctagatcagaattattatattaggtaagttctgtaatacttttcttttctaaaatgctctattatttttaaatgctcttattattttaaaaaagaaataatttaaaattctgattttttctaaatattttattattttatgggcactttattaacattatcggataaagtattttttaagttttttacttcaattgatttcattgaacatttttattattaggaatacttattttgtgaggctaatttcataacattttttaatattttcttcatgattcatggttgcaaacgatctttaacatagtgggtgaatgccattatgatgaaaaatgagtctaataattttatttctatattatacaaatttgtaggattgtttgaatccaacgtttacctagcaagaaaaaataatctaccaatattgaaaatcaagttgattttcattccagaaatgtaacttatttattttatattgaatttattttttataattatttggtattatttagatgttgtacatattaaaagatgttccagactaactgagtttgcagagtatcattacctaatttaggactaggttcctaagtgatacaatttttgttttattctcagattcaaaaattcaaaaaattcatactcaagatacccgaaacaaatgcttttaaaatttggttaaacttttgtttctttttcagtgtctttgataatttactataaacttctggaccataattatcaaataactatgcatttagaacaattagcacatgctaataagtaaaataaattgagcatcaaactattcagaagttgtagcaaatacaaaaatcataagcaatgataaactgttcattctactaaaacactgactgtttcacaaaatctatgcactgcctgacatcagtccaacaaaatgctaattctgaaaaatagttttcagatgttgccacagtaggaattccattcatcacatatcctacaaaatacatcctttatcatgtatccatgattaacttgtaattagttaatattataatttgtataactcagcttgtcagttattggacttcagcattatatatttgccaacagttgtggctttattatatttcaatattttaacaattggccgaccacattgctacatactggcaaaacacaatcatggagttggggaatgtgcaatgttgctagatgggagtaaggagcaacagtctggcttttgagtggaaagtgattttatttctgagacattctaaaattgtcattgggctgtagatttgattgctgtgaaggcagcacaaacactcttcatatgtttccatgcttaacagtgcctctttagggatcttgtgttataacaatagaaagaatggtaatatctgcatgaggaaatcaggaagctgtgaaaggtaccttccacccccatcccacttcacttactctttaaggaattgtatgagactcaaggttttcatttcttaaactttattaaatctgtcttcaacacacacctttgttattaacaggaatgctgtttaaaagtctatgaagattgatttctggattgcaattttagtattaatatatctagtattttctgcattataacaatgaatttacctcttagaagtagaaagcttagcaatttgttcaaaattagtgttcctaaccagggccatatatagaaatcacctgtagagttttgttttttttgtttgtttgttttttttaaatacgcacctgccccattcctcaaaatagagctactgaatgagaatctcaggtgagggagtggaaagaacatggacacttaatgtttcaaagtatacaggaacttctcatttccatctacgaggaaaaaaatcagtattctaatgggatgtaaagaaatatgtgttataataaaagttaatgatagaaaaggaaattcgaatagtaatcttgtttgtattcaacaaaacaatattatctttgctttcactataattatgcttcccttcctaacaaagtatccacagcctactgagttatggtactaccttcaaatgcaccagctctttttttttcctatgatctagccaaaaaggtaagcagcaaataaatgaaaagatcattgttcatcctgttaaattcacctgttcttactgctataaatatttataagttagtatccttaacattcatatttaaattaatagatctaaggtgggactctagaagttctacctccaaaagtttccaggtgatgctcatactgctgattaaaggaccccagtctgagaaccattgctttactctctagttatactcttggatggatgtacatttaagctgccagaataaaatgccttagtacaccatttaaggaggaatcgtgataaaaatttatgcaatgattaaatggttgtatctgtatgaattaatttaaacttacactataataaccttattgctaggtcttagaagaagatttacacttttccccacgcaatccatcccctaaataattacactattccccaagctgcagattgcttttgtccatcagataagtcaacaattacacaggactttatagaatacagcagaggaaatgaaaatcaaaaagaaacagcatcaaaacaaaaatcttggacatgaatggaaattcattaatttagctcaatgccctgaagaaaaacaatgcaaaattcaatctaacaatatagactcacccaaattaatgccaaatatacttcctgtggagtagagaagcttaagtattatagtcaaagccacatatggcttagggagcataattaacatgtgccagagatgcagagtttcattggttcataaactcacctgggaagaagcacggctagacacaaaacacttgtttcctcatgtctgtcatgcagactttaatggataaatttgtttgttagaagtctgcaaattaaagccatattatttgatgttctcaatattttattttatttatttttattttaattattgattgattgattgattgattgattggcagagtcctgctctatcccccagctggagtgcagtgatgccatctcggctcactgcaacctccgcctcccgggttcaatagactctcctgcctcagcctcccaagtagctggaattacaggcacctgagccaccacatctgactaatttttgtatttttagtagagacgggctttcactatgttggccaggctggtcttgagctccgacctcaagtgatccacctgcctcagcctcccaaagtgctgggattacaggtgtgagccaccgcacctggcctgtactcaatattttaaatagatcatttctctaaattgttttccccaatgaaaaactatattgccatttaaaatattatttgattcatgggaattattacttgccatttaaaatattacttgattcatggtaaattcttcagtagagtagatttattttacaagaatttctattgaaatttcactgactttaccagttgatttgcttgaaatgtgcctgcaatagtttacttttatttttagtccagtttgagactatcaaaatctggaaacaatccatttaagtggcactattaatgaaatagctatttttattttagtaaggaacctgtagctctcccttttttccaagtagacaccagttgggaattgccttgttaaacaatcagcctttgtggcagtccacttataagaatgctatagcttttaacacagcggatttaaaaatcccctcaattatgcaggcaatttacatctgctagtttacacagctcctccaaactaccatcccttttcacggaaaggaggcctgaataattttatttttttttccaagcagaattagagtcctgcatttcccactccaatgtggtgttgcattgccctatggttgggggcggagcagcttactctgcaatcatccccgaccatcatgcttcagtacgcgggaaaatgaatgtcagccaaattattgttcaggactggaaaaaatgaggctgtcccagtgcttaactgtctctcttctctttctgcttccttctagcccaggaacagcaaagtttgatacacaccaaccaggctgaaagtcatacagctgttggcagaggagtagctgagcagcagcagcagcaaggctgtggtgacccaggtcatagattgtaattactatcatctctgacccaattattgtcaatgctatttattacaacttccaagcaagaaatctcttagttgtcaaatgattgatggtgacacattagcatacttctcagtccttttctactggtgctggatgttgggagaaattgtggataagctataataggtactgaaaagaccatgtataactacagaagctttgtgtgcaaacacagaaagaataaaaatgctgtgatactaggttgtaaggaaaccacagttttccaaaataagaccaaacttttgttctccaaagagtgtcattatggaagacccttgacatggaaggaacaacttattcttttaagggatctaagaaggctctcttcaattcattaataagaggttgcttaatgggtactgatccctaagaaatgggattatgactaagaatcaacaagaacctcctgctgatccaaagttggcatgtcacatatttttccatctttctaatcagtttttgccatttcttttaggctaaactttagctcttacaaacataaggttggttactgctaaaaacatctattcactgtgtttggcatggatctagtcatacaaaacaaggcactcaattaagaaatgtgacttaaagggctgtctttaagaatgcagctgaatatcccttaacaatggtggtgtaattttttaagggattgaaattcagtatctttataaaagaccataatattcttgaattactgcaatacatgtgtaaagggatagacagtattattgctatataaagtgattcaaactaaattatgagtctctttatctttgattaacgaatacctcagtaaacaataaaattctcagaacatagctacaactacatacatatatctagctgcatattttaaatgctgaggtattgaatttggaagcagaagatgagccatcagctctgtaactgcgagcaagttattttggatttctgcccctttgtttctttttgagagtgtaacagtaactctttgaaataatttttttaaaacactgaaaattctgggaaaagttaaaacattttagaaatctaagctattatactactctttacaaatttctacacttagtcttaacattcaagttgccatttcctgaatgaatatagtcttgtattttcaaatgtattcctgcaaatatagtttgtttgaattaccttcaaacctatcatgaaatttaagtgatttttaaatatatatatattaatttttaattaaaaatttaagtgattttaagctgggcacagtggcttatgcctataatcccagcaatttgggaggccgaggcgggtggatcatgaggtgagaagatcgaaaacatcctggcctatatggtgaaaccccgtctctactaaaataaaaaaaaattagtctaacgtggtggtgtgtgcctgtaatcctagctacttgggaggctgaggcaggagaatcgcttgaacccgggaggcagaggttgcagtgagccaagatcatgccgctgcactgcagcctggtgacagagcgagactgtctcaaaaataaaaaattaaaaattaagtgtttttaaatatatatatttaactttcagtttttgtgggtacatagtaggtgtatgtactgttttgatacaggtacacaatgtgtaataatcacataatggagaatgaggtatccatcccctcaagcatttatcctttcggttacaaacaatccaattatattctcttagttattttaaaatgtacaattaaattattattgactatagtcaccacattgtgctattaaatagtagatcttattcattctttcttttgctattcttttttattatttatttatttatttatttttagagacagggtctgcacccaggcaggagtgcagtggagtgatcatgcatcactacagcctccatctccagagctcaaccaatcctcctgcctcagtgcccaagcagctgggaatacaggcacgtcccaccatgcctggttaaatttttttttttttttttttttttttgtagagacgaggtttagccatgttgcccaggctagtcttgaatctctgggccaaagcaatccacctgcctcagcctcccaaagtgctgggactacagccgtgagccactgtgacttagtctctaacaatttttttatacccaaataaaaaacaaatttttatttatatttttaatatatatatatatatttaatttttaattaaaaatttaagtggttttaggctgggtgtggtggctcacgcctgtaatcccaacactttgggaggccaaggcgggtggatcacgaggtcaggagatcaagaacatcctggccaacatggtgaaaccctgtctctactcaaataaaaaaaattagccacacgtggtggcatgcacctgtagtcccagctactgggaaggctgaggcaggggaatcgcttgaacctgggaggtgaaccatccccacctcactccaatcagccattatccttcccatcctctgataaccatccttgtactctctatctccttgagttcaattgttttgatgtttagatcccacaaatacatgagaacatgcgatgcttgtctttctgttcctggcttatttcccttagcataacgatctccagttccatccatgttgttgctttgttttttatggctgaataatactccattgtgtatatataccacattttctttatccattcatctgttgatggtcatgtatgtttcttccatatcttggctattgtgaatagtgctggcaatatacatgggagtgcagatacttcttggatatacagatttcctttcttttgtgtgtatacgtggaagtgggattgctagatcatatggtagctctatttttagtttttgaggaacctccaaactgttctccgtagtggttgtactaacttacattcctaccaacagggtatgggggggttccctttctccatatccttgccagcatttgttatttcctgtcctttggatataagccattttaactgaggtgagatgatatcgcatagtagttttggtttgagtttctctgatgatcagttatgttaagcacctttttatatgcctgtttgccatatgtatgtcttcttttgaaaaatgtatattcaaatcttttgccctgttttgattggattatcgggtgttttcctataggcttgtttgaccttcttttatattttgattattagtcccttgtcagatgggtggtttgcaaagatttttctctcattctgtgggttgtgtcttgactttgttggttgtttcttttgctgtgcagaagctttttaacttgatgtgatcccatctgtccatttttgctttgagtgcctgtggttgtggggtattactcaagaaatttttgcctagaccaaatgtcctagatactttctccaatgttttcttatagtagtttcatgttttgaggtcttagacttaaagagctaatccttttttatttgatttttgtgcatagtaagagacagaggtctagagtcattattctgcatatggacatccaatttccccagcaccatttattaaagagactgtcttttccctggtttttggcacctttgttgaaaatgagctcactgtagatacatggatttgtttctgggttctctattctattccattggtgtatttgtctatttttatgccagtaccatactgttttggttactacagctctgtgttataatttgaagtcaggtagtatgattcctccagttgttccttcagttgttctttttgcttaggtaagctttggttattctgggtcttttgttgttccatataaattttaggatttttttttttgtatttctgtgaagaatgtcattagtgttttgatagggattgcattgaatctgtaggttgctttggatagtatggacattttaacaatatttattcttccaattcatgaacacggcatatcttcaatttctttcattagtgttttatagttttcattatagtgaccttccacttctttggttaattgaatccttatgtatttaactttgtgtgtggctattgtaaatgagattacttttttttctttctcagattattcactgctggcatataaaaatgctactgagtttcatatgttggttttgtatcctgcaattttactgaattcatttatctattctaatagttttttggtggagtcttcaggtttttccaaatataaggtcatatcatctgcagagaaggataatttgaccccttcctttctaatttgaatgccctttattcctttgtcttgtctgatagctctagctagagcttctagtgctttgttgaaaaatagtggtgaaagtgagcatctttgttgtgctccagcttacagaagaaagggttttagtttttctccattcagtatgataccaactatgggtcaaaatatattttttaatggtctcaattttctcttctatatgcagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaaggtaaaaatgaaataaaataaaatattcattcagtaacacagaaagcaaatgattcatttttcttttcttacatcactttgggatctttgctttagtttgggtggtatggaaacctaagaaagattttttttaatgagatataaattcactaaaattctgaaataatttgaaatatctacattttattatatatactgaagtctttgactgaatattccatttggttgataaacatgatgtctctaactatagcctaacatattcatttttagttaaagtgagtcatattaatttacttccattgtgttatctacttcaagaataaaaacgcagttaggggatcaagatagctagttgcatggttgtctcaatactattgatggagacattgaggataaatctgaagtgcattattatcccccaaattttctaggttatggtgtaaaatctattaaatatatcctaaaacattccagctattattaatattaaagaataataatttatatatgtgaataggctttgcctgaattttgtgctcttcaaacagtgggcttaaaagcaggctatgtttctttctggaggatcaacaggataatccatttcctgctaatccaagatgctggcagaattcattttcttgcagttgtaggactgaggtctctgttttcttgatgtctgtaaactgaggcccattcccagcttctagaagccactgcatttcttgactcatcatcctccatctttaaagccagctacattgtgttgagttctccctgcatctttctgactatgtaactccgttggacctacctggataatcagaaaaatctctctatctcaaggtgcttaactttaatcacagttgccaagtcccttttgccatgtaaggtacatattcatggatacagggaattagcatatggacaccttgggggaaaggggtgtgtattattctgcctaccacagagatttatgtatagtgagtaattgttatgatagtgttatacacaggatacaatgggaccacttgacacttgcaacaaatccaatctaaggggaccagggaaagcgtctagaaagagaaaccatctcaattgatgttaaccatgcagaaaggtttcgggtagggcaaggatgttctaggcatgcagttagtttgattcctgggagcgtcccagtcgggtttattgtatgaaacttgtctgtttgcaagtttcaggattactgttttttttccttttgctttattcattaaaaaactcagtgtacaacccaatttttatcattcacaagttatcttttctctattgatttaaaaaagataaataggtggatatttaatatatcatctaccagtatggatgcttacatagctcaacaacaattatgttttttaatcatataaataattgctgctactcaaccactaaaagaaagaccctgtcctacatatctggtatggcccaaccttaccaatgctgagcatgagaaggaaacatttttcccccctgaagtgacagcatgagaaagaagtcaaatagaaacagtatgtaattgactataaccatctgaatgagatttgtttagcaagatttggttctcatgacctaacagaattagcctgtcaactgtttttttgtgacctaccagcctactacaaagattctggcactgacacaggagaaaaatcacacactcacagcaacagcattaataatgaaactccctccgcaataggaggaattaattgtgtactgagcacagtcattaattataagaaccagagggcttgtagttaatgaatattcttacaggaaacaaaaactaaacccacctccaaggtgctgtgcttgcctagcgaaaccacagcttcctccctagtttactttacatccaaggtgaaaaacactgcgtaatctgacagtagccatagaaactgttgaaaatcaaatgtctcaactccgtaagaggaggtggataccttaagaggtacctaaatgttattaaaaggccatacattcacaattacagaaggtgaatgctaaggtatctgatatcaaatatatctggtaagtcaccaaatgtaatatgcttctaagaaagtggaagcatatgagtcacaggaaacagaaacaaacagaattaaaatgatgtgcccactcaactattaacataaagcactttgacatgttcttgggaaatcagattcttgtacagatgcttgtttagtaacaaattgtagaaatgttacctgaaaagcttctgatcccaaaacacatttttaagctaataatatgtttaatatcttttcagacattgctgtgattttgcactttcttcaaagtatttttccataaaagtgttaaagtgtaacagctaaagtaatttacattactcattttcattgttttttctcccaattatgttgatcaagattttgtgctgagtttttgcttattgtttttcttattaggacttttaggcatgtagttttttgtttgctgaagttaaacatttattgtcattgtccacaactaataaattcaataaagcctaaattttattgtacctttcaatcttgaaaaactgtaagattataaatttaaagaaggtcgaatctgaaccttaaatattttattatatttcatcaagcttttgatgtcatgagaattagagtcatttttaactaatgggaaatgactaaatgttcttatagaaagagtaatattaatattactattgaatagtaccttacactcaatgatacttacatattcttttttgtaagaccagaaatcgaattttctaaattttacttactctatatagcatatagaatgtatttcatcaatatttattgaataaatgggtgactggttaaatgctaagcaaaatgtagaagataaaaatgctttaaagcctttctggtgtgattatccatgttatttgatacaaaagctaggactatttctgtataatttatcttaattgtggctagttagtcttttctaattcatttagcctttccttagtactttaaggctgtgtgtcatattgattactattctatatttcatgttttgttttcttttttccattacatacaaattgatctttggacttttaaacttactttagtttccactaagtttataaaaagtaaaataaaatatctttcccattttattttcatctggcaacatggatctttagggtgcaggatttccagagaaatgtttatccatctaaattttcatatttacagcttcgtttttgtacaaaattgtcaatatcaagatgctcaaacaatacatcattctatttttaataatcactctttcacatatttttatgtaagtccctcatgtatgttaaaaacttacttacaaaatggagacatgtggagcctatttttttaatcctaggatgatctttctttaatagactacatagtagctataattgatggcaatatcccattgtacagactttcctgtctaaaatgctttgcattgtattgtgtgtattttacattatagtcattgattattgtgttagtccattttcatattgctattaaaaaaacctgagacagggtaatttatatagaaaaagaggtttgatggactcacagttccacatggctggggaggcctcacaatcaaggcagaagatgaagaaggagcaaagccacgtcttacatggtggcaggcaagagagcatgtgcaggggaactgccctttataaaaccatcagatcttgtgagacttattcactatcatgagaacagcatgggaaaaatccctccccatgattcaatttatctcccactgggtccctcccacaatgcatgggtattatggaagctacaattcaaaatgagatttgggtcaggacaatgccaaaccatattatttcaccccggccccttccaaatctcatgtcctcacatttcaaaaccaatcatgccttcccaacagtcccccaaagtcttcattcatttcagcattaactcaagagtccacagtctgaaatctcatctgagacaaggcaagtcccttctgtctatgaacctgtaaaatcaaaagcaaattagttacttcctagatataatgcaggcacaggaattgggtaaatacagccattccaaatgggagacattggccataacaaaggggctacgggcctcacgcaagtccgaaatccagtggagcagtcaaatattaaagctccgaagtgatctcctttgactccatatctcacatccaggtcacactgatgcaagaggtgggtccccatggtggtgggcagctccatccctgtggctttgcagggtacagcctctcttccagctgcttccatgggctgattttgaaggtctgtggctttttctcatgcacagtgcaagctgtcagtgaatctaccattctggggtctgcaggagagtagccctcttctcacagctccactaggcagtgcccaagtggagacactgtgtggggggtcccaccccacatttcccttctgcaccaccctagcacaggttctctatgaaggctgtgcccctgcctgcacatccatgtgttttcatacattctctgcaatctaggtggaggttcccaaacctcaatccttgacttctctgcaccttcaagcccaacaccacatgtaagccacaggcttggggcttgcaccctctgaaacaatggcctgaactatacattggtcccttttagccatggttgggacacagagcaccaagccttgaaacagcacaaagcagcaaggcccccatgaaactattttttcctcctaggcttcccagctggtgatgggaggcactgctgggaagacctctgacatgctctggaggcattttctccattgtcttggcagttaacatttggctgcttattacttatgcaaatttctgccaccagcttgaatttctcctcagaaaatgaggttttttttcttttctatttcatcatcagcctgcaaatttttgaacttttatgctctgcttcccttttaaacataagctccaattccaagccatatctttgtgaattaataaaactgaatgcttttaagagcacccaagtgatatcttgaactctctgctgcttagaaatttcttctgccaggtatcctaaatcatttctctcaagttcaaagttccacagatctctagggcggggcaaaatgccaccagtctctttgctaaagcatatcaagaatcacctttgctccagttcccaatatgttcctcatctccatctgagaccatctcagcctggactttttggtcaaaaccatttgacaagtctccaggaagctccaaattttctgacatattcccgtcttcttcagagccctccaaactgttcccacctctgcccgttacccagttccaaagtcgcttccacattttcaggtgtcttaatagcagtagcccactctattgataaccataccccactctgttggtaaaagctatattagtccatttttatgcagctatgaaatagctgggtaatttataaagaaaaagaggtttaatggactcacagttccacatggctgggggagcttcacaatcgtggcagaaggtgaagaaagagcaaagccacatcttacacggcgacaagcaagacagcatgtgcaggggaactgccctttataaaaccatcagatcttgtgagaactcacttactatcatgagaacagcatgggaaaaaacccacccccgtgattcaattaccttccactgggtctctctcacaacatgtggggattatgggaggtaccattcaagatgaggtttgggtggggacacagccaaaccatattaattatattttgaatttgaatggacatatcttccagttatgtgtacttcatcactagatattataaatatatctctagtatatgtatcttttctgttttctttgtatgcaagtttttttatattttaaatagtcattttctattctaaatagttatgaatattaatagttgtgaatagtccagtacacttttcctgttcctttttttcatgctacatttagagactaccacaattatggcttatgattaaccaatgttttctaatatttgagatagtactatgtgtttcattacttgcaagttttctcttctctttttgttaaaaattaatgtcatactataataatatgtcaggtgtatcttgaattcctattttcgttggaggaagacttaattttgaaatccccaaatctcattattattattttattgttattataaaacactattaaatcttatgaatattacttcatttttcctcatttgagaatatcattaaggtttttccctgcagtcaatttattagcttttataagcccaaagcataagctttgcaacttaattagtagaaacctaacaacacagtcatgagctaacaccaggtattatttactaaggcagaaagcccaaagccatttattttcacacaaaacgaaaactagacctagaattattgtacacaagggtgtattactgaagtcagtagtagttccgtcatgtctttcatccaaaggaccttagttttatggttttagtatgttctagtatgttctgcaagtgatatctcctctcagatttattattcaaggaattgatcaccttttataaattatagtaatttttaaaattctataagtaaatgtagttaagaggtatttttattattacgtgttattaatgtttaatttcaaactttttatcttttagagatgcttaaagtctcatataattaaaactatgtattattaattatttctttctctaggtctaaaatccaaaagcattaatgtactgataagagacatagtaagagaacaatttaaaatttttcaaaatgacatgcaagagactgtagcacagctcttcaagactgtatcaagtctatcagaggacctcgaaagcaccaggcaaataattcaaaaagttaatgaatctgtggtttcaatagcagcccagcaaaagtttgttttggtgcaagagaatcggcccactttgactgatatagtggaactaaggaatcacattgtgaatgtaaggcaagaaatgactcttacatgtgagaagcctattaaagaactagaagtaaagcagactcatttagaaggtgctctagaacaggaacactcaagaagcattctgtattatgaatccctcaataaaactctttctaaattgaaggaagtacatgagcagcttttatcaactgaacaggtatcagaccagaagaatgctccagctgctgagtcagttagcaataatgtcactgagtacatgtctactttacatgaaaatataaagaagcagagtttgatgatgctgcaaatgtttgaagatttgcacattcaagaaagcaagattaacaatctcaccgtctctttggagatggagaaagagtctctcagaggtgaatgtgaagacatgttatccaaatgcagaaatgattttaaatttcaacttaaggacacagaagagaatttacatgtgttaaatcaaacattggctgaagttctctttccaatggacaataagatggacaaaatgagtgagcaactaaatgatttgacttatgatatggagatccttcaacccttgcttgagcagggagcatcactcagacagacaatgacatatgaacaaccaaaggaagcaatagtgataaggaaaaagatagaaaatctgactagtgctgtcaatagtctaaattttattatcaaagaacttacaaaaagacacaacttacttagaaatgaagtacagggtcgtgatgatgccttagaaagacgtatcaatgaatatgccttagaaatggaagatggcctcaataagacaatgactattataaataatgctattgatttcattcaagataactatgccctaaaagagactttaagtactattaaggataatagtgagatccatcataaatgtacctccgatatggaaactattttgacatttattcctcagttccaccgtctgaatgattctattcagactttggtcaatgacaatcagagatataactttgttttgcaagtcgccaagacccttgcaggtattcccagagatgagaaactaaatcagtccaacttccaaaagatgtatcaaatgttcaatgaaaccacttcccaagtgagaaaataccagcaaaatatgagtcatttggaagaaaaactactcttaactaccaagatttccaaaaattttgagactcggttgcaagacattgagtctaaagttacccagacgctcataccttattatatttcagttaaaaaaggcagtgtagttacaaatgagagagatcaggctcttcaactgcaagtattaaattccagatttaaggcgttggaagcaaaatctatccatctttcaattaacttcttttcgcttaacaaaactctccacgaagttttaacaatgtgtcacaatgcttctacaagtgtgtcagaactgaatgctaccatccctaagtggataaaacattccctgccagatattcaacttcttcagaaaggtctaacagaatttgtggaaccaataattcaaataaaaactcaagctgccctatctaatttaacttgttgtatagatcgatcgttgcctggtagtctggcaaatgttgtcaagtctcagaagcaagtaaaatcattgccaaagaaaattaacgcacttaagaaaccaacggtaaatcttaccacagtcctgataggccggactcaaagaaacacggacaacataatatatcctggtaagctgttactgaaaagtaacttttaatctctctttttacttaaatgatatttaatagatctgtacagttgagcaagaccattaaacataaaactacatacttgaacttggatagatagtcaagttgtgaagatcactgacattatttaaatctgaatctatcttacagtatttcagacatcaatacaaaacaaatatttctagtgtatatttggctatgtgtttttaaaatttttctgactagacctctataaaataattaaatttgctcctatggaacaatttgctttgcacaagtaattaaacaaagctattaggcaaggagatctttaatagaccagatttacttattttggcattttaccatatctgatatgcaataggaactcagtaaatacctgttgaatgatcatctgacaatgaatgttcaggaaatagatttgggtaaatcatagaaggccatcaatgccaagctaagtacttagacatgattttgtaaagagtagggtgtctgaaaattggtatcagtggattggttgtgataagagctgcaactcagaagcatgaagctagcaatagtgtgtagtgtgattgcagaggtgatattagggatgttactgaatgaatattggcaagagccatagaggaagctctaaggctgatgtgagaaatgttggaaagttcccatcaacagaaacagagggagagtggcaagaaaaatgatttgaggaacatcaaatcttgattctggtcctagatgtattagtaagtttctgtgttagttaatagcactaggtaaaaagttcacctctctaggccttagtttcttccttttaagtgatgagattgcagtaggtgatttgctgaggtgcttagtagagatatgccgaagactgcttcactgtaaaaaaatccacgatctgttcacagccttaatgcatgacacttggagaagagagagatctagactttcccgatgttttgaatttgggaaatgacagaatagtggtaccattaacagatgttctaaacaccaaggaagaagcatgtatttgggaagaaagaggaattgtgtggtgcatataaattgcataatagtacctctgtatgaaggaagtgttttatgaatatggttgtcatataagtaatattgaataatcttttctaaatatgaatatctcttcattcttacaaaaagtaatggctgtgtttttctcatatgagtctgctgttaaattatagcccatttgtatgaattttgtactttatttctttttaattacaaaggatgatcattattctaacataatatgacttcatatttaatgtatgaatgttttgataatattaaaaataacagaataatagagttgaattatctctactatttaaattagtatatttatttatgactcccccagagtaatctgacctaatagaactaattttacttctgtaggaacatagaagaaactatttagacgtatatgtttcccagagaaaggtagtatctcaatataagatgttcttaaaataacaattttgggagatataaggagttgttttttccatactatttccattattggtcttcatgtggacacttcatcatgatcttcaattagctatacagcatgtgtgaccacacaccaggcaagctatgtcattttttaaacatatatatatatatatatatatatatatatatatatttaaaatatatatatgctattttcatagtaagtataaaattgaaatagcctcaaataaattgaggaaaaacatttatagaacattaagaacttgcaaactttgataatataatgaatgcatgttaggacattataaaaattgtatctagatacttattgtgattgactcaatattgggcttaatagactaataataggaaataactcagttttgattcttattttccaataaggctttgataacattgcttcctgttcctttatttactgactgtagaactttttatgttcctgtctaccaaaaataactattaaagttctttattttatttaagcaaagataccaataatgatgccaaggtaataaagatatactgacctaattcccacgtgcaaggtagatattccttttatgccaggccgggccagcaacataatgtatgggacccttttaagtggttgcataggtttgcatgcccattaagccagccatacttccatgggccatagaacagatgtcaatcattgggcagctcagcaggcaaggtctatgaaagatgatgaaaccagtggactcaggctaagttctcctgtaagaatagaacaattgcagaataaactactacttttgataccctgttttataccaggggtgggacacactgtttaaatttggctgtttcatttcacctttgatattgtataagtattatacagccacattgctctcccacataactaaagccagaagataatttatcatcatcttatgaatctcagagtcatattattcagattctagctgccatcatttgcaaaataagtacagtatatagaaaaaagcatataaatatagtgttttaatcttaattttaataactgataacttactttgaagcctgataatatgaataccgtaataatacgacattggttagtattcattaacatttactatatctcaggcactgtgaaaattcccaatattcataacttcatttaacaatacctgtgaggtaagtattattatttattctgaagatgagtaaactgaccctcggagacattaactaaagtatcctgcctaaggtcattcaactagtaagtgatagagcttggcttctggccagctagactcagggctcagtcctcaaccacatgctcaaagaaattatagagtgtgttcacatgcctttctcttctttctgtttctgtttcatgcatcatatgttcttcagtctggccatatctgaatattccatatggctggagccgatatttttagggagtttcttttcttgaagatccaaatactgacaagttgtttctgcacatgaggaagtagaggtgctacttttcagtttggcttttttgggatatggccagtgggtacttattgaaagtcaccatcagatagtcacaagatcttcctttgactgacgaagaagagggacaaaattcattattctcatccctgccacttccttttgagccattcctacattcattcatgctatttctgattcctagtaggccactgatgataagatattctggttcaattgctaaatatttgatttgtttctaaacaatattctaatagacaccaagaggtttttatttcatctttgaagatttgtttgtacagcaattggcagacttatccctgcagagagcttttggctgcttgcccttccaaaagcagctgaatcctgacttaacacaatgtcagcagctcactgctgagcatgtgcacctcctgcttgtaaaaccattggctttttatttcaactttttctctaatgtttatcaatttagctccccttcataaacctctcttattaataattattcctgtactcccaagaaagattactttctataaaacatttggtagtgttttaaaatgtaattttaaaaattatcattgatgtgaatatatgctatttaaaagagaaaaaatgaggacctagtgaatatttaactgtcttatatcacattgaaaccatttctaaattttgtgactctgcatagaggcagctgtgatgactaatgagccctgaatttggaatcaggacaccagggttcaagtcctgcctggcaatatatttatttgtaataagtcatttatttttctaggcctttctttcctcatttataaaataagaataacatacaaaccttataagtttattttgagaatcaagaatataatctgcagatagtgtattaagttattactatatgatgcaattttcttagctatattcaatgtatatgcttttattttctcaacattttcacttaatatttgatatataattatttccatgcatcaacatagtttacaaacttatagcatctcattgttacttattattactttgataattcactgtgttttaaactccgcatatgcttataacttagcttatggtcatcatgcaatgataaatcaaaaagaataggatacaaaatataaagactgtgtaaaaacatgtgcattgataagcactgaaaataaatgtcaaagaatggttttctccaagcgattttctactatttatatgattttccatattataaaatattttcaaatatacctcaagataactaataggttatcttctgtacaaaatggctgaatataagcccgttaaattttgaaagctatctgcttcaatttagagtttagatgtgttttagaagtcccccaaatacgtgtacgcatttggtaattcaatagaagtgctcacaggatctggcatatccatagtgttcacatctgtggcttattatggcaaaaagttcgtaacaggatcagctaaggaaaaagatacaagcagagtctggagaaatttaggcacaggattttttatgtttatccctcccatgaaggacaacatttctgtgtgctctttttttctagtcacacacacatacacaaaattagtaacgtgtacattaattctgcccatacaagcccatcagatactcagcacttagttttactgggggctggtcacataagcatcctctgcctaggacataccaaaactccatactctcagaagggaagcagatattcagcataaatcatattgtttgtacaaagagtctgggcatggtgaatgacacttaccagttagggaatggagagaagtcaagttcccagatgctaaccaactgcaaaattttccaagtaggcctttctaaagatatcagtctctggcctactatgttcactcttctctgcagattatcttaaagatattcttcatgtcagaactggttaggaggcctgtctgctggggatggcctccccaatttgtgtcaataaaacatatcagtgttgaaggaaatagtaaatgaactactttttgttcatggctctctgggagaagaacagactcccccagatttccatatgattcccttcatatggaagaatgatgacagctaaagagcaaatgctgacaaaattgacaaccttttctgtcaccttgtcctcaataaagtagccaggctatctaaggtgcatagtcagaaacccagacgtttaatgatcacattctctgaaccaaaatgtctaacatttgctctgacatgaaaaaggaaatgggatggaattccaggttccatttacacagtcactgcatatgcttgggttctttcccaagcaaaaatcacaggagctacttcccaacaatagacgatttctttgacaccaaggatttgaaacgaaatttgattcttaacttgtctgtaaattaaatgcaataaacatatatttttgtactggtcattaactatattatgaatttaaaattgtactcaatagtattattttgtaacttattgattatcaaacatgaaaaggaaggtggcaggattattaaattacagattgtaaatttgctatggaatgatctaagtgaacatgatattttcatcctgacaaaaatcacagcatagaaataacagctgtgtaatatactaactgcatatgaagtctgaaaaacatactttaagtttttaattgccagttttactatacatagcttaaaatgggctctccaaagaaataattattattttaggatataaacctaatttgaactttttaattccaattatgttgacagcattgttttaggggaaaatatcacatgaaactccattgatatcaatattaataaatctaaactcaagtgtctttaccctaaaatcaaattaccagtaaaattatgacacagtgtttggagaaataaagcaatcaatgaaaaaaaatgatcgcatgttgtgccagaatgataaaagttctaaactacacttatttttttactttttacaaaaaagtaaacaattgttttacagttaatgaaccttcctttcagaattcttttccagactttataatcttaaacgagtgttaagatttgaaatttgcgtggaaatttagatttgagaggtattggcatgaaaatggtgtttggaaactctgggtgtgggtgagcagagccaggggactcatgtaagagcagagtcagaggaagagcaacctctaaagcttaactggagagagagcagtctggagagaatatcaagaagaaacaaaagagacaggaggataagcacatctgatgtggacgttagcatatgattgcattttccaggcctgccaaaataaattggaagttataaaaaatacttactatcccaaatcatcatctgaataataatgagacatcaacactaccttttatatataacctaaattcggtgactttattgtcaactaagaaactgcttgtacacaatcatgtgtacgtgtatttagtcatttacttgaataggaaatttgtttgaaaatgtgaaattgcagatttacctcaagaggatctttgtaaaacactttcctagatggatgctacaataaagacaagataatttctattattcatggttatattagcttaaaatgttgtgctaaaacttcttaaagcagtttttgttttaggacccaaatgaattatttttagaattatgagtattattggaaagttataatgattcttaattttccaacttgattcaacaaatattacgtaagtcctaagtgggatcaagttagaaagcaaggctctggctcagaaagctttgtaattttttgttctagaagaatttgatagtgaggctgggagcggtggctcaccactgtaatcccaacactttgggaggctaaggtgtgcagatcacttaaggccaagagttcgagaccagcctggccaacctggcgaaaccccatctctaataaaaatacaaaaattagccaggtgtagtggcacgtgcccaactactagggaggctgaggcaggagaatatcttgaacccaggaggaggaggttgcagtgagccgagatcatgccactgcactccagcttgggcagcagagcgagactctgtctcaaaaaaaaaaaaatgatagtgaaagatatacctatagagcagtgcaatgttctgttatattttatactttttttgatattttggtatgtgcataagaataccatgttattatgaagctattttgaatgtgaaagaaaagaaacaacataccacagcatattctaactatttatctaacttgtattcaatttttgacttttgtacattttaatttttttctctattttaaatagtgccacactaattaatttttgtgaccatctctaatcttatttccttaagataacatccaagaagtaaaattactggtgcaaagcccatgcacattttgaaagaatttgataaatattgccaagtttctcttcagagagtatcaatttacgctcccttgagcaacttatgaaagggccaagtgttatacctgtgtgcacatatatacacatgggcacgttaactttgcccaaaaagtttgtccaaaaaattaaaaaatatttaaatatgagacttttaacagacaatgatgacactatggatatcttttatttttatcattttaataggcgtgcagttatatctcattgtaattagggaagcagatttcacagctatatggatgagggttgtttagaggcaggcaaagcgatgttaagacggctataatcatctagatatgagaaaatgagagcatcaattagaaaagttaatggggatggaatggaaatcaaagagcagggagattacttttgagaagttacatttggtaaaataataagttttatagacaacaaagaaggtgggatgatgaactacaatattcttagtgattttgaaatccaaggtaggaaattaagggacttgaaacaacgcgagtttatttgtttgtggtataacttacatttagttaaatgtactaatgttgatagatagcctatgagttttgacaaatacatagtcgtataaccttcaccataatcaagatagggatcagttccatcaccaccccaaatttcctcatgcacctttgtagtcaaacctgttcctactaccaagcactagcaaccagtgatctgttttcttcccagacaattctattttttccagaatatgtaagaaacaaactcatacaatatgtggaggctttggagtctggcttctttcacttcatgtaacatatctgagattcatccatgttcttgcatgtattcatttttattcataagtagtgtatagtataaatatacaatttctttatctatttaccagttgaaggatctttttttggttgtttccagtctggggttactgtggataaagctgctataaacattcacatacaggtttttgtatgaatgtcagtttttgtttctctcttataattatacagcagtagcatagtttggttataagatacatagttttaactttagaaggaatgactaaccacttggcatttccatgaataatatatgagaattctaattgctccaaatttttgccagcacttgacattgtcaatatctttcatgttattttagtaggtacatagttatatctcactgtggttttgttttgcattttcctagtgactaggaacactgaacatattttaatgtattggtcagacaatgtttttaattcttctcttgattgatggttataactctaaagaaaaaggataaatcagttcacgatatcaaacaaaaacatttaatttcctaggtcacagcttaagataacaaaataatagcaagggataaagtaaatcctttcggacaggtctaagatatttgctgaagattgctgatacaactaaatgtgccttaaagtaatatatgaagggttgaggaaaaaagatcccagaaaacaatataagaaacaattggtgtgatataaaaagaataccaaaaataaaaactgacagtttgaaggaaaagcagtaaacatggtttgaaacagtatttccatccatctatacaccaaagaacacaatgttagtaattagagcaatgcatttgaaaacttaataaaaacaaataaatgttagtattcctagaagttgctggcaatgggcatatgaaatatttctagagcaacaggaagataagccttatttgatataaacagttttgacaaatggggaagcataatagcactgaaagttaagaatgtgtccattaatatggaaatgaaaacattttacagagcattggaatcaggatgaaacataaagaaaagtgcaaatgttgtgtgggcatgttacctaggagcagatttgtgtaatgctttcatctgtgtattataaaatgggaggacaggcaaaacgataagttccctcgctaatctcttggaaactccattgtgtcctagcagagatcagttatctgccctctacaatgttactgtttacatgaagaaattaagattttgatgctaaagtagaagtaagcaataaaatataaagtaaaattaaaataaaagtatatgatagataacattatatgtaatagaaataaatgtaagaatacagtagaaatcatcaacacaatgtatccctttattcatcaaattcctgttgaatgagttctgaatgagcactgaggaaagttgagtgaatagagcggtaaactcaacacagcccctcttctcatgaagttcatacattaatcgagtaattataataaaaaatgacaaatattaggaatgacagggtgctttgaaaatgcaaggtgctctccaattagttcaaatatgtacatttatgaaatatgaaactaggattaatagaaaattgtaactagagcacatattagggtccagaaagcaaagaccagaataaattgaaatttataaatgaaatatcagttatgctacttgcacagtggtagaatgttgacttggaagaactattgaactaattgcactgatctccattaaaaaaaatggacaggaaggagtttaagaggttattgaagctcaaggtaaggggagaagttgtggaaagttcgcttaaatggattcacttctgggcacagtggctcacactgtaatcccacattttgggaggccaaggcaggtggatcacctgaggttggaagtttgagaccagcttggcccacacggtgaaaccccgtctctgctaaaaatacaaaaaatagcctggcatggtggtgcacacctgtagtcccagctacttgggaggctgaggcaggagaatagcttaagcccaggaggcagaggttgcagtgagccaagatcatgctactgcactccagcctggacgacagagcgagactccatctcaaaaataaaacaaataaataaataaatagattcatgtctctaggataacatgacaatgatagcatagtgtcaaactctgtgacatttgagaaactgggaagaaggttgaaatttgataagaatgtggtattctattccatcttttattaatttgtctattcatttttaaaactactttagtattttctatatgtcaggcactgtgctaataaggttgatatgaagtttaagtcatagagaacatgatccctgacctcatgaaagctcatactcttgttggaagtaagaaagacaccaaagcaattacagttgagtgtgatgaattcaagaagacaactttggagcatcaggcagcaatggagagaactaaagtgatttactcctagggatgaggaaagatgtcataaagaaaatgatgctttattggagtttgatttttgttggtaattcaagaacaagtagcctattaagcacaaatatgagcaggtacttataaaggtacctaaccattttttaagcgttttaataataaaggagaaaaataagtcaggtggtgtacaaaagttgattttgttttgttttgttttttgagatagagtctcactccgtcgcccaggctggagtgcagtggcgtgaccctggctcactgcaacctccgcctcctgggttcaagtaattctcctgcctcagcctccggagtagctgggattacaggcacacaccaccacacccagctaattttgtatttttagtagagatggggtttcaccatgttagccaggctgatctcaaactcccgacctcaggtgatctgcccgcctcagcctcccaaagtgctaggattacaggcgtgagccaccgtacccagccaaaagttgatttctaactcattgtataacaaagtacaaatagcttcagttggaaaatcagtgccattcaatctttagttgtctgttataaggctctgtacttgtcactaatccatcaggtattttttttctagtacgtatttttatcgataacttggaggaacgcatgagacataaatttggaaatgataacaaagataggggagggtggctgaaacatctatacagaataaaactgaatgctttctatggacagagatggtaactcatgtctaataagataaattttattatcaataataattgtaaattcatgtttaaatgaattaaatagacatgagattttagaaagcttcaatacatcagagcacaggagacctgttatgagacagtgtgatacagatgcagaaatagacaatgaatacttaatgcttgtgttatcttgacagaagtgtaagttcatttcagcaggggtaactagcaattgctaccataacctactatgcttgggctcaactggtacaatatgtccagttctgggtgccatggacatgattttatattttaaaatgtgattattttggcagagacttggaaagtccagacatacctaaaatagcaaaaagaggcacagaaaggaacttaaaacagaagcagtcgaagcaggtacagacaagtggctgaggcatcctgagcagataatcagtaggcaccatgaaagatgtcctagaaggcaagctgtgtgcagtctcaagaagtttgggctactgtaacagtagtagtagatgcagaccttcaattaaacttaagtgtagccctactccagatgaatgaccctaaaaagaaattggaaaatggggtaaaatagcaccctctgaaatgactcaaagaactacagcaaggcaagacccaattcctaaagtaatggaacataaagaagcaaaaaatggaatgctgctcctggacattaaatagcaggcagaatccttgatcctgaagattcagagtagagccaacagcaatgcagataaatctaattttttccacagtttcttaagttctccttatagcacagctttgatccctgattcatgaacagggccaaggttacaggtgactgtgattttttatatttgggaaaattaaaattatagagctgatcaaattacataaataagttagtgttccccccaactctactgcacaattgatacattcctagtgaaacccattaattgaaacttctcctgtgagttgatcactgtgctaaattcagagaatgtaaaaataaatgaagcaaatgctttgatacagaatattcacattactataagtaatgaaaagtcattgatgtttttaatgcaggaaaataatgggcaaagttctggaatgttaatgagcagcaaaaaagggatttgataatctattcacatgcagcaaagtgaggttaaaggaatgttagccagtcgaaatatttgttaaaaggtattacacacatgtaatattttaatacttttcttaataaggaaaatagtttatagaatattgcagagaatatatcaagataattctgattaatttctcattacataagtacaatattaatatatttgctttgcaaaaaattttaataatacaggcatgccgtttgttcacattttatgtgaatttcaattgtatggctatgaaacaaaatgtatataaaaatttataggtctcacttcatgagaaaaatattacacaaaacaaataacttccaaattaaaaatcatcaacaatcacctggtttgaaatgagtggatggtaaactacatcattaccataaggtggcaccagagtaactgtggcaagtagtataagcgctgaattcttctgaccttgtttctgcatttacataattatgcattatgtttataaccatattcataatttgaagctttcacaacaaatgaaattattctatatgtaatgtgtgagctgtaactttctgtcttcagtaaaccaaacctgttggagaatctacctcattctttaattgctgtctaatattcctcagtgggaatatgttacaatttatttaacaagtcctgcatcagtgatcatttaggagtctttaaatttttcaagaatgcaagtgatatcattttgaattgaagaattgtctttgtgcacatggacaagtatgtctggagtatatatatactgccagaagaaatgtttggctcaaagtaaattaacctttttaatactgataaatatcgtcacattgtcctattaacagctatagcagtttacactccagccagcattgcatgaaaaggcccattttcccttatattgacatgactggatattttctacgtatctttttaaatgttgccaccttatatttaaataatgttattattgctaaatttattatttctgaattagtaatgaggttgcatatgctttaaaacttttagtgaccttttgtgggttttgttcaatgatttgcctactgatacattctccgttttttaacttatttttttctgatctgtaagtgaagaccattttcttatttttatttattttttatttaaaaaattagagatggggtatcactatgctgctcaggctggtctcaaacacctggactcaagccatcctcttgccttggcctcctgaagtggtggggttacaggtgtgagccaccatacccggcctcattttccatttttaagggagaattttttttttcttttcagagtttttcatatgttatgaatattagtcattagattgccatgtcttctaattttgtaacttatcattaaactttgaaaatggtggttttcaatgcaaatgagttttaattcttaggtcaaacatgataatgtttttctcttatggtttctgagttttgttttcctttgctttgctttgttttgctttgaaagaattttttaaaattttaaagctctagaaagatattctccttttttgttgtaatgcaatcatattggtttttttatatttagtatttttgtatatgtggaatttatgtttctaatatatattcaataccaccttagcaccatgtatcgaacagatatttttcttctcagtgatttaaagcattacctttatcaagtaccagtttcaaatatacatgatttgtattgagataattctattctgttctgcagttgacaagaatgttaacatttcacaccaataaatgtaatggatcacagaattttgcccactttactgaaggagatagagagatcagagctaagggatttgcatgacgtcctgtgcccagatcgacaggcatcctgggccgtggagcccatttttcttacttaaaattcagtctttttcctattctgctgcaaactacgatttgagatcaacaggaaaataggtcactttattctcttttaccttgattctttttccgtaacagaggagtattcaagctgtagtcggcatccgtgccaaaatgggggcacgtgcataaatggaagaactagctttacctgtgcctgcagacatccttttactggtgacaactgcactatcaagcttgtggaagaaaatgctttagctccaggtaaaaaaaaagtatacgcatctttggatttgctcattgtcataaatagaaacacgttttgaaaatatttattaatgaatatttaagcctgcttaatctggatccacttgacaattccttttactttttcgaaacttactgaagaatgtacctgatttacaagtggaaatgtccttttgttaggcaaattcttattcacatgcacctgttgaaattttcaatattgctatatagaggcagtttatggaaaattctaccccctcacaaactttttttctcttgtgcatcctaaaaatatatggatgtatatatctgactgatagaaacactttctcctcaaacaagcagttaaagaaatacgcctttgatttatgtctggtatggtcatttaaatgaggctttaatacatgcttagtaacacgttttctgtgaaggttaaactaatggcaccattttgactgtgtgagaactgttagaacatgctcaaatgtattaagtaaaacaagatggcttttttatttatttaaattcataagtattggtgctttggatttacttcaggagtgcaccatttctgatttttatacagaaatgtatgtgcagcataaaaatgtgttatttaatgactgcaaaaaaacctatttcaaatcagctttttcttaataatatcctgcatagtgaaatgtaaattttttagtctgtttttagatctcagcctttgtaagtacaattggcattaattacacagaaaattgcctttgtctactttgctgcagtgaatatgactttatatggttttcgttttagcctttagaaactgcttgacaaggtgccggaaaaattgtttctacatcatgtcagcttcaattcctgcaaggggctttaaaacattctgacataaccataataatcatagagtgctttgaattcctttatctctggggagatcaaagcaacatgcaaattatctttgaggcatttctgtgaggaaggtatcaaatgttatttttattctgtcctgatctaaatggagaaactgaggcaacaagaggctaagcaatttagagtaatttaccccagagaagagacaggcattgagacacgtgcacctttgctaagtttgatggatggcctttctcttctgctaagactttttgtaactgagataaaaatgacgaagatataaggaaagaaaaataagataaaaacatgaaaattaactcttgccattttttcctctaacagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggagtatatgttttcaagtacaccatcgagtcatttagtgctcatatttctggatttttagtggttgatggaatagacaagcttgcatttgagtctgaaaatattaacagtgaaatacactgtgatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaaacagccagtgttttcatttatctttgcttgcacatctgctctgttttggtttttctacaggaaatgaaaatcaacttgtttttttaatatgagtaaacttgtatgtctattttataaaattatttgaatattgtttaatgtctgaatatgaaagagttcttgatcctaaagaaatttagtggcacagaaaacaaagtgaatttgttagcataattattcctattcttatttcttcattttaagtcattgcaatggaaagtaatattataaaatggtaattacaacatattatcagtcacagttttctttccaattaaacacttaacttttgttattccctgtatataaatatataacacacattttctagattcacaaatttaaataaattactcaaaaaatgaaaattgattttgtaaacttttatttttactctttacgttgagttgatcaattttccatactaagattttcattcagaatcaaaattaagaaagttggactgaaaatatgaaaaatgcttaactattgttctcttcctataattctctaattataacatagtaatttacatgtagttggacatgtacactcaagtctaagaatatatgagtggatcatttaccgccccccgccccacaacatctataaggggcaaaaagtctttttctaataagtattcttctatggtagtacctacagatctgcccttcttcttctaaagggtaagtcataatctgtgtaatactacaatttatgggatgctcactatgccctgtttctcttctaaacaatttacatgtaatgtctcattcctcacaataacccttgtaaagtgggcatgattaccatgatttttatagttgaagaacctaagacacagagaccaaggcccatgagctcatagggctgaggcaggatttggaatcaggccatgtcttctccagagcccacatccatcctttctctatattgcctcccacagatgtgctaaaatttatttaactaatcctttatcctctatttgtgttgtctcccattttttattattacaatattactgtggtgaacatgcttaaaaatacattccttggatatctgacaacgtgtttctgaaaaacagattttcataagtaataataaaaataataataaaaaagttttggtatggtaagccttttttatgaattgatttgtttaatgatcactataacataatgaattacatattaacctatgatatttgtactacatattattactctctttctgcccatgagaatcagaagcacatagaagttaaataattttctcagtagtataaccaatgatggagaatttctgggacaaaggatgatcataattttccatttcgatgggtactaacaatctaagtctatgaaaaactgctctttataccccacacatcctcatcaaaattaacaatttttgaaatatttccagtcctgaaagtgaatatcttctatttgtagaagatacttgaaaatttttcaaatttgctaaaacttgaaagcatacatccatacaaagacttgtaagtaaatgttcatagtcagtttatttgtaatagctgaaaactgggaatcacccgcatgtcccgcgacagacaaagggttacgcaaactttcgcatacaaatacaatagagtacaacacctgggaatttcacaataactatgcagaagattttaaactgcagtctaacaaactttgtcacctctgcaaggaggaactctaaagtaagtattgtccatcagaatgtcctgcgctgagtcaaaataatcaggccttcataccctagcctcactcagtactagattcaggctgccaaagaagagtgtgacctaagagttaaaaccgacagctggatgcattagtccatcctcgcattgctataaagaactacccaagactgggtaacttattaagaaaagaggtttaattaactcacatttccacaggctgtataggaaacatggcccggaaggcctcatgaaacttataaccacagcagaaggtgaaggggaagcaggcacgtcttacgtggctgggggaggtggaagggggagaggtaggaggtgccacatacatttaaacaatcagatctcgtgtgaactcactatcaggagagtagctggggggaaattcacccccatggtccagtcaaatcccaccaggcccctcctccaacactggggattataattcgatatgagattttcgtggggacacaaattcaaacatatcactgaatgatgacaatttttatcctgttatgtgtaaacatgtcattttcaaaaacatttaaaaagttcttatgatatcttcagtccctgcctaaaaatttactataatctaaatttttaaaattttatttcttcaa

SEQ ID NO: 12677 - DNA, 119930 bp, Human
ccaggaagctgtcatcacctctcttcattatactaattgctctgaagatgaaataaggtttgtttctcccttcttatcctactcacagacctagctctgctacttcagaatagcatctgctatgggtcaagggaggcattttcccccctcattatacagagactaaaacaggaccatagcacgtgaataactcaccctggtccacagccagtgagaggtagcccaatgtcccagcaactgtcctcattcgtcagggtgccccagtggctgcctttatttcagccaggcatgcctcactctctcccatacaagcagttctcactccaacctttgtataattttttttttcacaatttcttcccatcctagaacagcctcttcctcccaatacccaccatactatctgagcatagttaggcctctatgcccactccagcctagtctctctcccctttactctcactgccctggacctcaccagagattagcatcagtgtcctgttttatgacctaattatgtcatgtgcattgccttgcctgctgcaatacatgccagcctgctcgggcaggccaaatcttctatcataatactacggggatattcccatagcaatgtagttctgaggccataggagagatggatacatagtttgtggctgaagtctgtgtaatctactaggcttaaagcatctcttttctgcatgttttcaagcaaggatgctgaattctacatgtaatgatatgttataaactctacacacattggaacctctcacatcctctcaacccacctcttattccagccccctctgcagcctgtttcccccggctgtcccccaccccccaaccctctgagaaacaacctgacagcgcctcaccttttgccatgctatgcacccagggcttctaagagacaaggtatgggaccatgactgaaactcaccactgctgtagaacagtgcagaggagttaataaccctaggatctcccttaccaacagggaaggataaagtccatggataaacgcttgccccttttgtcctcgacagacagttctgaggctctctgaggttcctgcaggactgagcaccttttgttaaggccatggccaaggcaaccactttcccttcttccccatttggctctgaccttcaatcttgctccctgctaggcatttccttccaggctctgctttctgcccctcccctccccctctcttatgttttaatgactaatgtcaaggtcccgctgaggaaaggtcttatatgagcctgttctcagaatattaaacgcttccagtgttctgctggttatttgaaggaggacagttagaacgactacattctagccagggctgtcctacttgctagagagtaacttttgctggattaggaagtaacctagagcaaagcacttcgactttctgggcagggtttctcagctgtaaaaatgggataatagggaccccggctactttgcggggcttgggggatcaaaggagttggaaagaggaggttatttcaaaaccgaaggagctgaatagaagaatctccgggttactctggggcaaggaaggtggagaccacggcgtggcccctcaggtgtctccagtgctccacaagtcaaaggagtccaggaccctcccaaagcgcctgcgtcgcggagcagctgggttcactctaggctgcccgctgcaaatccgcggtgtttaccagaatccaggtggtttgcaaacccggatgtcaggctccttgtcccggagattctcaaatcgctcacccacaactcctcttcggcctcccccagaaaggagagagcagggctgcaagctagaggagcggagagtgtgacccgagcagcctcactccgcctgtccccaccccaaaggcaggaatttctgggatgggcagatggcccacccctcctcctcctccttccccaagccgcagtgggtggggcgaggaaaacctccgcgactttcccgcatcccagcccagagccccgagtgtcggttcactgtggagacagcggtggcggagtgggtctccagggctctgggctggcaaggcccccggaggggtggggcgcggaggaggctacggatccgcttccgcgcggcggggccgggtgcttgggacgcggctctgggctcccgggataaggggctcccgggacaaggggctcccggagagcccagtggttagcgatgctgctgtcgccgtcgctgctgctgctgctgctgctgggggcgccgcggggctgcgccgagggtgtggcggcggcgcttacccccgagcggctcctggagtggcagggtgagtctcccagggtcggggactggatcggtacgttggggaggggggtcggggtggtcgaaggagaggaagaaggggcgaagctaggggccaagctggcgggcaagggcggccgcgtttgtaggggttcgtgtgtcagcagtcctgagcatggggggagcgggtggtgtcctgcagcctcttgtctaggcccagcaccccacttgcgcggcccggcaccctcctggctcctgcgggggtcgggcggcgggggcgggggggcttggtctcgcaggtaactcctctcggctctggcgcccggagccagcccgggataggagtgtcggagaagtttcaaaacggaaactttctgagagctgcttatttgggacggataaatgatagcaaaaagatggctcagttcgtccccttgcaaagcaagcgctcagggtctgcgtcgccacctaggagtgacccccaagccaggcctccccagtccatcccttccttaaggaaaactttttttgtttgtttgttttttgagacagggtcttgctctgtcgcccaggctgtagtgtaatggcgggatctcggctcactgcagcctccgcctcccggggtcaagcgatcctcccacctcagcctcccgagtagctgggaccacaggtgtgcgcccgcacgcccagcaaaatttttgtatttttggtggagacggagtttcaccatgttgcccaggctggtctccaactcctgggcccaagtgatccgcccacctcgtcctcccaaagttctgggattacaggcctgacccaccgcaccccgcctgaaaacatcaggccaggtgagggagagaagccccagtggctccatgaactgcgtgatctgaagcctttatgccttagtctctctcagtggaaaaacggggttcaattcagcaaacacttattgagcacctactacacatgagactcagaaggttgtgtaaagagagggaggagagatttctggcctgcaggggcccgcatttgagaatgggccacctcaggcagagaagcctgcgcctaagtgcagaagtccatatatgcaagtaggagggggacaggagggagttaaatatgccaggaggagcctccagacagcctccatcctctctgcctttggagataagtttggagagaaggggtaacacaagatgtgatcaatatctgcgttcacattttttcctccacagtagaatatgtctacatttttgaggtagtcttttctagactgtgtttcctaagctccctggaggcttaatcaggggcaggtagaacaagaccattcttattctaaagtgaccaaagtcagagatgctcttaccttcttggtcaattcagaaaattgctcctgtggatgcacatctgatcctgtagtatgtatgattccttcccactaagtttaccatgcagtggttattcctttgcattttaaaatgtgggttttgcctgggcactaggtggtagaacagggcagcagcccacaggacagaagttggactgggccacacagagagtatgtgctggtgatcctccgagtgaagggctaatcccttctatatgtagcagaaccaaatactggcctgagacaaattctcatcagtgccttctttttagtagtcaagggcactctgaaattagagccatctgctagcccttgtacctactaggtgcaatttgcacatctgaaaaggttgacatagttggcatagagattcttcagatatgaaaatgctgctgctgattttccaaggagcacggaggttatgtaccattcctcgcacaggcacaggctctctccctgactccagtcacctgcatgagtagaatttcaagtgtaagctggacaggtttgaagtcaagtttttactgtcaatacaaaatggaaaaacaaaatcttaacattgaaaagaacctgagacattgtctactctagccctctattcttcagatgtggaagttgaggtatggctaccatgtagttagccatgctttggggtgcctcagtttaccgctgtgttcactgtaccacattgactcactttagccacgattgacatccacagagcaactgagagaaaaatgcacactcattttcatttccaatccactaataatggctatgtaataatgcacagcagattatacatacagcattttttatctgaattgtttgatatgtattatttgtagatctgatatgtattacaagcatgccagccttgggaggcagatgatggattgtactgtgatgattttccaatgatttatcaataattcttgatatggtttggctatgcccccacccaaatctcaacttgaattgtatctcccagaattcccacgtgttgtgggagggacccagggggaggtaattgaattatgggagccaatctttcccatgctattctcgtgatagtgaataagtctcacaacctctgatgggtttattaggggtttctgcttttgcttcttccttatctttctcttgccgctgccacgtaagaagtgcctttcgcctcccaccatgattctgaggactccccagccatgttgaactgtgagtccaactaaacctctttttcttcccagtcttgggtatgtctttttcagcagtgtgaaaatggagtaatacaattctgtattcaaaagtcagtagatacagtattatatagtagttaagttctcgggcttcagagctagacgatctgagttcaaatcctgactatgccatttaccatccgtgtgaccctggacaggtattttgccagtcagtagctcagtttcctcatctgtaaaatggagctagtaatagtacacatctaagtgttgtccttttgctgctctctcaccatggcaccctcttcctctggccaatccagacattttgacaggttgacagccccataacaattacttactacggtgcacagcactgtacttggcaggtctgaaactcatctcctcctacctctagctcaggcatccccaacctccaggccacctaccagtttgtggcctgttaggaactgggccacacaacagaaggtgagcaacagtgaacaaaagaggcttcatctgtatttacagctgctccccttccctcacattactgtctgagctccacctcctgtcagaccagtggtggcattagattctcaaaggagcataaaccctattgtgaactgtgcatgtgagagatctaggttgcgagctccttatgataatctaatgcctgatgatctgtcactgtctcccgtcaccccagatgggaccgtctagttgcaggaaaacagactcagggctcccactgattctacattatggtgagctgtataattacttcattatatattacaatgtaataataatagaagtaaagtgcacaataaatgtaatgcacttgagtcatcccaaaaccatcccccaccccaccaccccattggcctgtggaaaatttgtcttctgtgaaaccagtgcctggggcagaaaaggtgggggacctttgctctagctggttattccaaggagcctgattttagtttgttttccctgatcagaatctgagcccttcttctagcaagtgctaagacacactaacttcactcactcaagtactccagatacaaagtggacagcggggagaaagaagaaggggatggagcatcctggtgaaaactgggcatagtcattgctaaaggaaatgatcagggggcaagtaaaagggttttgaagctttgttgagggttgaaaaatgataaatgtgaaatggtcccccactaatatatcgtaggagagtttccttctgtagtgctcagcttcccagagcaggagtggaaagaacctaagtctgtgtcagtgcctggggacactcaggggaggctcttctaaatgaccagtgatcaaaggaggtgagggtgcagatgagtgtgtggtcagtgtgcttgccatcaggtcctatctggggagaagaaagtgaaacagggttgggtgtacggggtgtctctcgacatgctgcgccgacggaaagaggggtaggggctgatggcctcagttgttcattatctgtcaggcaatatgtgctttatctacctgttttagttgggttcatccaaaagcaattcctgagacatgttttccttagggtgcaagtagtttttttttttggaggtgattctagaaagcatggtaagggagtgaggacatgagaccagagagggaagaaagccaccacagaccactggggctcagtttcacaaaggaccctttgaggaactgtatagaactcagtggacccaccaacgggcaggaagctgaagtatttatccaccaactcccgcctcttattgactaaggtcactcctggggcattcaccccctggtgctcctggtctctcccaggcagagagccacagaaagtcagtgggagtgcacgaggactgtctgcaggtgagtgagctccaggttagagggtgtgagaaggaaaccaacagaatctgctacccacctccagattggggaggtaaaaacatgagtaggatatgacactggccccaagaggctgagagtccagggacagatacagaaacataaacaattacaaaacagtgagagaggtcttatgataaccagggatgagcaaagtgctgaaggcatgcagaggaggcactggcctggggagctggaggctcataaaaagacatttgttttcctaaaggataagtaggcagttaccatataggaaaaaggagactgagcattcctgggaacatgtatttcatgtgcaaaggcccaggatcacgtgtcaggcaacagtaaaagttcagtgagctgaaagttcccttctgagctcttttggattcaaggaaagaggcccactgaaggtcactcaggcaaacgtggagttggttgtaatggtcccaggatctcaagggggacccaggacaggttcttcagggcagccaggcctcctgggaaacaggcactggccactgacatgaagcattactttatctgtttctctctgtctctggggctctatggtggttcctgcttggttgttctttctgttgactgtttctttggctttgactagcaggactttcctctgtagctcccttagcttcctgggaagagtcccttaatttcctaggagaggggtctggttacattcttcacagcatgctagccagttcctgtgctctgccctcaagtcgaaggccttcccctggctaattggccatggtagaggcaggaggtggacacagggatggatgctgcttcatccagggctgtggatggtatagaccaccagagtagggtcccaggcaaaacaagaagcagtgacatgtctatagttggaagcatgagagagatgaggaagagtttggttggaggcaccctgcttctggaaaaagtctggctgagtgaattgggtactgctgagaagggccctgtgggtttgcacaaaggggaaccagattgcatgtttaagtttagaagtgccatgttcagtctgggacttgaagagggtctcctatcaccttgaagagggtaattctggaaggcagcaaagaaaccgtctggatagttaaagctgagctaagtcagtcccaataggaagattgaggagcagaaagtttgggttcaagaaacagggtttaaaaagaggaaaatatatatttaaaaacaacaacaaaagaaaacagttagtgaaagttagatgagggaagattgcagaataggagaggtagtggttatagagtgcaaaatccaagttttggagatggacctattcttggtagtgaccagatccaagctgtgtttgtgggagtggtcaccaaagtgaagaagaggcaaaagaaggtcctcacagcagaggaggtcagggagcccaatgtccagagcaaagctaaagtcgagtagagtttgggactcttttgtcagcaaaccacaataagaaatacattttacatcacaacccacagcatataggtctacatatgtataactgaaacaatgtttcattttttaaaaaatacccttacctaatatgacatgctgctacatttccccctgttccattctgtttcgttttgtctcgctggtcataacacattcagttgatttcaagaccataaatgggccacaacctgcagtggggaaagcatcgagtcagagtgttgggtcatctgtatggaagctaaagtggctttggggtgtggagaatagcggggagtctgctggtatcaaagccatggtgaatggggggaagaatggttcagggcagagggccccagtggcgaggaaggggggtagctgccaccttctgaaagagggcgatgagagccactacctggaggcggcagtggggagaagctgtagccctgagatttcctgcatagcttctgtttctaatacaaaggtaaaaatgcccctctactgcttctagtattttctaacagctggggagtcgttactctttgttgttttatttacatcgacacattgtctcctcaccaaaacaggtaggcaacattaatacatacccttcttttacagatgaagaagggttaagtaacttgtgcccacaggagcttgcagcatggggattcgaaccaagcactctgcactaatgcaaaggatccctgaatagccttgtgaccccatggtgtggttcattctgtatcctgctgcatgacagaagcatgcgatttggtttcacagcaggaagaataggaggccagcctcttgttctctgcaactcctccttttccaaacccctccttccacatgtgggagtgatattttcctaaagcagaaatgtgcaaagctactgatttatgtattgttctaggcaattctgatgtccctaggcaatgagccattctactaatctggaaacggaatttcagtaaaagcgtgatcggatagtggtttagctgcccttcctggccctgaatcatgccagccttcttgactccgtttctcccatttctgtttgtcatccctcgcatttcttccccttcatacttttctcatcctaccttctctgcctggctcctttcctggcaagcctttgtgagtcagcatagatgtccagtttttctggtcctatttactctttcttgttaagcctctaactcttttcctattgttggttgtcacagtaactgatgccacacaatgcaggttccaagcccatcacaggaaagatggggccacacagatagcttagttgtccctgcagctccccttctttgacctaacaatctgcttatttatatcaagttttctgaagaaacggtccccttgtgttgcctcttctgaactcaatcctaatgctgcaaatcctcatgtaatctatcaaagtaattgatttaagacatttataaacccttccctccatttttttttagaaattatccttgagagccttttggagatgttccaacacatagctaggagcataaattatattttgaattgatcaaagcaaaaagaaatattattgttcataaaataaacaaaagaacaccatataaacactatattaagtcatttagggaaaaacattttataaagccactcaagaaaattagaaaattatgattagaatatctgtaacttgggttctgtgacacagagctaaacaagacagaaaagtcatagccacttggctttttaatttatgatactttttagacaactacagttccaaagaaatatggaaataaaatagtgttaccacttctagcttttggtattctgctcttgagaacttttcaatcatgaaaatataaacaggaaactcaaagtaattatttaactatacacattttttcattttgctgctctttggcaccattcatattcaaagttaagattggcttttatttttattaatatttataaagtgatcatcatgactgagataatccctatcaaggccttgtgaggccagcactattatttttttctttttattataaaatttaaactttttgtaaagaaggggtcttgctatgttgctcaggctggtctcaaactcctggtctcaagctgtcctccagccccggcctcccaaagtgctgggattacaggtgtgaactacacacccagccccagcattactattaaacccattgtgcagatgggaaaaccaaggcagatactcttctggttttaagcagttctgccctgaaagaagtgctcggtagtttgccaaggtcttttttacataatgttaatcttgttcaaatgcaaacaaggagagcttcatggggatgtaaccagtgcagttgcacagggccctatactcagaagggccttccttccacttagggtttaaagctccatggtttggggtcttgggattcataatcatttctatctttgaatttgtgtgctgcgcatgatgtccaatggaacaatggaacttgagccagaggtttggagcctctgttcaattctgcctggtgtcccctgtctacctcccgggacgggttctcagctgcctcctcccaactcctgccctacaattgatgctgcctgctgcacacagtggcaaccaggttgcattgaagttgggggactggaggcctgggccctgggagtggatgccttgtagcatttcggggcagtgcaaggcagtatttgtcaccactgtactgatatcacttctgtgggttctgcgagggctgagtgggaacctctcacatatcctcaatccaggtactgtattctaagcacgttatagctcagaggttgcaatctcctgtgggcctgagggaaagggacattgacttgacttccccatgtccagccaaaaccacgtattttcattgcaccctggaccctgcaaatgatgtagacagcctgaataagaatgatagggatggttatgatctgaattgttcccccccccccaccaaattcgtataaaaatgagactttacttggagatagggtcttcacagaggtaaacaagttaaaatgaggcagttagggtagccctagtctattatgactggtatactcataagaaggggaaacttggacacagaaatatgcatagagagatgatgtgaagagacacagggagaagatggtcctctaggggccaaggagagaatccaggaatccatccttccctcatagcccttggaaggaaccatccctgccacactgtaatctcacgcttccagcctccagaattatgagaaaagaaatttctgtcattgaagccactcagtttgtggtattttgttatggcaaccctagtagcaaaccgatacagggactaacactctatctaccactaaaagttgtttgtttgtttgtttttttgtttgttttttaacatttctaccttgcactttagtaaatgatttttcttttaatgggcatactcccaaggcggctaagatggatagctcattgtaagcacttttgttttcagtaatgccatatcatttccggagttgttttggttgatgatggagttgttttctggttttgttggtttttgtgacccagtctttgaatcatttccccctgggctttaatatgcaggcatttgtgagggcatcttaacagtgttctgtctttttgtccttgccctaacttgcactttgtaatgaggcacccttttgactgagatggtatattttcaacagagtcaataagataatcacagagctgttgtgaataatgatttttataccagcaatgtttgttaagtactttccagttaaataaaggcaaaacaatgggagaatagactaaaagctaaaaggaagaaaaatgttttcaactcagtttaaaaattcattggtaagatacagaggtctagcaaagaatcacggaagagagattttctgccagggtcagcaactgctaaatgaggacagagcaggaggacagaggagggaacgggaatggccagggagtggcaaggacagtctgaaagggttaacccctcctggcacaggggttggtaacagacaatttgaagcctcacagaactgcagtccggtggcactgattatgctgggtttcatttttccctcatgtgagaaagactattgtgtgcctcatgaaacttggagaggcaattaggtgagattagagagaaaatggaagagaacatgtaaaaagatttagcaagagcggtccacggccctgtggagatggtgattatctaggttcagaagctgtaggagaataaagaaggctaagagttaaggacaatgctaggacagggaaagagaagaaagttctgagacaggacaaagaggttttttaaaaaatgtacttgggtaactttttagttgattaatagaaggcaactgacaggaactcaaaagtttcagaataagagacacatgaaaactcagatgatttcagataaaatgcacatttccatgcagagagagaggtaggaagggctggcccacttttcactttcttccgtggatctcttctttgaagaaccatgcacatgctgcttgctgcaagcatgagaaattcctcacttattggtttgaaaggtcatattaagaatacagattttctgcatcactcggccatgaataggacttgattcagcagcttacagtattccttcctgctacagagtaatcttaggaacgtaatcagctctgaatccattgttcactagatggaacagataaagacaaacccaaatttgtgaagctggaaaaggtcagtacatctcaagagagaagctgctcacctccagattggttacagaggagagatgccctccccatttccttctggactgcatccctgctgaaacctaataatgtcagaacagcaaggaaatggacagagtcaagacaggctgccgggcaggaagggcttgagcccagcactagctctgtgggtagatggagtagaagcaatttcaaacctatggactggggtaggagattgaaattgggttgcagcctgcatgctgtggctttctaatagcttgtcttaagcattgcacttgatgtgaaccatgcactggaacttttccttccagttcccttaatggagcagcacagagactgactttatgtgtatagttggattaggtgaacaccttcatggtgtaatttattgaataccagaaagtcctttgtttgcctaaaatgccaccattaaaattgttgttttattgtttctttaaagtgttttttgttaaaaatgcggaaacttcacaaaggcttaacagtacaaatcttatcttactcactttaacacttcaaaccttcactcagctagttctaagagaagagctgtctaaagctaaagggaacactaaaggcaagtagaggtgatcagaaggggtgcagatggtcaagtgcagaggcctcaggagaaacttcctctaggtacctccagtctgctgttcacacagacagatcaaactgtaataatggccccaggctttagactccaacctcatggcacccccttttgcttatatctcctatgtcaaaatatattttggcattagggtataatttctttctgtgcatttcagggattcccagggagaatgtgacttccttgcaggcaaacactatgacatatatatccttctgtctgcagggttcctaaaccatgccacatcaagcagttgatagatctttgttgtctgaaatttcaagtcacctacttcaaaatgtttggcaacaatctatagcagtttattttcttctaagttataaatgaatgcatgtaaataaagctacacctggactgaatatagtagatagatataaaacttctaagacaaaaatggatttggaaaaaaaaaagtgaaagagtggttcagttaaataatctttacagttccatccagctctgaagttcacggttcagggtttatgggtgaagtgagtctcctctgccacacccgtcttccttccagcactgccctgctttgtcctccctagaaagtgggcaagtacatgtgtgtgcacactccccgctcagagtctggtgacactgaggggtcttgtccacctcacatgtgacatcagttgaagagccagttcagggtcttaaatttgggtttattttctttctcttatttgttatcacttggttttttaaatcttttaaaataattgtttattttattttgttttaagttctgggatgcacgtgcaggatgtgcaggtttgttgcatagggaaatgtgtgccatggtggtttcctgcacctgtcatcccatcatctaggtattaagcccacatgcattagctctttatcctgatgctttcccttcccctgcccctgccacaggcctcagtgtgtgttgtttccctccctgtgtccatgtgctctcattgttcatctcccacttgtaagtgttatcacttgtttttaagaacttattttatttatttgttgttttttgtttgtttgttttgagacacaatctcgctctgtcccccaggctggagtgcagtggcatgatcttggctcactgcagcctccacctcctgggttcaagtgattcttgtgcctcagcttcccgagtagctgggaatacaggcacgcaccaccacgcccagctaatttttgtatccttagtagagacctcaagtgattcgcctgccttagcctcccaaagtgctgggattacaggtgtgagccaccacgccccaccattaagggcttattttaaatgcaattataatgttttctttggaactgatggaactcccttcttttcattagctaggcaaattcccatgattccagaacaaatatatacagtttcaaagaacagatatttaggcaaataatttctctctatctctagcatcttacccagtgtctatgaagtagctggcatccaatgaaagctagttgaatgaatgaatgttccatatgcagtcataaaggtaataacctaaacttcggtttaaaagttgatcaatgaaacattctcctcccgctccttagaagagtacacgttatcttatggggccaaagagtggatctgaaatggtctcctcctaaaggaactcagaagtagaaagtagaaccactgtcttccatggattttatttaaaaaaaaaaggatagaaattagcttataagtttcttctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactctgtctcaaaaaaaaaaaaaaaaaaaatgtttcttctaataaatgaatcctttttctcctcctaaacttataattatgaagggaagtataataacattttcctgcaaagagatttagtaattctggcagtacttcattaatcacttaatcagtgttcaagcagaactgatgtccttgacatgtataatcaatcttgattcctcccacatttgattttcatcttttaaaaaatccaacaactatgcacactaaggattggtggcttattttcacattatagttttgttagagacattatgtgcatataataacaatcagaatattgatacctatattaagtctcctcacagtctatttgaaagtaattcttttcagtgaatttatggagattaacagtgctaggatcatattctattataacttaatggaaaaatgggctcaagtcattttttaacttagtatatttggaggcagcatgttgattattattggtgaaccagagctacttgcctatggcacattctgaagaacttttctaaagctatttcctaaaggcagctggtgtggaaatataagtagcaccccaaaattaagcagcaatggattaggtgtgtctaatatgttctgctttggaaaggtatttttatgattgctggtgtgactacagaagttccaatttctgccactctttttctcttaacatttattaatttggaagtttaaaagcattattggccaggcatggtggctcacacctgtagtcccagcactttgggaggccaaggtgggaggattgcttgagcccaggagtttgagaccatcctgggcaatatattgagatcctgtctctaccaaaaacaaacaaacaaacaattagccaggcatggtggtacacacctgtaatcccagctactcaggaggctgagatgggaggatcagttgagcctgggaggccgaggcctcagtgagccatgacagtgccactgcactccagcctgggtgacagagcaagaccttgtttcaaactcaccgccccacagaatatttattcaccccaaatgttaggtttgtaattttcatgtctatttattcacagaccagccattcccgcatctacacactgcttgtcaacaccatgtatttttctctttcgtattaaaaaacctacagtgtagactttacaggtgggtaatgcagaaaatcaacagatgaaggctcttaattcatcattgcacacatatttgaacaaaggaggcaaatattttgttatctggttgtttggagagtatttttcctccataaaagatgatagcgtggtgtctcaggattgtttaaaactaaaatgtctgcacccactgtgtgctgcagaaactgcagtaaaaataagcttttgtgctaacagtgtaagaagagaagcctttgagggatgatgagattagcactctgtaggttcaaccaggtctgcagctggatctatagaccaagaatcaggaagtcagaggaataaagtaataatgatagctcccatttcctaaggcttttcatggtagtatgtggtgtgcttttcatgggttactcaatggaatatccttaacatccctaagaggtcagtaccatacatattcccagttcaaggaggaaagatgaggctcactgagatggagcaatctgcccaaagttacacagcaggtctgtgacagctccacgtgactccagagctctcaaccactagccaggtcgtctacacacctatctgaggtgtataaactgaggcacagtcagtacgttgcagagcttataatacatttgaacatatatattaggtagaagctgaactacaaaaccattatagtaaaataattatcctttaatgaaaaattaatgaactctaggttagctagaaagtgattagtaggttacaacagaaattaaggtaaacattctacccaggcatgaaaaagtgaaaaggagagttggacagaaggttaattatcggactccatatcacattgacgagaggtggatttgattttgaatcactattactaataaccatgcagacaaggccctcattaggaaaacaaatttcctgatctaaatgaaatctccctaaaaccattcattttccccaccccaccccctctcttttgctcttatgtatggtgatcaaagcaattctctgacaactaattcaactcctcaaatctatggctataggtaaggtcatcaactattagatgaggtataccatttattaatacattgacaatctttttgaaacagtatcttaagtgattttggttactgtaaatcagttctcctcaggctgattaactttggagaaaccaaaagaacgtttaccagaatgaagcattgttccctcgtggatccatgaggaggcccgtcctgcactgtcccaaacctctccaaagcctctgcctgtacctgttctgccctccattacatgacccgccctaaaccccagacattggagggaaccctatcttgtcccttcagagttttgaagaatagacaggaagtaaaatagaagaggggaacctagctactgggagaacaaaagagcgcctgggcctcaccagacatgaactgaggtgacttaagcagccaaaggctgaagcagcagcagccggtgtgtttcatcaacagcaagcactgactgaatttccaccatgtgcccagcacactccatacttagaccaaagaaatgagactttgtttccatcttcaaaaagcctgtgagaaaacaagttcataactgttgagtactaggtgccttccaggcccgcaacttgggttaagtcaggtagcaggctggcagctaacatgtattccccagctgggtcccacagcttttccacgggaaactcacccaaatcccttcttccagctccggggaggagagcttaggggcatatcacaaaacacctgctttctccgcctgtccatgtggcctctggtttctgccaccgtaatggtggtccgtcacctctcgtgtttcaaggtgtggtgccatagctagtggcctgggcatctacctgcttctgcctgccccacccagcaagccatctcctactaagagtctatccccatatagcaagaggtccccacctccacccttgtactcctgagaaacattgtattctgaccagtattgaatcccgtatcagatcacaaagcagcatttcactgatagcctttcggttttctataggaacttgatggtagagagtttcattcagtggctcttgattcagcagctgtgttcctaacattcaggcacttgtctgagaaagacagtgttgtcatatccattggcacccagtgtccctccccgggagccctgagtattattaccaatccctctctctaaccaattgtgtgagcacaccttctctgtcagtaacagacctgagtggattggcaggtaacccttgttcccatatggccaattaggtcttagatcagagctctcccattagctccagtaagaccttttatgcttcccaagaaactcctctgttttatgcaaatacagcccttcaggtggaccctgcccaacaactccagatctgtgggaaatggctggcaactgtcgcatatcgcacttagatatgcacactgagatcctcatgacgctagttaattatatatgaaaatttcatgccacatctttgatttttgtttcagataaaggaatatttgttatccaaagtgagagtctcaagaaatgcattcaagcaggtaaatcggttctgaccctggagaactgcaagcaagcaaacaagcacatgctgtggaaatgggtttcaaaccatggcctctttaacataggaggcagtggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaaggtaaaaataatttaaagaagcactcagggaatggtgtttttttaaggtttgcctataagtaaagatttgtaaagcattacgtgaaagaagtacacgaagcctggaccctcaagggacttctgctaaatacattttagttgcttccttgcttatggtaaaagggttatgagagtctcagaatggacatactacattctgctaaagaagcagaacttctcagaatttaaaggtattgggaggaaaaacatttaactgactctgggaatcaatggaagggagcagaaagaataagcagacaggagggagagagaaaaggacggtggaaggaaaagatctttgaagacttttgtcatgacaaatataataatctctcctcccctgccgccatttctcttattgtaaaaactcatccccacctatggaggtatgtgtccaggacacctccaatgcctcctgatgctggctggcattcatgtgattaatcatgttacaagtcacttgaagagaaatgacagactattgtcgggggttatttggtgtgtgccaagcatggttggtggggaagcatggtttagaggggaatttcattttctatggttatttttgtcatttctaaacagaaaaaaaaaagaaagttacatagttaaattcaaatctcaaacctgtccctcagcgttttgtttggtagctcactctatccatccatccatctatctatccatccatccatccatccattcatcccgcatttttgtatagcactgctaacaaatccaccccacattcatcaggcactggactaggcacctggtttacaaaggtccacaggacaggtggagcccctaccctcgtgctgctctgtagaattatgctttcacaagagcatatgctcctaagaattctgtacggtcctgggaagcagagcaaggaactcctaaagaagaaatgattaaaaagagacagagccaagggccaggcattttcaggactcactaaaataaagcaagtgctgcaaaccagcactctgaataatctacagttctgaagaggaacttgatattttgctttatgttaactttttagccacatacccacactcatggtgcatgcaggggaagattctggggaacatatgctttggagtagaaggaaggggactgaaagaaaagggcatgtcctgaaatacctacggttcctaaatagccctaactgctaaggctggtgactggtgacatgtcatgagctcaggtcagcccctgccaattgtgggaaagaggtggggctctccactgctggtccttttgccccaggacataccattggcagccccagttgagtcatgaaaagtttttgttgattcctgattaaggccaagaatggccgagtattgcaataccctgagaaggcagccagcaggccacgtctgcatggtcgacttgctctagaccactgagaagccacccagccagctgtctcgcttcaccctctccctatgtcagctgtttgcccctttgcaaacagggcatcagtggttctttaaaaatgtaaatctgatcctgtcactttcccattcaaaacccgcaagagacttgcccccaccctcagggtagaggccaaagcccgcagtatggcggggagacagctctatgtgcactgacactctagtacgtccctggctccctacccagagggcctccttcctcttcttcattcaccccctcacttgttcttgtctcaggttctttttacttgctgttccttctgctggatcacctcttttctaaagacctgcactctcaggtcacccagttcctattcagagaggtctttcactgcccatcctgtccaaagtagtgccctgtgcccctccaccccatctctccctctctctcactttctctctctctctctctctccctctgtctcacacatacacacacacacacacacacacacacacgcacacacacaccccactctgtcttctcatcctatttatttttcatcatggcaccgctacctgcaatgatactgtatgtttacttgtatatttgctttctctttctctctccttgatagaagttccacataaaggaacttttgctggtttgttcactgttgtatccccagtactgagtacattaaatgttcaataaatatttattgaatgaataaattaataaatgcctatgaatctattgagctttagatgctaatggctgatgtgtttggcgactggaaggtattatgaagttaaatctccattaaagtttctttctcatccatccacaaatatgaatgttactgtgacagctcaccatagtaagtaaacaagtagataaatgcataagcaaaccatgtatcagcacttcctctgagcccagcactcagtctcacacctctactgacaggagacagtgaggacctgagggctcactctgctgtagtgagtatctgccccaagagggtttcagtccataaaaaatgctttcgatatatagcagtttccaaagataaagctgacatcatacttatctgactttgtacatttctttctcctagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccagtaagaataaattttgtcttctctatatgtcatgaatgaatcaaagatgattagaaagttatctgtatctaaacaaaagcactgggattgatatattgaagtctgaataagaaccctgatgctattaacacagattttgatttggggtttgtttttgccttgaaaagacaattctaatatatattctttttgccgtacattcaagagatgttaattagccattcttcattaagctcagtgcataatgatgttttaaccagaatcaaattataaatactctgcgatctcattgatcccagcttcttggctggatacttcaaaacaaacctgattgcatataaagcccagttagcctttcaatccactatctcttatgagctgctttaatttctccacatccaggctgctgcttgtctcgcccattgtcaagcccaggcaccagctggccccttgatgatctttctaaaatcgcaattgccctcattatttcttgacagtggattctcgtcttgactccctttcctactatttaccttctggctataacctcattttttttcttttcttaacttgattttcaaagttcaatggcagtggcaatgttctaacttctttttttcagttagtgccttattatttcattttatttttatttagctaaaaagtttccaattgttaccaagtattagagaatgtttatatatgcctcctactttctatattcaatttcctttcccttggtttctgtgagtcagagtacagcttttacagtcttcatctcccatgcctgcctcccctccacatatataaaatgcaacaaataaatttgaagcaaaagcaagttgaagagattaaccccaaagaatctgacttataaagtatctgtagaattgttttctaatccaagagctagtatggcttagcaaataagaaagagtataagctttgaaataatcacacaggccaagattggagtcctgcttcctcccaacaatgaaattttgggaagctctctccatctatctgagtctcagtttcctcagacataaaatgtaggtaatagcagtacctattaggattattgtgcaattcaattagatgaggcattcaaggcacttttcataatatctggcacacagtaagtactcacaagggttaaccattgcagccagaagcagcagcaacaatagcagcagcagcatcaaacccaatttatattttcagcatacacttctgaatccatgatttctcctctctgctgtaagtcaacaagcactaagctatgcatagtggtgaatgccaagagttttaggacttaggatcctccctttaaggaacttggcatctagagagaagacaggtttgctgtatgccagaaaatgcaggctgtatttgacacaatgccctagaatcacctgggagatagtttaaatgcatatcctggcccatcttccagagatgcagtgggtgcagtatgtaaaactcaaccatctgcatttttgaaaagtgccccaggtgaccccggtgcagataattcatcatcaagcaataatatggagataattctatgcaatatacatctatatacagggataatatcaacacatttaacagccaatatggtatgggctattggtcaatcgcaatggagaccttagtgtgggggttgggaattccagaggctctctgctgatattaaccccttagctgctacaatgtgggggtggggtgcagggaagcctgggtagtgggggtaatagagaagctcagaacagtggctattcaccaaccagaatgaaagcattttattattttataactgtcagatcaccagccttctctatttgaatctaaatgtatgcatgtaggtgtgtatgcatgtgatctctacaccccttgactcctgaaacagatgtcatattatttttattattgtcatattatttgcatcatctcttctttttccttttccatccccaatagaggtcattattaaaaccaaataaatgaaccaatactaataaagttaacacgtacttcacatggctctaatactagggacttcaaaaaaaaaaactacaatattcttcttaaggttctgaaaccttaagaagtttccactgggaaacttccaatgacagtttcccagtggaagcctgggttcagtggtgctccaggcttttcattccccagaccatctatttgttcagccttgtacagctcagaagcttcctctgcttgacagcctgccagattccagccctcctgccctttaccacaaccagcagagagcatgtttatttgttcagtgccagttttcttcctttcttgttacttttggctcccggtagccaatataactcaaaatgacgtgtcggagattgaaacctgagcaagctgatagctctttccatggggtcaacaagtggataggacagagaagagtgagtggaataaagtaaaggtctgtactgctgtatctcatccttcttatgtgggaaatttttttaaatatctcaatgtaaaatgatgctacatttaaaaaaaaagttgattgtaaatgagcaaaatttaaatgtagtattcataaacacatatacaaatatactagcggtgaaggatgtaataaaacatcttcagcaaaaaggatgacacacaggaatctctctgggtttgtttagaggcaattatgggccattctggactctcttggttgtgtgccttacagagctgcagaatcacacttagttaatttgagatatttttacgataccaacctgtgaaatgatatgattgcccttgaaccttatttttatataattctgatcagttgctcgagtgatataataaagcagatttaggctgggcacagtggctcacacctgtaatcccagcactttgggaggctgaagcgggcagatcacttgaggtcaggagtttgagatcagcatggccaacatggtgaaatcccatctctactaaaaatacaaaattagctgggtgtggtggtaggcacctgtaatcccagctacttaggaggctaaggcagaagaatcgcttgaacccaggagatggaggttgcagtgagccaagatcgcgccactgcactacagcctggtgacagagcaagactctgtcgccgcccgcctgcccccgctcccgccctccacaaaaaagacaaacaagcagattgatacaacaaaggtatggctgctctctcctgagccctcaacatggctcagcaatgctatatgtttctgtcatgcagttctcacaccccacaatgaccctgccaacctctctattctcctctaacttctaaccctaccttccaatctcctttctgattctcattatttgacctcagttcctacctcataatggcaaaaagatccatcagacagacagtttggcaacttcctgctctctcacctttaagcctacctgcatctgtgcccatctttatttcctcccttctatgcgcgaggatgatgttcctcctcctacatgggccaagtctccccacctgggctctggagcgccccatccaaccttctccaacctgtatctcagttgttctcaatgtgtggtccccgttccagcagcgttggaattccctgggagcttgctagaaacgcaaagtagcagtcacaccctagaccatcatatcagaaattctagaagtgcagcccagcaatctgtgttttaacaaacttctaggtgattccagtgcacacccctgggtgcttctttgctgggcccttttccttagcagttagacctgtgcgagtcttgaaataacatcttaaaaatactgcaattctttcatccctatttctgcctcctgaaaacacctctctctctcatcctctaaatagagagaattcgcaaaagaattgtctataccttcttcagggcactgtctcctcttgacttctacaacaatgcatgcctgaccttgacctccatttccacagaccattcatccatttattcatttaacaaatatgtattgaacacctactatgtgccagggacttctctggctcctggggttataaccgtgaatgtgaaatgtgaaagtcatagtgcctgccctgatgaaattcacattcaagtataatacccaaattaatacataattacagtttgtcataagttctaccttaagaaaatacagtattacaagtgagaaaccgaagttaaaattgggagtcatggaaggttttcctgaggaagttgtatttgaactgtagcccaagagatgagtagaagttgtcaaaatggaaagtggggaaatgagatattcacacggagatgcatgatacagacatgtgcaaaggaaggggagagggagtggtcagcatgggatgcaggcaataaagagggtatatggtttaaatagaactaaaaaataataataaaaccaagtaaaagacagcatgcttttgagtcaccaggcacatgctctaaccattccaaacaatgtcagtgataaaatacgcccacctgtccaggctgactgctcctccacccccagccctcagcatgtcactggccagatatctgaaggttttgaggggggaaagaggttattgccatctaagaaagacaatgtggcaagagtacagtgaatgaagaagagagaaacaagacactctgaaagggcagacagagtccatgagtgtcataaaggtaaggacttacctaattctaagtgcaaaagaaagctatcaaaagagttttaagcaggggagtgatgattttaaaaatatatatttaaggattactctggctctattatactgaatggcttggaagggagcaataggcaaatcctggagaccaggtagaaggctagagcaatagtctgggccaggagtagtggtggcttcagttaggtggcagcaaggggattggaaaaatgtggatttattgaagatctaacttgtagataaactgaacaggacctggttgtcaggagcttagctgggctggagacagcagagctgtcaggtgttggagtagctgattaaagcaacaagccaaaaatgaaggtgttaagctgttgatcactcactacaatggtataacaaagagactaaaagaagaattcgccacctcccccgttccatttttccccagggaacagcacagccatcgagggtcagtggatcagcacagatgtggagttcagctcagctcactattgagagaacactaaacaacaacaaaggcttttcagttgtatagattctgggttggggtaaggtgaggggaagagctaggagttgaaaagtactgagcactgagtcagggtggggaaaaagtgtcttcaagattcccctccttcccactccatcccagcctcagcagaggcacctgaagaggaccttggcccaaggcctcacatagaaagagacctaggaatggaaggcacctgcaccagaaatgcaaataacacagagcacgatgggcttgaggggcctgaaccgttaactatgactctctttagaaactgcagtgtgccagctcagcaccaagtctggggtaggggcagctttcccccatgaggcctaccaggtaaagcctttgtaactgcctgtggtcagacctcaagaatcacatataggtttttaaccaggagtaggacttctcactcctaagaacttggaggctaggagaaaaagtgagacattaattcagactccatgtttctgacatgcatagctaagtttatggagatatacatttggaaaagaaaattaaatactattcaggtttgcacatgttacatgtgagtcagttatgtagagatgtggactaggtaggtagatgtaatggtctctatgtatttggaagttataggaaatggacccatgagaacaggttagatagccatgtgtagaaagaatgtatagaatagaaaggaagggggctcagggccaagtcttaaggcctccaacatttaatttgagtagagaagaataaatcagcaagggagactgaaagggggcagccagggaggaataagggtagccaggcatgggaagtcaagaaaagagagtaaatcagcacggagagggaactcagcctgccaagtgctgatgaaggggcttgtttgataaagtctcaaactaacagttgctgaatttggcaacacaggggtcattgatggccttaaacaaggtatacattaatggctagattcagtggatgagactaagtgggaaattagaagaggatgaaacacttcccaagtcattctacgtatgcacttcacttcattaaaaaggaggtgtagtttaggaaggaaaaatcacctatttataacaccatgaaaaagattctggtaatctctcatcacataataggagactcaaagttatatatgacacaattgcttccctggagcccataatttagcaatagaagagatgatataaacacaatcaaagatgtaaagaatataacaataggattttagcccttagattagaatttttcaagaataataaacatacctgagacaccagcctttgattttcagagttctcaagctggggtgacccttcagagttgccccttgttgggatacaggggctaagtataccactacattgaccagtcatggtgtcagctgcccttgggaagggagagtgaaagggcaaagagactcttctgccaaagcagtccttagagagcagcacatcacagtgtctatgacaacattttcattccatttgttacttaaaacttacaaatgagattcctggagggacatgcagcctatcctagagaagcagagaaaggacttgtgtctgccagtacagaagtacaaattcttatacaggctgagtatcgcttatccaaaattcttgggcccaaaagtgttttagatttctgattttaggatatttgcatatacataataaggtttcttgggcacaggacccaagtgtaaacacagacttcatttatgtttcatatatacattatacccatagcctgaaggtaattttatacaatatttaaaataattttgtgcatgaaacaaagtattgaccaaaacccatcacgaggtcaggtgtcgaattttctacttgtggcgtcatgtcagcactaaaaaaattttcaccatgttgcccaggctggtcttgaactcctgggctcaagcaatccacccgcctcagcttcccaaagggctgggattacaggcatgagacaccatacccggcatctttctttctctttttgtagtgatagggtcttgctttgttgaccaggctggtctcgaactcctgacttcaagtgatcctcccgcttcagcctcccaaagtgctagaattacaggcatgagccactgtgactgtcctaaatgattcttatgcatgccaaaactatgaacacacccccgctcccccatcatggtctcagctgtcatggtggatgagtatggctgaactagtgtctcgtaacacgtagtagtatattgtccttctcagggaaggcctaggattttaactgaaaacaatctttaaggattccatctcaatggggaaatttcagccacctgggcaaaatggttactgaaaatttcccttctctttttcctttctttcttttccttcccttcagtgttacttggtgatagccttgtcttctgccttcctttaatcttggatccttctataaacacatgtatcagtcaggaaactctatagacaaccttagatttatatgtgatttaaaacctctggaatgtgtgttgcaaccagacatgaaaataaactttccacatttcccaaggggaccatctaactgttatgagggaggaaaaaaaaccaaacaaaaaagattttattgtcaaataagtttgaagtacactaaattaacagtaagcatgtttctttactacagaacttctcagagccttgaatatgctaatgttcattgtgaatttcccagagaacgctatgtatgcattgtgtccagattttcttggggagcctcttaaagttgtcttactttgggaatcacactttgggaaaggccatcctagacttcagctggttgcctgtcagtcattttcagtcatgctgcagtatggctcacattctctgtattctgacattctctgtctgagtttggtttccggtcattattgtggctacttagttcaccttggagtttgattttaaatgttagcaaaagcacccaaactcagtcttaattttctgttatttcaaaaaaaacttcagacttcagctccacatttcatactttattacatttccttttgagcacactatgcaatcttcggccagtgtcttacaagtggatcttgcttctattcctcttggctgaaagaactttcttaaactatatgtcagtgttcctgtgcttgatgtttatttgaaaacttgtgtttactattgactcatattcctactgtatccttttattttagcattttgtatttagggagaaatgcctttgaaataacatttgtatctactaaaatgaacatttaaagttacaagttttcaatataaagttctaaatgacaaaagaacttagatcttattttcacaaatacttcgcttctacttccttctcttaaaactggttcctattattactctggaaaggatcatagcttcttcattggtgatttcttatatttctttaggtaaatcatgaaagagtttaaccatatcttagcaatggaataacaatgcagattttatcataaagacctaatcaagaatagataaggccctgaagttttagagattgcaagatggaataattccattcagacttaccttagaaatatgttgctgtatagataaaataagacctggttgtttttaatggccattgtttccagcctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataaggggtaagtaggtggatgacgcacattgatattgatacaataaaagatggttgttaactgttttcacatatacaaaaatatattctgacaaaaagttcttaaaaaatatttttctttccataatatggcccaaaactctcacccaaaatttttccatgaaccttgagtgattccatttggcatccagtgatgtctttcttattttctcctccttggagaagagaatttgaggccacagcaagggacccaggagagttgcagttctaacaagtggatcaggaagatttctaaatttaagggctatttgcttgctcttctggagatcttagccattccatttccattaataaatcattaagcattttattaattaaacaaaatcttacatatcattcaccatgtgcaggtacatcataggccttctggtgggtcccaaaaacaaaaccttaaaatttagtgggaaaagcaaaagcacatatatgttaactaacagtatagacaataatatgttaaaagaattgtgccgataaactaagacttatgtttcgcttattgcctaaactctcctcttacttcttctttatagattaaatgtatttgtatgtgtgtacattcacctctttaaaaacttgtggaaacattagaaaatatcacaaaattagtcactttcattaacagtttttgatgccaatgtttttcaaattttattgcatatgtagtccatgtttattttagaataatttgtaaaattcaggtatatagaaagaaaaaccaataaaaaggttcccatagttctgtaatccagagacaactgtgtttctctgcaaaaacatataaatgcatgtgtacatacacagtatatataaaaaatggtattatataaaaacgtggcagcagccaggtgcagtggctcacgccagtaatcccagcactttgggaggccaaggcaggtggatcagttgaggccaagagttcaagaccagcctggccaacatggcgaaatcctctctctactaaaaatacaaaaatttgccggacgtggtggcatgcacccgtagtcccagctactaaggagactgaggcaggagaatcacttgaacctgggaggtggaggatgcggtgagccaagatcatgccattgcactccagcctgggtggcagaacgagccttcatatcaaaatacataaatacataaataaaaaataaaaataaataaaaacatggcagctattgcacagtgatacaagcaagtgatttaaccacctgctcaggttaggagcagggagccacctgcctgggtttgaatcctgcctctaccacttaagtagcagggttactcaagcaagtgatttaaccgctctgtgcctcaatttccccttctaccaagtggaaataataacaatgcaaattcctggtgtggcttacatattttaatacaggtgaaatcatagaaaagtgcctggcacacataacaaacactcagtgtgtgttaaccatttaacaacaactacgtacacagtttggtaatctggttattttatttacctgcatttaatgaacatttgcccgtatctgtaaatatagatctacatcataatttttaatggttacatagtagtataagttagtggtaatatattagagatattgataaaactatttgttttgttatgtatttattagttggtattataaaccatccctgcacaaacctttgtgcatacatccccaattatttctctataagtttgcagaagtgggttcactggatggaaaagtaagcacactttaaagcttttgtaagttgttaatatcttccagaaggattgtaagaaatgaatgagcaatgtgtgcccaccctaaaagtcagaaattattattgaatttgatttgagtaagtcatagtgcaggaaaacatcaattttcaaaatcattttaagcctgaaatggtttttatataaaagtttacatgccatttatgaattacaattatctatcttaactgccaggatttctcatgagaaggtctggacttattcatcaaatttgaataaccatttaaaaaaataagacatgtcagggactttgatttaactacctcagttctataattagtctttgggaattgtttggaaaaacagaagtctgttcataaagacagaaacctgttccaaccaaggtattttttaatgatgaaaatagtctaatgtttcttgctaattctggtgaacatatactatggtacaaggaattatctaagctgtcatgaatgccgagaaatatccaaaggaatttaaattcgagtttcttattacagtatcgtgggccagcttagtcctaaaggtaaatagatggttttttgtgccttcagacacaggttataaattgcacaattattttttatctgcattattaaaacaattgcacaatgggtattcaaaaaaattctaagataagaataattaacgttttaatattttaactagattttaaaatatcacttggcacttgcctggatgtgaaacgtgaaaatttctccctgccctgtcaatccatttcacttcttatcatcataagacctgctaaacgattcaatcgaatggtgctattgaaaggaataatcaaatagacattagaaagagattccatatgaatgccacagaaacttggaagggtgaaacccgtgtatagtatgctgtttctgtttattgatttctgggagtctcaaaattataaagcacctttttctcttttcttaaatgggttagtttctttgagtttttcacaattgtattgaaatatctagtcactgaggatgctgcagccttgttatatgactacaatgaccttcacaacctgggtaatcatacagtctatcatccaaactgagattcttttgatagtaaaagggactgtgattaataattattctggaaataccagcatgaaccatgagttttccaggaaaatgggggcatacggtcaccctgtttataacccttatccgtcagggtcttaatcttaggcaggacccctgcgtctgactaaaaataaattgggctctgaatcaggtgaattgtaagcgaacaatgctctcctttatagattaaacgagtaaatggcaacatttcaaagcatcacaaaattgccactttcattatgtttctgacactaggttttggtttttttccccccgaaattttgctgcataagtagtacctatttattctggaataatgtttaaaatttaggtgcacaaaaagaaaaactgaggaaaaattcccataattctttaattttgataactatgtctttctgcatgtcaatgcatgtttttattcatagtatctataacaaaaatggtattgcattaaactgcaagttgtagtggactggttaagaggaggggccacagagccagcctgccattaaacttctcccacctcaagctgtggaagcagcctccagtttgcactgcacacagccttaggtcccaacctgctagggatcccccgagacactctggtccctcctgttgagcagacatctcctggtggctgtcacactgtacacccctccctgatctacttcagcacaccgttttacctttgaagatgtgcctctgttcactttctgggactgaccctgcacacctcttcctccaccctattaaacctttaagttcatgagctcactcaagtaagatggcctcaagtatgcaaccatgcacccttgtctagattgacaaccctgaaaggcaacctttctgggtacttgcatgaagcattcacagttgaaaaacagctgtcagtgagcctgctctgtttctcaagatggtgggagcctgctttatcactcagaagcaccacgtgcattctgtgcacctttcccgtcattgactggaattagtttctgactccatgatccaggaataggagaacaagaaagatgtgtaacactggattttttttttgaagctccataattttcatttcagagcacatgagcagtaaaacagtggaggtgtggatgggcctcaatcagctggatgaacacgctggctggcagtggtctgatggaacgccgctcaactatctgaattggagcccaggtacccgcagtgttttctttgccttcgtcacgtggcatcatcttgcacccttacacagcagcatttcccatgcacataggacatgcttttttgagagtagtgtataaacattttttagcctgactgaattcctttaaggcaagcttttccaaacaagaaaatagggaccaggaagataagctttttagccaaagttgcaggaggatttgggtgtaagccaagattccagtctgctgttttaaaaatagctacaaattgcaaaatatctctctactttaagataataaaagtgggtcttttggaatctttgggaaatcatttaattgacatgcctggactgtaactgcaaaatcatagataacatcttataggatttactatatatgacaaatagaaacgctgtcccccgatgctgaaaaccacatttcaatatatattaaactaactgcttttgcttctaatattaaagacactcattgtattttcagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttggtaagcgtttttattttaagttgttcttaggtgttgttgacttgtcctctcaatatatgtaaatttctctattttttgctaataattcataatgtaaacttagctaaatctagtttatatttatatgaaaagatgtgtaactagacaatatctgttatgtcaaagggactgtgattttaacaaatgcatttaggtttatactaaaaactgaaataatctgagcatagcaaacattttcttctcttttaaaaaatttgcactgttagtcattctgtattagagaaataagatacatttctttttctattctagttttgagtttattgttcccctagaaattaaacataatttagaaaacaattttatataattatttacttcattgattttctgccacactctgaatctcttattagtaacacaccttcctccctgaaattacatgcagaacttttagatggagttaatacttaaataatatctaatcacagtctagtaccagaagtccaattatttctgtttttcaggtctataacctctttttagtttctctgagaattaatgtcttagctccaaatgtagagataaaagtataaccattttttaaagaatcattacaaaaataattagaaaaaactctagatttaaaataataagctgaattgtcatttttaaatattgtctcttagaattgggttttaactttcattttcctttaaatagctaagcctagaagttttgtagaatatggggtacaagctggggaaagaagaagcaacttgtcatttttttatgtagagatttttccattatttcaggaatttgctgaaattgctaccacctgttattgtccttttccctccctctcttccttctttcatattcctttctccgttccttctcttttcattttttctttctttccttcttatgccatcttgcattccctcctgccacccttctttccttctgttatatttatccttctatctgctaattgaggtcagaagaccagaaatgggagtagttaagttagcttgtttggattatttgctttgcttcaagttcaacacattcttctgtggattgattgaagtcttgcttttgtggcccaggctggagtgcaatggcacgatcttggctcactgcaacctccgcctcctgggttcaagcaattctgcctcagcctctcgagtagctgggattacaggcacctgccaccacgcccggctaatttttgtatttttatagagacggggtttcaccatgttggccaggctggtctcgaactcctgacctgaggcagtccgcccacctcagcctcccaaagtgctgggattacggcgtgagccaccacgcgcagcctaaaattccaagttcaaaaaggatttcatgagtgcttttttaggctgaaaaccattggggtcaatgatatacaaagttctaacactctttggccatgattctaattgctgccagagtcctagaaacaattttaaaagaatgttttgtttcccaaatagcagtgaaatcatatttagtttaactaaattcgttcttaatggaggcacctcgttgtggttaataaaataaggtaaaaatgccatcatcagattggggacagtctcgtgagaaaggaaagccaaaataagcatgtgcatcaccactgccctccaatgtccaaaacatcatggcactgtgttcctgaaagccccacctggagtccatatcagcccagagcaacatcgtggacactcaagacttattttcaaagtgaaacctatttgtcatccccattttaaaggaagtcatcagagttttaggctcttttcagctggggataaatatctaccttacccacatactatgtataaaatccttggaataccatttaaattgtattccataatacttcttttaaatataaaaaggtttcaaaaatgagcagctctgttaaattttatatctagccccaacactctgctttcattgtatgtcctctgtcaagtctctttacttctttggttttgttgttgttgttttacttttttactattttttaaaataaaattgactgtgtatgttcaaagtattcaacatgatgtcataggatacatatatagatagtaaaatggttatcttagtgaaacaaattaacacatccatcatctcacttagttacccatttcccccactgtgacaagagcaactatagtctactcatttatcaaaaatcctgaatacactacattaactatagtcctcatgctgtacagtagaccttcagacttgttcatcctacatatctgctacttgtatcctttttcctacctctgctcattttctctcgttgactcctataacattttatccattcagccattctgtgttttgattagataatttaatccatttgcattcagagtaattattccgataggtaaagacttactactgccatttttttcattgttttctgcttgttttatagattctttgtttcttccttcctctcttattgtttacctttgtgatttggtgatttgtgtgtgtgtgtggtgctaaatttcaattcctttctctttatcagttgtgtatctgctatagttttttttttttttttttttttgctttatggttaccatgtggcttacataaaacatagttataatggactgttttatactgataactgcttaactttagttgcatacaatcactctagatttttaccctacccccaatagttaaaattttgatgtcgctatttacatcttttaatatcgtgcatttcttaatttattgtagctatagttatgttttaccatcttggttatttatttatttacttatttatttatgctttagagacggtgtcttgctctgttgcccaggctggaatatggtggcatgatcatagcttgacctcctgggttcaagtcatcctcccacctcagcctcccaaagtgctgggattacagccatgagccactgtgcccaatctatttttgacaattttgactttaatcttcatagtagagatataaatgatttacagaccaccattacggtatttgaacattctgaatttgactatatatttacctccaaggaagaaggggtactctggaggtttggctccagggaacagggcacggctgtaacttgggaagcagaaccagtatggcacagtggcaactcaagctctaggggatgaagcaccaggcagtggtgactccggaccctggggtggtgggacacagcagtatctcaggctctgtgaggtcaggttcagtagcagcaaggacccaggaatggtggcatatacctgtggtttgtttcctgggggtcaaggagcagcaaaatgatgactcctctccctgggaaggtggggtgcctcagcagttcaggctttgtgggactagtccagttccaggaaggcaaggtgctacagctgtttgtgttggagggcaggatgtcccagccttgccaatgctgtttcccttggatgcagggtaccacatcagccaagccctacaaggcacagctgctctgctcagctcagccaaggcacccattcccccatgagatggggctgcttcagcttaggtgctggggggtatgactgctttgggcagctaaagcactgtttcccctggatttgagagccacttcagctcaggtgcctggggtgtgactgttttgggcagccagggtagggattccctgggaggcagggtgccacttcagcacacacactggggaacatgactactctgggaggccaaggcaccatttctttggaggcagggtgataagccagctcaggctctgaggggcacagcacagcaacaaccaggaagggtagatggagcagctcgtggcaacttggccacaccaggtagagtgagagccccacagcagcttggcatggggatggtgggccacgaggtagaagtggtgcagtggttacaaagcctcaaggatggaggggtgctgtggctactcactactggagcagaacatgacattctagcagtggttcttttttcaacattgtgcagcgcaatagacccatagtccacagagagacagggtgcagcatcagaactttctctgaggcaagcatagtcctgtagactccaggcagctccctcaaatgggcttagtgcctgtgggggctgcaggggtcctcagtggcaagaactgtaggtgaccctggtggtgttggaggctgctagggtccccttgctcttcctttccttacagagagaagtctctcctggctctgagctgcttataacgggggttgggggagatggtgggggtgggggcagcaagggtttctgtgctccgtgttgtttctgctactcccttgatgtgctccagcactctccttcagctgccttcgtgaaaatgtagtcatttattcattgctttggctgttcctgtggcagggatgagatcccaggtgttaccagaaaggggtcctgatccaaaccccaagaaagaattggaggcgaatccataaaaggaaagcaagtttattaggaaagtaaaggaataaagaatggctactccataggcagagcagcagcttgggctgctcagctgattacacttacagttctttctcgattatatgctaaacaaggggtagattattcatgagttttctgggaacggggtatacaattttcggaactgagggttcctcccccttttagaccatgtagggtaacttcctgatgttgccacggcttgtaaactgtcatggcactggtgggagtgtcttttagcatgctaatacattataattagcatataatgagcagcgagggtgaccagaggtcaccttcctcaccgtcttggttttgatgggttttggccagcttctttactgcagcttgttttattagcaagctttcttgatgagactttctgtctcatcctgtaacttagaatgcctgacctcctggaaatgcagctcagtaggtctcagccttattttacccagctcctaaacaagatggagttgctgttgttcaaaggcctctgacacaggtgtctctatcggccatcttgctgccatccctcctctccttacttctttgtaccttcactagctcatccggaaaatgaaatactgaggttcatttgatcctagatctaaatctagatcatagattagacccttctcaactctgaagatctagaattccatgatatatgtcattttgtatatttctgtttttcacatttttaaagtaatcatattaatggcaatttacataagctgtaataagtaatgttaaaataattgtggaaaatgacattgttttttgttggtttaaaaagaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatggtgagtcccagctgcctttggtttaaaaggcataaaatataatgtagtaactacttttattagtggagttgaaaagaaatttaagctatttaaaagtggttattcattgcacatatatttaaagtttctaaatgttattcaggagttcaaatttattggatttttacaaaatacatgttcagaaactttgtaacatcttcatatatgccacatatattagatgatttttaaatttttggaaagtaggaaagttcatttcctaaaacttctaacgaaaaacctaaacctgtaatttagctttatggccactagatagcagtagtgtgttgttaacatgtaatccacataataaagggaaccccttaggcaaataattagatgtaaacaattttcgccagtgaacatgggtaatttatttggtgaggtgatgttcagactgttccccatgtataggaattttaggctcctggcttccgcacagcctgagtccctcagagttggcctgctcttcactgtgtcatgtatttgacatagacttatgctgaaaaatactgaaattatttatttcatttttcagttttttaaaaatacaaaaaaatgtccaggatctcctttgatgaccttttcaattgttacattttagtttggagtaaaaacatgcatccttctctgttatttttcctaatcatttgcatttgggattaaagaaccctgtgggctgcttatctcaacaagggcacttacacatctctttcagccacatagggtcctttcctacctaggctgtcaagttttaattacttttgcagcaactccatttcaatgcctttaagaggttttgctccttttttcctatggcagaaaaaagaaaaaggaaaaaaatactttaaaaaataggtttaagaggtacaagtgagtatttcttacatgcatatattgcagtggtgaagtctggcctcttagtggccccatcacctagatggtgaacattgtacccaacaggtgatttttcaaccctcagcctcacctctgctaccttttggaatctccagtgttttttatcctgctctgtatctccatgtgtccccattgtttagctcccacttataagtaagaacacgcagtatttgacattctgagttatttcacttagcagaatcgcctcaagtgctacctgtgtgcgaaagatatgatttcattcttttctatggctgagtagtattccatggtatgtgtatgtgtatatatatattccatattttctttatccaaccctcctctgatggatacttacatgattccatctttgctattgtgaataatgctgtgataaacatatgagtacaggtgtctttttgatataatgatttttttccctttgggtatatacccagtagtgggattgctggattgaaaggtagttctatttttagttctttgagtaatcccagtactgttttccataaatgttgtactaatttacattcccaccaatagtgtataagtgttcctttttttgcatcctcaccaacatctgttggggaaaaaaaaactcctatctttaagctagactatcattaaaagtttgtttgtttcatgcccttttcataatccagtgggccttcctatttttcctttctctaggcagaagcaaaaccagatttttcagatctacttaacatacatacatggttctagcagaaaccagagccccaggaatccaacttgcttaggctttgttgttgcattggctttagctcacattctgcctcacttataaggcctatatcaagcagatctggatattatggggatgtcttagtccattttctattgattatagtagaatacaaagaaactgagtaatttataaataaaagaaatttatttcctacagttatggaggctgggaagttcaaggtcaaagggccacatctggagagggtctccttgctggtggggattctctgcagagtcccatggtggcacagggcatcacatggagagggggctgagtgtgctatctcaggtctctcttcctcctcttataaagccaccagtaccattcccatgagaactagttaatccattaacccattaatccattcatcagggcagagccttcatgacccattcaccccttagaggcctccttctcaatactaccacactggggattaagtttcaacctgaattttggaggggacaaacattcaaaccatagcagggaagggaaaatgtttaaacagacattttataccaagacttaaacagatttcatcatgcaaagaaataaagaagaaatcacatgtgaagtggtatattttagtaataactccagggtgttacctcctttgcaaataataggatcccataagtaatttacatttatctcttacagaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgtaagttgattcatttgttcagtgctcactttgctggtcttgtactgaaggccacctgtgttggagctttgggctgtggcagagaccaagacaggtgcagtccctgttcctcatgggccttccatgttagagagcaaacaagtacacacagaaaaaacatggtaattatagttgtaatgattgctccaaggaactatgtgacatgatagtgaaaagcttgggttggggcaggacaggacagccacagaaagcatttctgaaaagttaatatttaagcttggacttaaaaaaaaactctcagagagaagggggaagaatattctaagcagaacatgcagagggtagcaagtgcaaaggcccaaaggcagaccaagacttgccatgttgaatgatcaaaaaggagaccagtagtgaggaggtcgtaagagatgggcagtaggaattctaaaatgccaggtttctagattgtggtataggaaccaataaagtacttcaaggaaacaaagggcatgacctgatttacattttacaattaactgtggctgctacacagagaatggttaggagaggaataaaatggaagcagaaaagccagtttggaggctacaccagagttgacttagggtagtgactgtgaagagaagtggacagatccaagtgtgctttggagaacagaaggtgttgctaagttagatgtgggggtgagagagaggtcggcttttggcttgagcaaccatggttttggtgtatggtggtgccattgactgctgtgatgaagatgaggggaagaactgagggatggaagattactctggagagtgatggtttttaagctccattatgttattcacataaaaggatttaaacagtatgtgtaacctctttgaaaattgtggatcagtggcaaatcttgctttttttcctcatgtggatggagtggtccccgtagcctgaacatcacattcatccctatgttctagtctctcatttatctaaagcatctgattatacagaattagcttaatcccaagccatttgaacagtttattatgcctaaaacagacttaatctctttgatcaagatagctgctgaatacactggctgagttttagggggttgttgggatttggtagatgtccatgttcttctaaccaccaggatactctgtcaggttctccgaagaggcagtttattaaatgttactgatgtggcttgacaaagtaattatgccagcaaaacaggaagcatttctaagcacttaacttttgtgacatgtttcatggttccatcttttaatgctagcacagacaattacaattgtacagtgcagtaacaattatacatgctaaggcagtgtctctcagccccatataaaggagaaacaatacctctaaatgtctgtcctgggtctagctctgctgaaatccaccacaatgtttgtttgtttgtttgtttgtttgtttgtttgtttttgagacagagtctcactctgtcacccaggctggagtgcagtggtgcaatctcagcttactgcaacctctgcctcctggattcaagagattctcatgcctcagcctcccaagtagctgggattacaggcttgcaccagcatgcctggctaatttttgtatttttagtagacatggggtttcatgttgcccatgctggtctcagactcctggactttaccatccttggcctcccaaagtgttgtgattactggcatgggcaaccgcgcctggcccaccacagtttattctacagtatctgctgatttattggttcattagttttgatataatttaggtgatcatttcttattgacaggcatgggtatgttgctctgcaagtttacagaacaggagccaatatttggacagagatttttttttaagagattgatgataggtattaatagtattggatatgtcaggacaatgctgccgtaagtgtaatattttatggccccttttctggaagctcagaagctccttaaatagtagatgtgtaaaaattaacatttatttccatggagtagaacttagtatgaatataattattataattaacaagttccccaatcacagttgacacaaatttgaatatgagagcctaggaaacaattcatttgttcttccattcatctaacagttcttaactatagtatgcctgacactatcctgtaactggattgtttgctggaagactccatgggggagcgatgcagggctcctcttacagatgaaggtatcagccctggacgttgtatttttctaagggtcatggaagggctccacattcccctaaaattctagatgtgtgaaataccacctggaatttgaattgtgtaactttagcctaaggttctgatttgtgttattaaaaaatcctatgggaggataaaattttaatatgttagcagttattatatcattattaatgaaagatctgagagtagccttcaataggattagagaaagacatgaaggtatctgcctagcatataaagaggagatggggtggtgctgttcgaattcctgatggagggatcattgaagggtgaacatgagtttcagctatgccaatattacctagggtgtttcatggtagcttccaggaatttccccagcatcaggtagagacatgaaagcagcaaagcatttaatgtaacacttagaagtggttgaagagaggcgtcagcactctcacttggtcaggaggatggcttcatcccagtggttctcacagtgtgacccccagaccatcagcattaacatcacctgaaaacttgttaggaatgccaattctcaagtcccaccagacctaccaaatgagacactggtcatgcagcccaatcatctaggtttcagttagccctccaggtgcttctggagcacactcgagattgagaaccatggctctatcccatcttttcatagaaaaattgagaacagcttaatggaaagccaggctgaccttggtatcaatcctagctccaatttttactgactctaggaccatgtaaaatgctaactctaacctttaaaatgggaattataatccctacctcactggaacattgagataatatatgaaaatcgccctgcattaagcctagcacatggcagctatcaagaagcaccagttgttaatagttgctccctctctcctgcccacccagttacagattgcacaccttggaactcatgctggagagaggggcctttccctagacaaagtgtcaaccctttccgtgacaaagcagagtgccgcctgaaacattatcccacgcgggagcacattattcatcatatttttttttataagaattgctattgcccatcggtatcagcacagagtgtattcattctcttgtaacatttttctccgtaggagggacactggaaagtcaaaaattgtgaagaaagacttttttacatttgtaaaaaagcaggccatgtcctctctgatgctgaatcaggatgtcaagaggtaagtgctgttaacattgcaatttaggtacagggacttcatagctagaatatcaattccaccatcaatttgaagtgaatttctctttctcctctctctctctcctctctttcatctctctctctctcctcgcaccccccccttctttcctttcctcttttttttcctgtcctgagaaatgttgtcttgctatcttctacacaggattacttttcttttgagattaaaaatgtaaatggtcctgatacagcatctgtacagtgactatcctgtgatgtgtgatgccctgtctcacacttggttttcctagtctttctttcttttctttttctttttcttttttttttttttgagacagagtcttgctttgtcacccaggctggagtgcagtggcacagtctcagctcactgcaacctccacctcccaggctcaagcaattcgcatgcctcagcctcccgagtagctgggattacaggcgtgcgccactacgcctggctaatttttgtatttttagtagagacgggattttgccatgttggccagacttgtctcgaactcctgacctcaagtgatctactgcctcggcctcccaaagtatcgggattacaggcttcagccactgtgcctgacctatggttttcctagttttcaagtgagatgtcataaaacaattgtgttcctctgagtcagagtgaactatgctttatcagtctcaacagttttccagacctggtctttatgcaactatgctttaattattttctcttctaatccagttatttgtattgcaattgaacaatgacccatccccttagaatcttcattttattcattaatcaatgtgtaaacaagtgaacttcatactctagttggatagtagatatgccgtagctgacatgtcaccattttatctaatgattataatctctgaattagttatagctgatctctgattaatctctacctgatatgaaatattgaagacggggcaggggtgagggtggggggatttgtcttactgtggctttctgggaaactcaacgtgttttatttttgttgaaaggacaattaactttttacactgcaaatacagaactgatgttctattcaaacttttgttcatggcttcccttttccagccagcattaccagtatttaaagttcctgagttcatagccaattctctagctttgtgaagaaatttccagtaattttattatgcatcagtctatgaatatggttttgaaagttttctcttttttagaaagttgcttcaatgcaattctctaaacagtctgcacttgaaaaatcaatttgtaaaatcaatcttgataatttcaaagcaaaagaagtgatttgtttttccttctgagtcacttttttgggattggacaatatgagcaattccttcagttttgtcaccaccatcctttcatttaaaaatgaaatggcacctagtgtacaaagggttaactgatataatcagttatccttcccgtattcattgtgtggacaaagtcttgaagtaacaagtcggtgtttctgattattctatgccagatctttttttccctcccttttcttgagctggttcagttattggatttttttgtttgtttgttttgctaagcagcctatgatctaaaaactgctaatgaagaagaatacattatcggaaaggtcaaattgccagcctccctctccctgtccttccaagtacaggagcagtctaatatccctgctcctaccctggagggatgcatgaaggagctgtatggagctgtcagttactcacagagagaagattgggaatagaagtgaaggggagtgagttcagagcagatcctagatggctggatgtgggagctcctgtgcttcctacctcagttaatgatatgtttgaactaacacagctgatctctaaattaaggttttctttaatttactgcaagaccaacatcttttccaagaaatttatgagaaatcattttataactgatcaaaagctggcaagaattggcatagcataaaatgaagagtgttttaaaactggtgaataaattaaaatagataaaaatgatgtgatttaataatattggggaaaaaagaactaaaatagctcagtttaaatatagaggactaatgaatgtatgtcttaccatactgtgtgatttcagatgagatcgggcacattcagggtggtgtggccatagactgtactgcatgatttcaaaggaagagccacccttcgttgttcccagggctaaaacatagacctacatgtttgtcatttttgtctgagtgccaaagcttactttcttcccctccaaaaggccagccagttaatttaggaataatctttacaaaaaaaaaaaaaaagaaagaaaaagaaaaaatacatatattggccattctctatttggaagcattatgctccaaacaagaccatcctggactgttccagaattgggtttcaggcccaactgatccactagtttgactttatccaagtccctaatctcaatgaatctcagagggataacatgaaataatcaatatgaaagttgaaaaaaatctctaatattatctagatacatatattctctttgttcatgttctctttcccctctgttcaattctaaaatctctatctgtattgtccttctctgattctcagaacaaccccataaatactattattatcctcatcgtatagatgaaaaaactatgatattaaacaaggttgcacagtagtggagccagaattcaaacccatgcatcctgaccctagagccaacacttaatttctaccctcctgtcggggccatttatatgaaattctgtaagtcagagagagagagacacacacacacacacacacacacacacacacacacacacacacacacacacagagagagagagagagagagagagagagaaagagagaggtagagatcttgaatgaatgccctttattttcatttacttttaaggttttacgttttaagttaattaaaaattttaggttttaagataataaattaaataaatgtagaagtgggtgtagttaatggcattactggatagaataaatataaaaatatcaagacaaaaattcaaggagttttaaaggagtaagagaagaaagttatgtaggtggtaaaagagtatgcaaaaatatctcttggtatttaactaaatgagattgtgtccttaatttcccttttattctttttaagggatgggagagacatggtggattctgttacaaaattgacacagtccttcgaagctttgaccaagcttccagcggttattactgtcctcctgcacttgtaaccattacaaacaggtaaattaaactttttttaacagaaacaagacggctttcacatgaggactcttggaatgataaaatctagctacaatcataactgttcaaaatctaaattgtgctatacatcaaagtactaaattatttaagttatttattgagatgaatttaaattatactatgttattccagaattgatttttgagtaataaataataaaatttaaggtgacctttactatctgtaaagatttattaattatccagcttttctaatatattcagatgtttttagattttatcttctaactgcttatatgggaaatgaaacccattatttattttttattttattttttttcatttttttgagacagaatcttgctctgttgcccaggctggagcgcagtggtgcagtctcagctcactgcaacctccacctcccaggttcaagcaattatcttgcctcagccccatgagtagctgggattacaggcacctgccaccacgccctggtaatttttgtatttttagtagagacggggtttcaccatgttggccaggctggtctgaactcctgacctcaagtgatccacctgcctcagcctcccaaagtgccgggattacaggtatgagccaccgcgcccagccaaaacacattatttaacaagtatttttttgatgtaatgtatgtgaattgtatgggggtgtttttagcagaaaagctataaaatgtggaggatattcaaatccttcaccatcacttcttccatctattttatttagattgagacttctctgtgcacatatgccttcctgatgctggcacagagactgtgccctttttacactccatacaatctgccccatggtaccgatgcataatacctgtaggggataaaaataccaagagtaaaggtgacctcatatcagtatcgatgccaggaggacagtgggggctggaacacctgggagacccactcctcctggggaagacagaagcggggtagaactccagtggtgccacaggaaactacacctgcaaagcaagtcacttgcatatttacctgggccattgcctttaaaaatattcactgaataccagcaaataggacaactggttttacctagagacccttcccatataagcctaatttgtagaggaattcctgtatgatttctctgctcctcccacattggaagtcaacatccaaagctgccagtatgtccttcctcctcttaccctctttcttgccttcttacccagcttctgttccaaacaatgcacaggaatgcatacacacacacacaaacagacacacgcacacacacacacactcaaatggattgatagcatttggcagactaagtcacctggtgaaacattttactttcaggagatcctcccgttgaaatatagcactacctttgatgtatctcagcattgtttttagttctacctttctcctcccaggtttggctaacaggcagaagaaagcctttatcaatttgttaactcacccaaaaggttccaagaacaccttgggttggaagtcccccagtcagtgagtcaatactggacttcacaggaggctgaccaatgaagctatacgctcttttgttaattacaatttaattatgttttttaccaaagaaaataagtccaattgtttcacctgttttttatgtcttattctttatttttttgtttaatgttcattgagtgcctgtcacatacctggcactgtgttaattatttttcatatgttatctgaccacacaaaaaattaatagccaagagtttattagaaaattttttttgaatacctgttttgtgagagtccccatattaaacactgacatgctatccacaagaaataaaaggcatgctattattgtccagtgctttctgaaacccagcagctgaagagatcgaacatagacacaagaaataagtgaagaaggtagaatagcacaataaatggataaactcacagtgacattacagataacccatagtgccacagtgacccaagctaaggcagaaatctgttagaacaaatgcttcatattccatgaaccctttggggacctcatacaaatgacagaaagtatctgggaaaaaaatctgtttcattttccccaaaactggatacaagactatgttgtgaatactttaaatgttttctctggtaaactgtattcagtagcaagcgctcatgcctggtccatctgtaaagcagaactatggcatagagaagtttgtttttatcccagtcttggcctcctacgcctgtccagattgccctgtgctggtgtgctgcctggtcacccgccaagccctgagggagtacagatgagcaggatgtgtcatctgtccaagtcagttaacatatacttatgctacccccaaaacatgtctacattcaaagcagcaactccaacacaggactcatgagttgaagaaagaaagggccaatgctcttggtttttaatcattcagagtccatcagggaagaaacaagggtccacactgtactgcttttgattcaccatacacgttggaatttttgcaaacagcatcttttgtctgagaaggttgggcagtagatggaaagtgtctcagatccaggagtgtccactagtggccatggtaatcattttcttccattactgatttcctgtttaagacactcctgtcactcttcagtacccaagcttgtagttgctaattgattttccactcttctgcacaatggaatgacaggtttgatgggcacaattagaaccacctgctacaaattacttatttcttttgtgatcaggcaactgctcctggtctaagacttttaacactttgtggaatagagaggggaagaaaaacagatccttattgttgagtaacaaatttttgtttgcttgctgattgttacaaaattttttcaggcctggccactttgcttccagacaaagcatgaatgcaaaagttgagttccaaaattataatggataattggctaaatccatgtatgtctaaattttgaatcaatcagccatagaatattggtacaaaataatccaaatggcattcaattttgtgaattttgccaaaagtgagaaattctgcaatatctcattttctcctaagtttattttactttcatttatttttgagacagtgtcttactctgttgcccaggctggagtgtagtggtgccttcatgactcactgcagctttgacctcctgggctcaagtaatcctcctgcctcagccccccaagtagttgggactacaggcatgtaccaccatgcctggctaattttttaaaattttttacagagacaggttcttgccatgttgccatggctggtcttgaactcctgggctcaagcaatcctcctgcctcggcctctcaaagtgctgggattataggtgtgagccactatacccctcctaagcttaaatgtgcattattttaaagcatttttacagctctaccgttttcctgcaactgtcatatctccccaaaacacttttgcagttaatattttttttattgtggtaaaatatacttaaaacacacataaacataaaattcaccatgttagtcatttttcagtgtgcagttcagtgtcattaactgcattcagattgttgttcacccactaccatcatccatctccagaacttttttcatcttcccaaactgaaactctgtacccattaaacaatagctgcctattctcccctcctcccagaccctggcaactactattctattttctgtctctgtgagtttaactactctacatgtctcatataagtggaattatgtttttctgtgtctggtttatttcatttagcatgttgtagtgtcagaatttcgtttctggaaattctgttttaaggctaattcatattccattgtatgtatatacacatattgtttatccattcatccattaatggacatttgggttgctcccaccatttggctattgtgactaatgctaccatgaacatgaatgtacaaatacccttcgagtccctgctttcaattctttggcatgtatgcctataagtgaaattgctggatcatatgataatttgattttaaattttttaaggaaccactgtactcttttccataatggctacaccattttccattcccaccagtagtgcataaaggttccagtttctccacatcctagccaatgcttactattatctggttgttttgttttgataatagccatcctattgggtgtgcagtggtatttcactgtggttttgatctgcattccactggtgattgatgatgttgaacatcttttcacgtgcttattggctatctgtgtatcttctttggagaaatgtctattcaagtcctttgtccattttttaattgggatgtttgtcttttctattgtttagttataggaatttttaatatattctggatattaatcccttatctgatgtacaacttgcaaatactttctcccattttgtgggttgccttttcattctgttgatagtgtcctttgatgtgcaaagtttttaatttttataaagtccaatttattaatttcttattccgttgcctgtgcttttggtatcatatacaagaaatcattgccaaatacaatgttatgaagtctttttcctgtgtttccttgtaagagttttatagttttagctctcatgtttaggtctttaatctactttgagttcatttttgtgcatagtataaggtaagggtctaacttcattctgttgcaagtggttgtctagttttccctgcacagtttattgagaagactgtcctttctgcactgaacagtcttggcaccattcttgataatcatttgacatatatgcaagggtttattcctagtctattccactggcctatgcgttagtgtttatgctagtaccacactggttttttgttttgtttttgttgtttttgagacagggtctcactctatcacccaggctggagtacagtggttcagtcatagctcactgcagccttgacctcctgggctcaagccatcctcccgcctcgacctcccgagtagctgggactacaggcatctaacaccaccacccacagcaaatgttttttatgttttgtagtgacaggatctcactatgtttcccaggctggtgttgagctcctgggctcaagcaggctgcctgcctcagtctcccaaagtgctgagattacaggcatgagccaatatgcccagcccacactgtcttgattactgtagctttgtagtaagtttggaaatcaaaaagtgtcagacctctaacttggtttcttttcacgattatattggctattcagggttccttgaatttccatatggattttaggatgaacttttctatttttgaaaaagatatcattgggattttgatagggattgcattgaatgtatacatcactttaggtagtatgagcatcttaacaatattaagtcttccaaggcatgaacacgggatttatttccatttctctgtggcttctttaatttccttcagcaccattttgcagttttcagtatacaagtctttcacctttcagtatacaagttttcagtatacaagtctttgtgtagtttattcccatgtattttgggggcactattgtaagtggagttattttcttaactttcttctggccaaactccacatcgttcttcctgtcgacggcctgccggcatctgccagtgcctgtcggtgtgctcttccaccggtgtgttcctctggatgtccagccgcttgtctgtcttccagctaaggcctcgggggattttacaagcacaggatgggggtgtggcaagccagggtggtcttgggaaatgcaacatttgggcatgaaaacagaaatgcttgtcctcacctaggtctgggggcagaggctgggggtggagccctaaccagggaccccgcccttctcctcccagcacttccctgacccggtattactactctgcctcagaggagatagagaaaagcagatcgtatattattgagagcatgaaccaacagaagtgtaaggaaaattacaacagcatgtaggcaatatttagtcttctatatgttccttttgaagcacatttatataaggttctgccagtatgatctggattaaaaaaagaacttttcttgtttcaaatgtgtgctatttaggttattaatagagtatctgcagaaaatatttactaaagtatgacgaaaatccatatcccctgcaaagatgagtaccataaatacctaagatctctaaatgttgctaataatatctgtaaggcacttaaaatttttacttctttttattcttttctctttttatctcctatttcctttgagactcttctattcataaatgacctcattgcttttgcttcccttagcaagttaaggatgcacagtaacgaaaaaagccaccaaaattgaatgaaaagatctaatttgctttctccttaggtttcctgggtaatggcttcagcctttccttttccattgactcagcaggtctgcccagaagtcgccactgtttcaaatgtgcttcttctaactttgtatgttctaaaaatagctttctcaagatagtttcaacttagctgaaaggttcaatgctagttaaattttaatagtcatgtttttcttagtaggtgtgcatgtggaagcatgtatgtgagtcttctatattctgcttttgatgcattcatactggaaagggggcactgccaccaatcattgaacagtaattcattcagctgtttgggaagtatattagtggatgtacggccttagattagttcctaggctttcacatttttcttcagtgaacatgcagatttaaacacatttgaataagctgagacctacctctgcctatgaacacactgatttgggagacataaaattgctactttaatttctgtttctttctcaccaggcaagtgaggtaggtgggtgtgtgtgaactctgtattagtaaatgctcattcagaaaagcataatatctttcctcctccctcctgcccacctttaccccgtgcatattgtggcatggtgtgtgtggtgtgtggcctaattacaaaataggccacatcgtactccaagaaatgcattgctggccatgtgaactttaccacctatgctttgaaactggagctggactctctattctgtgcaagaattaagccccatatgcaagagtcagattctgctcactcatatagttctgggaattgcactgacattcggcatttattagtaatgttcagggtctttgggtgttttcctgttccatgttctaaagaattgatgagaaatgcttactctggggccattctgtgcacttcattatgctttaatgacatttttttattgcccagaaacttaatgtaaccacttcttttttccccttttaaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgtgagtagagtgtgctgcatcaccaaccctccctgttttctttactccaaattccttccaccccttggcccacctcctttgattctttcttaatgttttcttaatgcctaaatcaattacaaggatcaacacaggttaacagggggtgacatatggctgatctttgtttttatttattttatttatttgtttgtttgtttgtttgtttgtttgttttgagacgaggtctcgctctgtcacccagcctggagtgcagtggtgcaatctcggttcactgcagccttgacctcctgggctcaagtgattctcccacctcagcctccccagtagctgggaccacaggcatgcgccaccacacccagctaatttttgtattttctgtagagacagactgatattgaactcctgggctcaagcaatcctcccaccttggcctcccaaagtgctgggattatagacatgagccaaattgcctggcccaatggtcatttttaaaagtataatccgtatgagtcatttgacatgttaaaggtataaattcatcgctcaggaccaccactgcctttattagcagcaagtccagcttctccctcctaatgtctttctccccacctgcaccccccactgtctaagaatctcaagtgcttactcagttcagaatggtcagttaaacttcaaagtacggtggatgggcacatatgggtacatccaatcagttcacagtcactgcctggggtaccttagccaggattccagcgttaacagctctactagttcatcctcaggtgttcagctctgaatcccaaggcatgaaactgtgccaggttggtcagtaccagagaagctgatgtcttccgccacagcctacactagaaccagtctctgtggaacaagcttcaggcccttgtattaagctgaggttgacagcctagacccaacagcccctctacttcagggtgagttcttgcttgcctgtatctccatcagggctgtgccagagacaacagcaaagagttactaagtttgtatctagaggaaatggcttaggggccccaggctcttccctccttgaaggcccggagctctttatacaaattggtctattccatcctcagagctctatataccaaggtaaggaaagtgtttgctaagccacagggggaggtatatctcccctttagtgtggcctcacactaaaatataaaagtggccacacaagccttgtttctcataattacaaaagtccagtccaaggtggtttgctaatcccaactctagacagtggttggcaaagctccaccgatttttaaaattcaacgatgaaatcatgaatatattcttactatagataatgtgaccatatacctcatttgcccagaacggttctaatttatgtctggtgtcccagagcaattaacagcaggtatttttactccaaatttttctggcttggatggtaaattatgtagatgctctaattatagagaagtgtgctaagtaaaatgtggaagtactccgttacatctttctcttcaccttcccaacatcaatacatttcccttttcagaaacaaccactgttaactgtttggtatgatcctgctggtgtttgtctgtgcattgcatttaaatacatttatgcatatgtactttttaaatggatataaggatttcatgtttctgttatttgatttttttcacttagcaatctgtcttagagaactttccacatcaatatttattagtcgacatttgaaacagctacatagaatttcgtagtatgtaggactcataatttgctttgccatgaccctgttgaaggacattgggtgaaattcattttcatttctgctacaaaagtgttacaacaaatatctctatgttgatgtcgctgtgcataactatgagcatgttggcctaaaagtgtacatcttactgaggcattatcagtttacaagttcatctaacaaaatttgagagtggcagctttcccacatttttgtcaatactgaatgtaacaaccttttacatttttgccaatttgatagaataaaaaaagttttactattcttttaatgtctaccttttcatttagttatttgagcaatttttcatatttgttctatacattttgttttgtttttcaactacatggtcacataatttgatcactttctatttttattttggacactttctattttctcattacttagtggaaatttcattatattctaaatataaactctacatgtttgctatttgccttttaatttttctatggtatgttttgtcacacataaatgttaaactttttgtagtaaaaaagtttatatttttcattttagctttgtagatttttatattttctaaaggctttgctcaaccaaagattataaaaatataaccttatatttttatagtttggctttttaaatgtataattttgattgatctgagattttaaaagtatgttctaggagatagctcattttaatttttctaaatagtaaccaatttcaacactatatagtaagttcaccctttcgtctactgattcgaaataccataataaacataacctacattctcattttctgtttccctgccaatatggcactaacataattcaagcagtgtggtattgaaaaagaaatagaaaaaatagaatcaatgtagctgaaaagagagcagtaatacaagaatataatttctattattcttagttttcttggagctcttttttaaaattattaacagattttaaattttactcaacactctgaatctactaagacaatcctaaggttttctcctttactctcttaatatgacaaattgctttacagtagtaaaccagctttgtactgttgggtaaacttaacttagtgatatgtattttaatacatctctgggtttagtttgctaatacaaagcttcacctactataatgtacataagaatatcctgtagattttgatgaagttaaaattctgattcagtagatctggggtaaagtccaagaatccgcattttttaaaaagctcctaggtgctgcctatgttgcaggtacacaaactaacctttgagtggtaggtttatgattttagcaaccttttttcatagggaaaactagtccacatttcttcatttgtatacagctttggtttcatgattatgctaagtttcatagaatgaattggagagtgttcacttttattctctacagaactatatatacagtaaacatttattagaatttgccttatgttttatataggaaatttaaaaaccactaattcaatttctgtaatgcttataagactactgaggcttcctacttccttccaagtgctgcttgagttgtatttcacaagatttagtagagttttataatttttcaatttagaatacattccaatttccaatatgaatatgatttcaacccataaattatttagaagattttttttaatttcccaaaatgcaggtgtttctagttccttttgttgtcaataccttatttaattgcactgtggtcaagaaatacggtttgtttggtgcctgtcctttcaaatacaaagttggtattatggccttgcatgtgttctttttatatatatatatcccatatgtacttgaaaagattgtatattctgcttttgctacctgaaatgcttcatctatgtcaacagattatgttaaatgtgttgttcagatcatctatagcctcaatattttttgcccacgtgatcaatcaattattgagagtgtttgatacctcccactatgatggtagatgtgtaaacttctccctgtagttctgtcgaatttttgtattacatactttttaggctgttttattaggaacatacaagtttagaattgtgatatcccacctgtggtgtcaaaatcggtatagtagtatcccaagtgatcctcttgttctttcaaaattattttctccttagagttaatttgtccatgaatgtagctacagtaactttttaaaaattagtattggcctagtacattttttaaatttttttctaactttgaatgtttttgtgttcttagagttaatgtatcacttataaacagcatataactaaatttttaaaactctattcacacattctttgtccttaactgtatagtttggtttacttatattttttgtgattatgtatagaattggatttatttcttccattttattatgtcctttccatttatcctgcattttttagtcatgttttctcttctttcttgccatcttttgaatgtatctttttcttcttttctcatttcattctttcccctttacttatctgaaaattgtattatctaaatctatttttttatttgttacactagctattcaacatgcattcttaacaaaatcaacaatatcaaagttattcatctttaaaaggattataatttgctgttgctgtctagttttgaaaattctgaactgcttcatttctgttagccatgattttgttgttgttatctttgcaatgaatatttgtttagatgtattcatatactagtgtaccattccttctgtgatctggaacaccttcagtttcgtatccttttcattagactcccgcaacctgaagatggttggttttacacaactctggaaatttttcaagcattatctcttcaaatattgcctctccccattcattctaatatttccttttatcattccaattactcagcctctcctccatgtttgttaatatttttaaaatattttctacctctgtgtctctcaaggatgcattttaaataaagtcatgaattatttcaattcattgattctctcttcagccagatctaattaaattttattttttagttttcagtgttagatactatatttatttcatttctagaaagtctatttctgttttaaatttggtttgtggttctttgtagtcacttgtttcctactcatattttaaagattctctttcatttccttaaatgtatccgagttattttgtatttggtttctaataatctcatacctgaagttgtatgggtctgtttctggatctcatctctttcattttgtgggttttgcctagaactactgatttttctttgtactttatttatgggagttctctcacccccagggtgaagttgggctcctccagtgaaaattagcatttgtttccaccactcagtttgaggcactaccaactaaggactgctttaaaagctctgactgaggttttcttgaacacataggtagcatgaattcgatgactaacgactaacctgcatgaagtttgggttgtggttataaattctttagaaagttatttcttttcttattattcactcccaagattgacagagacaagtttccttacaaacagctgagtgaatatattctcatgtacgcttaccaaaagtggccatttgggattctattttatgcaggtttcttctgttagacttttcattttgtatatctcttaggcttcatctcctttcccttaaaatctccatgcaactatcaaagcagatgctcaaggtctccagaattggaaagaaacctttagggtaaatcccactaggaaggtagtttggctaccatggttcatacttttacttcatttgcaagctctatagatttgtttattttatgccagctcagccatacatttataaagatgttttcaaaatgttttatccagcatttcaactagtttgaccaaaagaatctttcagggtacctaatctgctggttatttctcatagcaccatttattttaacacatgagattttaggatagagaagagataagcacatgtattcagtctactgctcaatctttgagatgtctctctctgtgtttttaaaaattttttctttctataaccctattgcataattaaagccattcatttaatgaacttttacaaggcatttgtatgacaagggacatttaaaaattacgtaatgtgcatgccttcatgttgctataatctgggagtggtgacagcaaatacaataaataactcatatacagattcttagtcattcctgttactataacaaaatatcacatattgggtaatttataaataacagaaatttatttctcacagttctagaggctgggaagtccaagattaagttgctagcagattcagtgtctgctgaaggccttcttgcagcgccctcacatggtggaaaggcaaaagagcaaaacaagactaggacactccctcagcctcttttataaaagcaccaatcccattcatgaggatggagcactcatgactttattacttcccagaaggccctgcctcttaatactatcacatatgcgttttggagggatatattacattcaaaccatggcaacaggaaaatgtgtggtgagtgttgtaagaagtataaaataaagaactctaacagttaaatgaagggaggattaattcccattgaagttatcataaaagttcaagaggaagtggcctttcacctgggattgaaaatgtctgaaatatagtaggatttagtggttaaagaagtaaaaagaattttctcagcaggaggaaatatatggggcaactttgagaaattttaggagcactgtgtaattagagattaagatacatgcaaaagagttgtaaaagataaggccagagtaggacattgaaactacagcttaatattacaagctaaagagttttcacttcttctctaggtataggaagtcactagaggttttggatcgaaaaatattaggatcggaagtgttcttcattgaggttattatgtagggtgatacaaacagatataagagactgcactgcaggataacatatgcataaagagtacctacccactactgagttgaactaaagttcaaattccagctctatgatctcagggaagttatttaatctcttcatatctcagttttctcttctttaaaataaggacagtaattgtatctacctcacaggattgttgtgaggattaaaagaaatattacatagttgctactgcattgtaaatacttaataaatattagactttcttattgcagagaaataatttgcaggattttacctaaagctacagatagtgacattgctaacctattagggttcctcacccatacattctaagatgcaggacctattctgtgctggaccagccaccaatgtgagcaccctgggaaaccacagagttttaaaggaaggtatgattgtggcctatacacatacatttccccaacacttaggagctagtgttaaatgtttttaaaaaaaattcctttagacctcctgatattagaaaaagaaaaaagagagagatcaaagaaagtcagtttacattctctctgttaaatacatggtttaaaaccctgtacttttgaagacttccagttcccagacgagcatataagaagtttagaagttacaccatcctaatgagtaaagagctgaacaaactgaaaaatcaacaactcttcttagatccatcgcaaggcaaaccactgctgccccaaactggagaaataaaaagatacagagaatcacagcttcctggatcagaaacccatgagcagaaatctccagaggaaccagtgctgggagaggaacatctgaactgtcattgataaaactgctggaggctcaacacagacaactctaagggttaaaaactgtaggggactcagtcataagggacccccacacttttgtgagttctagctccaggtgatctatcaggttatcacagtgaaatatcagagaaaaattgcctaatgcttccagcagagggagaggaaaaataaccattttgaaatatagcaaagcattctgttcttaacaaggccccacctcaggaaaggctattttaccagagactgctactggagttttatcagagcctaatttatctggaggaagggaaatctgcaactccagccagctctatcctttcacgtgatggaaaggaaataccccgctccagctctctagccatcctgtcccaccaagcagggaaaaataactgagaagcattcactggtcaagggtgcagtccaggaacacaggctcaccaaaaggctgagacctaatggtaaaattgtagaacgcttcccctcctctcacaccttaccattccatcacaaaggcctgtttactgcagtttcttttacccaatatattacatccacttttcaacaaaaatattacaagacatgctaaaaggcaagaaacacagtttgaagagacagaacaagcatcagagccagtcagctatgacaggaatgttgaaattaccagacaagcaattcttttaaactatgattaatatgctaagggctttaatggaaaaagtagacaacatgcaagaacagctggatcctgtaagcaaagaggtggagagtctaagaaaaaaaacaaaaagaaatgctacagatcaaaaacaccataacagaaatgaagaatgcttttgctgaccttatagtagactgggcacagatgagaaaagaatctctgagcttgagtatatgatgatacaaacttccaaaactgaaaaacaaagaggaaaaagactgaaacagaacagaatattcaagaactgtgggacaacttcaaactgtgtaatgggaatatcagaaggaaaagaaagaaataaaagaaaagaagcaatatttgaagcaataataactgagaatttcccccaagttaatatcagacaccaaaccacagatccaggaaactctgagaacaccaaccaagatgaacgcacgaaaaactacacgtagacatattgtatccgaacttcagaaaataaaagataaagacaaaatcttgaaagaagccagaggggaaaaacaccttatctttagaggagcaaagattagaattatatctgactgctcttcagaagtcatccaagcaagaagaaagtagcatgaaatatttaaagtgttaagagaaaaaagccctccaacctaggattctatactctgtgaaagtatcctttaaaaatgaaggagaatttttatcagattttatctgatttttatcaaacaaaaattcaggaaatttgttgctagtagacctaccttgcaagaaatattcaaagaagttcttcagagagaaggaaaatgatatagaagctcagatctatataaagaaagaaggagcatcagagaataaatgaaggtaaaataaaaacttctatttttcttagtcttaattgatccaacaaataacagtatgtttaaaataatagcagcaatatattcagacataggtgagatagatagatagatgacagatagatgatagatttgcttttatacaagtgaaatgagtgacagggatgatgcaagggataagagggactttgggtgactgtgatgtgtccttgtaggttcatcagtggtaataaatgtaccactgtggtgtaggatgtctatagtgaaggagattggagggcagtggtgttagaggggaactctctgtattttgcgctcaattttgctgtcaacctaaaactctctgttactaaattttaaaattatacttttgaaagatgcatgcaaagtgaaatgaagacaaattagatttttttgtatataaacatcagcttaggaaatttgtatggaaactggtgactttccatagctccaaacaagtaacatcacaatttgctcaacagaacgaccttgttctacaaatctatgaatattattaaaataaagagagtaataaacttccatgtcacactatactgcaaaaaaataaaagtttaggtatcatttctatatactttggaattttgttaggaatgtctataactgtcaaaataaattaatacattttgagtagagaaaatctttggtttttaatattaagtttcttggggcatatttagatgtcgaaaatctggaattgaagcagagttccttgtcattcataagtttctgctgtaatttatttgagtgacactgctctttttctcttttccctaaagcaaaaataatgccatgatgttcagtttggctgctcaagctgattgacgctgagtaaattgtctctgaataagatgaaaatgtaaatctttttgaagaaaatagcaatataaaagctcctgtgtttccctttttcttttaaattgcagcttgcagagacactacctaaatcacatttctttcctgcctgtcacaaaagaatccattagcttggtccccacatcagaatcttaatccagcaaagactaactacatgaattgaccactgaacaggaagcctacagctttttataaactcagccaggactctgtcttcatgtcataccagcaaaatattcacccaccccacatcccacaccacagtcgtacatttgctacaattgacgaacctacatgaacactcagaaccacccaaagtccctctcatccctcctatcattcctgtcacgcatttcactagcataaaagcaaatcagaagggaatcacctttccgccatttttttttcaacttagtattaagtttatcaaatagtattaccaccagatggtatctaccagtagtagaaccactgtggtacatcaccaagcatcagcaattatcatttcatgaccaatcttctttcatctgtatcctcacccctttcccatattttttcataacaaatcctcaacatcatattgtttcatccataaacatttcagcattatttccaaaaaataaagactcctttttaaaagacataataatacaattatcaccccttaaagtaattaactataattgcctatcattataaatcttcagttaatgctcaaatttctaaatggctcataaatattacataatgtattttacagttagtttgaatcaagatccaaagaaggttcacacattgtaattggttgatagatctcctaaagtctgttttcatctctgtgtttcctgcccctccccaatttccacccctgcctttatttgttaatgcaaatgtgttttgtcttataaattttcctacagtctgggctttgttgattgtattcacatcacattgtttaatgtgttactctattttctttttcataaaatacgcatttttatttttaaaaagaatgaaaggattgatcaaattcagattttatttttttttttgaaagatcacttcctaggtagttgtgtgctctgtctagaggcacataatgtcccatttttttttctctttttgtgacattagcagcctttgatggtcaattcttagatccattgactcattaggggtttcttcacttatagctgggatagtcctataaaaagctaattccttttaatcaatttttgttaccccgtggtacaatttttataggaaacacagaacaaatgcttagttctttccctttactagctttcaaaatgattatttttgcattagcatccttcatctgtgacccattagaggtgtttttctttttttagcattactatggagtaagggttttaaacatatttgatatgttttagtccattgcaattatcctttttaatgctcaaattgccccatccttgtgatgggaatctcttcaaggaatatcttctgaatccttctgatgtgatcctagtagtctttgatagtgtccttgctatctggtatgacaagatataaatttctgctgcagacctagaagcatccattgcatcaaggaaccctggtttcttctgatgggaaatgatattatttcagcatcacagtctgggcttaagggtgctcgtcgtttgtggtttgttattgtttctaggccatttcaatggacagatctaggaagtgtgtgtgtgtgtgtgtgtgtgtgtgtaaattaaacactttttgagttcaaattcatatttacaatttgaattcaggactacaaggttaattaacctatattttaactggatttcctttctttcatgccaaatttcccattctcaaaacaccagaaaatcctgttatttttagtaaaaagcaacaacaaagggactctctgacacttggtatttcaagagaaatgaaatattcaggtgaaacaggaaaaatggttttcatccatactaattattgccactgattaaatggaaagatgataaattagcttctcattcaaggagaagctaatgcttagaaactaaaatgtactttgtacccctagattaaagattcaatataagtggaggttgctctatggtgaaagagaatagatgagtctatacttgttaagacattcgaaaacacttttccaagttatattagaggctcataggtgtctgtattgagaaaaataaacactttcaatcactcctttgcagccctccataactcaggctctgtgaaaaatgttttgtttctagacctagatacccctggcgtgtttcattcatatgggatgactccggggcatgttcaacccaattgttccaaacccatggaaatctgcaagtgacaaagaaaataagatcccagtagagtaagtcaggtttattttcttgaaagtgccctgtagtatagtttgaagtcaggtagtgtgatgcctccagctttgttcttttggcttaggattgacttggcgatgcgggctcttttttggttccatatgaacttcaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctctttgatttccttgagcagtggtttgtagttctccttgaagaggtccttcacatcccttgtaagttggattcctaggtattttattctgtttgaagcaattgtgaatgggagttcactcatgatttggctctctgtttgtctgttgttggtgtataagaatgcttgtgatttttgtacattgattttgtatcctgagactttgctgaagttgcttagtgggtgaaggacatgaacagacacttctcaaaagaagacatttatgcagccaaaaaacacatgaaaaaatgctcatcatcactggccatcagagaaatgcaaatcaaaaccacaatgagatacccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatgtagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattcttagtaaactatcgcaagaacaaaaaaccaaacaccgaatattctcactcataggtgggaattgaacagtgagatcacatggacacaggaaggggaacatcacactctggggactgttgtggggtggggggaggggggagggatagcattgggagatatatctaatgctggatgacaagttagtgggtgcagcgcaccagcatggcacatgtatacatatgtaactaacctgtacaatgtgcacaggtaccctaaaacttaaagtataataataaaagaaagaaaaacttaaaaaaaaaaaaaaaagaaagaaagtgccctgcactttcagcctgtcccatcagtagacactagagaggccaatccattttaaggctcatcagagctctgaaatgagccaccatataaataaggataaacccagtctcatttctgagagcccttagaacatttccatatctcctcataatcatataagtaactgtcatgcaaagtgaaaatgtgacagtagatcttcaaggaaatgctgtggccacacacaggagagaaacaggatcagagggatgcaagagagctccatgggacaggagcataattttaggggaactcattcattcagttattcaactgcttattgaatgcccacccactcactctgtaccttgatactgtctcacagacccaaatacatctggtttcaaatcctggagcaagcctactacgtttgtggcctttggcaagttactaagcctctgtgccctaatttttccatctgcacaatcaggcactaatgcctgtctcaaagagtttctgaagttaaatagggaaaagaccatataaattgcctagcacagtgcctgtctcacagtagacccaaataaatctggtttcaaatcctggagcaagcccactacgtttgtggcctttggcaagttactaagcctctgtgccctaatttttccaactgcataatcaggcactaatgcctgtctcgaagagtttctggagttaaatagggaaaagaccatataaattgcctagcacagtgcctggcagatacacagcattgcaggaaacttgccttgcctacccaaagagcttcacttttctctgttagaggagagaagaaggagagagagagggaaggtgagagggtagaggacttgagagatgaggatgtaaagggttgttgcagggaaccagaaaataagcaggcagactcaagtgaaataattgtctagaggcactgaaaagccagcacaaaaagttttggtcaatgggtttgtttttaggtatttgaacagggaggtggacagtggaggttttcccagctcacttaattttgcatagataacttggtgaatcagaatttcttaattgacagaaagtctccccattcgtgtttgcaggagagagtgagtggggtgggggtaaggcaggtaaggagaatctgttaaaatgtgagattcacctctgagaataatcatttttcttctccagtgggaagtgagttatcaaatttaagaacaacttctctgaaagaaaattcgcctctgctctttcccacacccttacccttattatttggctttgcaagcatccccacgatataggcttataaatttagtttatctctcccttagcctggtctccctttattataccactttactgcttctttggggctgagactcttaaaatttgggtcaaatgttccattaagttaaccactttagaataccaataacacttctgcagcacttttcatcttcatagtggttcacaaacatctccttcttcactaatgaagatgagtcgaatatcttatagcatctaaaaccaaagctatttaatcattgtctggtgtgggaaagtgagacaaaatgcaagaccaacaaaaaagtatattacatttcaaacttgctgattcaaacttttgaaaaattctttgaatatgcaggcagaacttatgccacaaaaccctagtttttgtaatgaaaatggccataagcataatagcaacattgcaggggtatttttagctcttcatattttatagagtgcttttcagttcattatttcatttgatcttcatgaaaacccatgagaagaaaaggaattattattcacatattttagacaaggcctattgtggttaattcacatcctcaagtttccagttactaaagatttgtgctgagactagaaccccaaacttcacgctccaagtccgaagttctttccatgaggtttcctgcctgtgctgtgcagtaactggagtttccactggggcccctcaaaggacgggggaatggagcaggatgtgtgcgttcccttctctttcaactagagcagctccacaagtatattgcatttggggcttccacatggatttctccagttcagttttattgcacagagcatgcagcatctcttgtactgttcatgatccagctggactgtgagctgcattctgaaattattcaacaggcctgcaaagctccattaatggcaggggcagttgcatactataatttctcccccttgcctgcccacaaccttgcatctttaacaccagctagctgttctgggccagtagagccatccgatggcctttggatgcaccaactcttccttgactttcttttcttctatgtgagggatagcgtgtttcctcttttaccactggacatttttacctttgagggtctctgattcatcacagaggcccagggggttcttccagatcagaaccatcttgccatggcgatgctggtgcctaacacacttgtgcagccagcgctgttgaagacacaaacactcatacactcattctttagcaaattattccattcctaaagagatgctctatgtcttcctttgtcttctttcttctcctttgcactcttcattttccctctcttgtgtctttccatgagcataaaacaatcagaacatagatgacaagcacaatgccaggtactcagtatctgaaaaaattgaagccattacttctgaagggaaattaagcaagataaatatcaagtagcaagtgacgacattttttaaagagccttcaggtacagaatcatcgcaagtcgtcagtcatctataatcactctctttttacaagcatgccttgaaaactcatttctccttttcatccttcaaaattcagctcaaatgtcacttcctgcaaatgttttactgacatctctggacaggctccatcaccccttctgatgtctcctccagaactttgaacacaccttttactgtagcactttacacattatatttattagaattgcttatttatgtgtctgtgtcttacactaaactaagaattggtttttggtttgctttgcttcatcctttttttcaagcagttaatatacagcctagctgagcacattgcggatgtacaattttttattgttgttgatgaatgtgaatttagttaactaaatgatcacccaggattcaagaaaaaacaagctcattcttactcattttaattctatttttggaatagaattgctttctactgttcttcactgaaatttgaagtgtatttttttttttttttgctgtcatatgagttgtatagattttgctgacaatcttaagaatcttaatttataaattgtttctgtggaaaaatacattttaccttctaaaatgttcaagcatacacaaagaaaaaagtggagttttgtccataactagtatatcacattttccaatatctcacatatactatgaaggtgggagggaaaatctcagtactttgcttttcatataaaagcccctctctctctctaattctgtcttccttttccctgatgtctgccttgtccctgcccccggatctttacctcatttagagaattcatctcattctcttcattcttccaaggtttacagtttggttttctgttgtatactttgtggtctaccttgaatctgttattcacctattttcccctgttgaatccagttgttagaggatgagcactatgcacctttcattgttgatttttcacaatggaattttgaagtacaatattgaaatatgggggatattttggttccagataggaatagctcctagttcctcatcatttgccatctgagcacaaagcagacaaggtccaaatttcagccttcacactctcttttctctctttcccatcttgcattcttttctccagagatgaagagaaatgacataatcaggtcaataagacattcgttttcatcttgattgctcttgtctgggtgcttaattatgagatgtcaattattcaacactctaaagagcagtcttctgagcacaaaacgttttagtcgtctggtattaaaaatgcttgttttctgcttttaggctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtgataccaaggttacatggacattcttaacaggaccaacactattttaatttgatccatgtatcccaaattcctttattccggggccctttttttttccagaacagtgcctgacagacagcaggtgcttaatcaacatttgttgcctgtctctatcctttcaatcatattccaaataatttttaagtaaaaaaaattgacacatcctggtgatattgaaggcttcctcatgaagattgatatctgttaagcagaaataccaggcacagggccaggcacagtgactcacgcctgtaatcccagcactttgggaggccgaggcaggcggctcacttgaagtcaggagttccagaccagcctggccaacatggtgaaatcccatctctactaaaaatacaaaaagtagccaggcatggtggcatgcacctgtagtcccagctacttaggaggctgagacaggagaatggctcgaacccgggaggcagaggttgcagtgagccgagactgcgccatagcactccatcctgggtgacacagcgagtctctatatcaaaaaaaaaaaaaaaggaaagaaaagaaatagcatgcgctaatattaatacctggaaggagggcaccatgctgtggttatcactcctgggggaggactctaaacacctaaccagtttctgcgtaagttcctagctctgacaggaggttttgcacaaacttggctgccagagtatgaatctggtgagacagaattcccacacaacaagatgggcaaagtaactttattacaggttgagtactccttttctgaaatgcttggaaccagaagtgctttagatttcagatttgttttttttaatatttgcatcgcacttaccagttgagcatcccaaatctgaaaattcaaactccaaaatgctctaatgagcatttcctttgagcatcttgtcaccgctcaaaaagttttgcattttggagcattttggagtttggatttttggatttgggatgctcaacttgtattcacagataggcagcaagaagcaaccgaagtctaggatccatggtgagccattcccccaaggctcaggaaagcacccccaggaagatggaatcttgtctgcacatgccccactttgcatgacagctgagggctccccaaagcgcttctctcggggttttatatcccaggtgccacctgaatcactgagcaaaagtattacaagacatcctattctaggagggataaggacagttcctccttatctcaggacgttgcactcttggtacactctgcctgagaattgccaagaaaaagaggaagagctgggtcagcaagggtcatctggggacctgtcctcctgcaatattgaggccccagtcaatattgttcatacactaagtgaaggaggtagacactcagagggtgttaaatggtataatttcatattgtttgtaaaccaacaaataaagtttttattattgaatgatacaatattactaataaggatagcttttgcagcttgccagacatgtgaagatcaaacaaattgatgcatacggttgatttgtatgtgtatatatgtgtgtgtgtatgtatgtgtgtgtatatataagtgaagacatttctatttttaaaatcagctttagatcctacatttaaattagttcctacaatcttgtcagaaacacattttttgaaatatgatttttaaaaatgtttggtggttttgtcttggtttattttacaaataggggttcactaaatcttggggaaaagttccccagcatctctgcacaggcagagcagaatgaagacagactctatctctggaactgttgtagcttgtagatggcatgaagcagctgtgaatgtgctcgatttaaattgtacacatgtataatcctacattacattcatagaataataggcccaaaagtggcctcgcccattaataagttaaaccttagagatgagtaaactggggcctgtgaaatgtagtgatttgcccaagatcacgattatttattgacagagttggaataaatgcctggtttaggacttctggtctggtgccttttctactatatatcaccctgatatgtcaacaaatgcatggtgtgtgtgataggcatggtggtaggatttatgagcttatagtgattcgggaagaggttcccagaggaggcaagttttgacatataatttaaaagatggaaaggttgtgctgtggtccacaggacttggaaagctattcattctggtctcagcaagtaagagcctggtgagggctggccacagggtgtacctgtctggcatcagaggctcaggcttagtgccaggcagttaaaaataagaagggtaagaggactgggattgcaagctctgggtcttcagtccctttccccaatcttaaataaagccaacagaagaccttccattcatctggcttcttcctgccaccatgaagacagctgagaagcagcagagattttaggcacagctgaaccactgcactgccagttcaactaagattcaaagactctagaaatagagctaccctaggtcccaggtctaatttctcatttcttgccctgggtcagccagagtaatgatcaatctgctaattctaatctgtcagaaggcaatctggtgggatggaagtttatggactctggaagcaaggtattgtaggtctaattctagctctgccagtttatagctgtgtgacctaaaattcttaacctctcttggcctgactttatttatctcttgacaaatatttactgagggacaagtacatgccagtcacagaagatttagggtgaaaaaaaattcctcaaaaagctcatttataaaactgagtttattatattctcctcagaaatttgttatgaggataaaaggaactaatagttttatgatgactaggcacattctaattcagtaaatattacttcctcccactagatcaagctctttataaataataatgatgattatgttaatattactgttactttcttgaacagagtttaacaacctgactttatctataacaatgttaatttattttcttttactatacaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggtaaatacttgttaattatgaaaaattacagtcaaatattctatctcccagtaatggcttctgagggtgagtatcccaagtagttgtttaaaattcccatatttgtattatgcccaaagccaagaaaaataaatatacatatagttttatgtttatcttgtaccaggttctcatttcataaaacaaagaacaaagtgacaattgtttagatatttgaaatcttttctttgtgcctcaagtcagaactgtagagctttcctgccaaactcaggaattatctaccccaatggttttcaaagtgttgtggaaggatcccaagaatcctggaaccccaggagtatgagagggccacgtaggcagagctcctagttccttccacgcctcaccagagcggctctgaccagctccaccgctaattattttgtatataattggagcctatgtaagattttgtttggaaaaaaaaaaaaaaagagtcccagtaattttttttttaattccaacccaacctcctaagttttcatttgaggaaacaagctttcccttatctgtatccatcttgcaagtttacagaaccttgaattcagtggagttagaaactcaagcttaaattgtaagaactctaaaccgtcttgtgctacctcccaccacataccgtggtcatctgctgtctgcataattccttccagtttcagaatgcttcttatttgggagaaagcccattccattgcagaagcctggtttcaaagagtagttttctaataagccagaaatctgcctcccctcagtttgagctagagcaaatacagatcaaatctactctattttcaaatatttgaagacagtcatcttgtctccttcctgtgagccccccacccccgagtttggcctctcactttggaatgttcttgtcagtcagcctgcattgtgagagtatcttctgtggaaggggcacagttacatgcatagctggttggataattcaatagacatgacaaacaagatcctgcctctgaggatgttgtgatcatcacacctccatgactctgtatatttatttaatgaaaacaaccataataataggtactctgcttcaagctctggaaatctagagtctcaatgaaacactggcctgaatcccagagaaaaatcctgtactattttttcaggaaaattctggcctttcccacaagtttccttgtaggacattcccataaaaagattaacatgcaacatctatcagattattcatcttccacatctacagcaatgaccttaaagctgggagtttttgacatctctccatgtgagtcttgtgcagcattctgcaggggaggaaggagattttatggtcaaatatgtttgcaaaacaatgtacaatcttggagatttgccatgtacattagcatcgtaaagggttctagaaggaagcactttctttgaccacaattcccttttttaagaacacttattgacatcccacagaactgctagtccctacgggaaatgctgacatgaggccatgactcaggaacctggctgctcatcacacttggtcgggacaccttttaatacagagctttctggcctcacaccagagctgctgagtcagactctctgagtctgaagaaaagtttaagaagctttctggctaattggattatcagccaggtgtgaggccgcaaatccaagggataggtgatagtctccattgttcaaagttacattttgcttcattactttagcttcctttaaaacatatttgcatattctgtccttgcattttagtgaggtttgccatatgacaaccacacacacactgcttcccagtttgctttaagatcaaatgtcactgtcatttctgtttatgtaagttctcatgcttgaaatgtctagcagaatttagtcccaagctaaatcatggatcttcaatatctgatcacaaaagtcatataatatgagccaggcacagtgggtcacagcactttgggacaccaaggtgggaggaacacttaaggccaggaattcaagatcagcctaggcagcgtagtgagactcagtttctacaaaaaaatttttcaaaattagctgggtgtggtggccacacctgtagtcccagcaaaacctagttcaaagttacagtgaggtatgattgtgccactgcactccagcctgggcaacagagcgagaaccgtctttaaataaaatatttaaaaattcttgactgggtgcagtgacccacacctgtaatcccagcactttgagaggccaaggcagattgcttgagcccaggagttagagaacagcctgggcaacatggtgaaaccccatctctaccaaaaagtacaaaaaaattagccaggtgtagtggcacacatctgtagtcccagctactcaggagactgaggtgggagtatcaattgagcctgggaagaggaggttgcagtgagccaagattgtgtgctactatactccaacctgggcgacagtgtgaccctgtctcaaaaaaaaaattatcaataactgtgtatgtttcagtttattcccagactaccagagaattcagtcaaatctgatgcttaattatagcaaacataccagatctcatagttagcaggtatagcaggtatgctgcttttccttcctatggcactgcttttctatttctattttattaatcagacacacacacacacacacacacacacacgtatgcacatacatgtgtgtttattaaatattgtacaatttcaggaaactgatgaagagaaagtaaataccatttcatcttccaggagccagtatatagcaggaaagacatagaactctgaattcagtgaggaaagaaaaaggtcacaacaccaggagagtgacatggattttcagcctatgccatcgagattaatgtgcttggcttaaactgaaggtggccattctcaccttctcccagccttaaatgaaagttagtatcatcatgacaatgtccaaccgggcatcagtgatctcttggatttctaagctgaatttgaatttaatttgtgtcatccaggcagagtagctgacatatctgagaaggaattccttgcttctctgcacaaaggaaaataaagtatctgtcctgacatctgaatattttaaatctttgattcttcaaaattattctcagaaaattatcttagtgagatggttcattgcacaggtaggctttattactcgatttattgagtattctgtggacacatttgtactctgcctcatagaagggaaggtgattctctgtggagcttctcaccaagtataaaccaatggtgacaactgaagttaatgaaccatggctcagggtgactggctttagaattatttgtgttgatatctgaaaaaaacccaaaacctactgtgtaccttttattcagtgaagatgatggtggttgactttcagagaatacatgaatgtttaacaaaagaacaacaaatcaaagcatagtaaagtagaataaatagtatagtgaagtagcaaacacacagtaaagtagtgaaaggtcctcttggctagagatgttccaaagtttcttaccaattttcttttcatgtgttcttgtcctgactgaaaggctttgctattcctgatgagaaactcatgttctcaataaaagctgacttttacccacctgtatatcacctgtgagcaaaccacacaaaccaagagtaatagaatgtgaggcttattcttctctcagttcatgtcacagcacagggttttgcacatttaaaatgttcaatgcttgttgacttgatcaatcctgccagtagcatcagctgtttcctgcatacataaatattttaaaatattttttcttttattattattatactttaagttttagggtacatgtgcacaatatgcaggttagttacatgtgtatacatgtgccatgctggtattttttgaacctttcacataatgctgtaaatttgatgggaaaggcaaagcttttgtttcttctctttacaggacagaagaaaggcagttctggattggatttaataaaagaaacccactgaatgccggctcatgggagtggtctgatagaactcctgtaagtcttttcaaactggagaaaagggatggattcaaaacaagtgggcctgggaccacttggtaaaccaaccaagagaacctagaaatgatggccagagctcccatgacaaaactgcaccagaccttagtaccaggagaattatttggcaaggtcctgagaaatctttgctagccatattgttctgaggccattgtacaatttcagcctgaaaaagtatcaaaaacctccaaaaagtccccccaaaccatctcccatatgaagtctctctggcagagaagcagctattctttaaaataacacaagactccctttaccctatacctccctatcctgcatatcacctgattatctgagtatgggaaccttgtccatgtcataatgaaatgaagattattttggagaatgatttttcatttatctcactctgaaaggacagtaatgcaagttttagaaatatcaccttctagagcaagttattccagaaggaaaaaaaaagtcttggttttcattcattcccatacttgcaaacctctatgaaggacacagagaactcactattgtatttttttccagttgcaatgggtaattctcacatttttctcaaaatgacagggaaaaaactgaagtagtatcctagattgaagtgggatccatcctacggcacatgaaaaatcacattattcactttcacctgtgaaatggggagactcctaagagcctgcagtgagaatttaatgcaactgctgtttattgagtccttatactgttccaagcgctgagctgaatgcactcctacatgatctcatttcatccttacaataactcagtgccatgggtattagaatgattaagtggcttgcctaaaatatataggagagccaggatttgcacacaggttgtctgactccaaagtcacaatgttataatatctcatgattagcaaaatatcagtagccaaactttgaagtagtaaagaacaatagagaaagccccgtaccaagatggttttcaaatttatgtcaaggaagaggtttatagaagagagtaggaagagattttaaaggtcattcagccccactaatccatttttctgataaagaaaccaaggctcagaaaacagaaaaggcatagcagggtcaacttactccataaatggcagccactacatgagacagctgggtggttcaagtcaatgtagcactcgaaaaagaaatgtgacacatagaagttgagaacactttcttttgttttagtataacaaactcattagtaataggagaggaacagacaatctgggtcagaataaattagataaggccatgaagcagtggccgagcttctcactaatatctgctggacaaaatgaattcaaatcacaccattttctgaacctgaggctatatatattttagatagatgaattattacgtgacagtgtacatgtttgaggaggaatataaaggattttaaaacatcctttttttccccaaatttttaccccaattttacttgtggtacatccattcttctgtgagatagtcattaaataattgagaaggttgattctttaatacccccgtaatgtgaattatatgagttatgtggtcactcatggaaagtgacctgatagattcctgattaaagctagctatagcttagaatttagttattagagacaaaaaacttagcatatgttcaaagtaatcaaaatcaaagttaataccaagatctggcacacccttgagtccctaagtttacccaggattccaaggctagaaaattttcccagttagaaaaatgtgcaaattcagaccaaagcttgcatttgatttgttccttctggagaaaggaatagcatacctttttttaatttttattttatttatttattttttttgagacggagtcttgctctgtcacccaggctggagtgcagtggtgggatttcggctcactgcaagctctgcttcctgggtccacgccattctcccgagtagctgggactacaggtgcccaccaccacaaccagctaattttttgtttttgtatttttagtagagatggggtttcaccgtgttagccaggatggtctcaatctcctgagcttgtgatctgcccaccttggcctcccaaagtgctgggattacaggcatgagccaccgtgcctggccttttgttttcttgtttttgtttttgttttttaaaaaggcatctttaagaaaaaaatgctaaatattgattagcttgttcttcacaaatgtgaaacaaccttcaactagaatgacatccagacatttctgaagcttcctggagtagcctataatgcttatgtacagggatgccctttttgatcttttgaaactttgtggggggatcatcattaaggaataatgaacttcatctgctgcaggttgtctcttcgtttttagacaacacttattttggagaagatgcaagaaactgtgctgtttataaggcaaacaaaacattgctgcccttacactgtggttccaaacgtgaatggatatgcaaaatcccaagaggtaaaaatagtagtaagatctttgctatatgtttgatttctaataatctctagtactttcccaatttaaacaccccaaaccacaatatcaacaaattgcatgataaaataaattacactactttagcaaaaaatgtttctataggaaatgggaaaaggcgacaccaatgcaggatgccaagttagttcattgggaactaaggtaaccagctaatattgcagaatatttatagtgcaagtatagtcggggaaaaatgtcactttgacattacagagcaaatggaattacttgcacaatgagtaagtggaaacacctgggacagtgtgtggcacacagtggcctcagcaagtgctcatgtccttccttctttaattagaagcctctctggagcttcctcttcaagtgtgagaactcaccatatattccaaacagcacaatgtacctgttttaaagtgatgttttaaaagatgaaggacaaaatagtgtgtttagagctgaagtaattcacagacaatgcacttgagaagcaagatcagtcaaagtgatttgctttcactttgcagatgtgaaacccaagattccgttctggtaccagtacggtaagaacgactctggcagctcttgaatttctaattattaatatataccatataagtgctattatataccattaatgtgttgttacatttctcaaatcgagcctctcttttcttgtgtcaacctagagctaatttgttcaaattaataattaataaatgtagtcatttaatatgattaaggactagtatcatcaatcattttcatgacatgcgattttagaatatgtacctatccccgaccttttaatactagtgaaggtatcttgtaagagatagaccaaagaaaaaaagcaagttatatatctatttatgtgcatatgtgtctgtgtgtgtgtgttcaaattcctgtgtgtgtgtatacaattatttttaatgttgagtgaccaaatctcaaatttggggtcaatcctagcatacctatttatcatttcagcattattttcactgtttctttttcagatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcggtacttgaacataactcaccacgaaaaattcagagtttagcaccttcttttgcccttgggagggagggagggatagttttttcgatttgacttcggatatttatttaaacttcagtaaaagccatagatttcagtaaagccatagatttttgagaatttttttcctattatagagattaagagaaaataatggaggtacaggtttactgtattgctcagtcatttcccttctcttcattctttgttagcaacaatggtgagcacgtcgagattgtttcatgaggttcattcgatcatttaatcactggtagaactggggttttaccagtgattaaaaaagacccaaattcctatcttcatggagtttatattctcgtctgggaagaaagaccataatcaattcgagtaaatagaattatataatatattagaaaaaataagtggataaatgccacagaggaaaattaagctcaaatgagggatgaggaatacctgggggggtgcctggcagttttaaactttcaaatcttacaagagtacattatttttaagtttgtaaagactaatatacagaaaatagtaaggagtagttttctatttcaacttaaagtagagaaaggctacttaattccttgcagaactaagctagtaagaaagaaacatgtaagacctattaaataataaactggcaaagaatagtgtactttttcagtgtgttccttcaataagcattcattatcaagtatgtgccaggcactgggatatttgtcaaagatgcaaaaatgtatgagatacagtctctgtttttaaaaaggctagatatatatactttaaaacatcatgttgtatacaataaatacatacaattttatttttcaatttttaaaacataaatttaaaaactaaagctggaagtgatatgatgtagtaaatagaaagggcacagaaagtgcaaattacaatgggggcatgaaggcgggaaatcctcactcccctttcccttggaagctttgaaagcaagaaaaagccattttcttttcctgtaatttaatcatatttcatgatcttcaggaatcctttctaactctatcatctttttatatctctgtaagttgactataaaatgaagccctgtattaaagcatcctaggcttgagaaagaaatgtctttcctcacagttcatggggatttactgtctctatatcttgtctgttgcacatacagcccatgaggtacaagcaggtcaggactcctgctacattctgatgaagaagccgagaaaaagagaagttagatgacaatcacatggtcccacagacactcagttgcagaacaaccactagatgtggaattttccccatcataaatttgtacactattttgtcacccttccactcttacgaatggaacactcaagccaaaaccataatgttcaatatgagcatgttcaattctataccatgatgtcggaaaatacacatttctttagccagacaccatactcctcacctcagagggcaataacaagagaccagatgaatggctgaaaactaatccatacgcatgcaaagtatacaacccaaaaagagctgatatttggctatacttaccataactgtttcaggtactatgataagtactaaaatgtaatcttcccaagaaccccctgtgggaagtctattattagtacatttttacaggtgagtaggctaagacttcaaagaggttaagcaacttggttacacagcagctaagtggtggaatttggaaagaaacccaggccatcttatttatccagtcatttaaaaaccctacacggtgctgcctgtgacagtggaacagcagtgtcagggcatgtaagagcacaacgtcttcattacatcaaaagctagttccaaaatcctccccaaaacatggctgccagcttcgtctcagacatgaacaatgaagggcttctttgatctttccaacagagcttagctctgctgggaacttctgtagatcttctgtcttcacctttcctcttaattcatctcctaatctttggaagttgggaagccaatggggatggcgtagataatgcctcccatggaagggaagggcgaaaccccacaggctgagcagtttgagtcatcatagccactgccatgatctagttgaggattctgacctcaaatcagacaaactttatggtgccttatatggcaaaattgtcacctggcctatgaccacgttgatgtagaatgccccatcagtttcatgggtaaggtgctaactaatctccccactgtgctgcaaaagaaagttatgggaaggtataggatttgaatactgagaacagggccaggggactgtcctagtcttttcaggctgctataaaaaaacactatagactacgcagcttacaaacaacagaaaattattgctcacagtcctggaggctggaaactcaagatctaggcattggcagatttgatgtctggtgaatgcccacttcctggttcatatgtatccttacatagtggaagaggcaaaggagctctccaaggtccccttttaagggcactaatcccattcatgagacacccccaccccccaccctcatgaccttatcatctgccatctgccttgtaatatatcaccttgagagttaggatttcaacaatgtaaattttagggggacacaaacatttagtctgtagtggggtccaaggggaaaggatatcaaattagaaagaagaaagctgttgctttccaaaaaattcttatttctgcataatttgtgcctaccttgggcacttattgttggtggtggtgatagtggtgttcacattttgtaagaaagaaaccccacacctaagaacgtcctgctggaatgggtcaatccagaagttacttcattccaggatgaggagcaagatgtgtagaggtgattccactcacttctgtctcacatttatcttataaatgtaggaagagtacaaataagtaattaaatatttttaaaattacgtatgtgctttgtgtagcttccctaagaagagcagtgattagaattgtgaaaaacaaaaatagcagttagttgcagtgtcaaaaaaattaattatgaacaagcaagctagatacagtttaaaaatctgaagcaaataaaaattttaataaaatgtttccatcttggaaaaagaatgtcaatattttctctcccactctttgagtaacagaagaccataaagcatgattagagtgaatttattttttgagccatcttgataatcacattaatgctgaaaaaacgctgcaagcactttaggagttgtttgacacaaactactagctaattagtctgcttatctgacatttttacactgttatgcagtattgtcattttgaaatggcaatttaccattattattaaatttttatttctaaatgcttctcaaaatacatatcaaatctattagtcctcctccaaaatatcatttgtcatccttgatgggaacattttaaaagatgacaggttgttcttccttatattgctttatggattaatgtagtgactgtcactgtggggttttgtttgtttttggtaaatgctgtttccatatgatgctaactataatggctgtttgtaaataccaaaacatagttgatgttataaaatgcatgttcatatgacattttttaagccctgagcttacttctctatcacatttctttatgcaaacacatgttaataagtcttctattgttgtggccttcttaagctaaaatttcaaacatccattttcacattggatgttccattctgggtatcttctagcatctcctatgaagttcagttctgtgccatatcacaacaggttgtgatgtgccatgtggaggttaccacgccataattgaggtggtaataaatatgccacttaggatgcagcagttataatttctctttagaggtccttaattggggcagtgaacaatccaggccatgatttccagtcccgtggcacatgaaacctctttagattgaatgaaattgttgtggttcccccactgagttaacagccagtctcagtggacccattccaacgtctgacaatgggaatctgaattcagcctgtaagaacatgtccacgaaacaacacctcagggatacaaaattacagttgttccatcttgcattattctcaaattgctgatatgacaaatagccatgctgtttacagaataaaaatacctgtttataaattagattgttagagggctattgggttctgttgtatggagagctgaaattcctatggaaaaataatgtatcttaaaatttcttctgaagtctttacagaagaaacgagagtacaaatttaaatatataatgccttcaaattaacaggattttagcatataaaaattaacttacagttcagcacacaacacacacacacacacccccattaagtatactgatttacaggtcttagaaaaacccttacttcctcttcctcttttatagttaaagagggaatttcaatttcctgggtcataagtcagtacatctgccctaatgtgtgtgtgtgtgtatgtgtgtgtgtgtgcacgcacacacgtgtgcacatgcatgcacatagtgctttaattttatactttattgtacttaggtccaagtgattaatagtggtataaaattagtaaaatgtaaaaggataattttctttttgttgttgttgttcaagtcttctatttccttactaatttttactacctttattctgaacactacaacattactaatacaatcttagattaagtggtttttttattggtgataactatatcactctgttaacatagaatttataatctactaaaattccaattttttgttatacagtttaattttatattaaaaagtacatattttgaaatgtgtccatgttgacacatataaatctggttcctttttttattattatactttaagttctgggatacatgtgcagaacatgcaggtttgttacataggtatacatatgccatggtagtttgctgtacccatcaacctgtcatctacgttaggtatttcccctaatgctatccctcccccagccccccaccccccgacaggccccagtgtgtgatgttcccctccctgtgtccatgtgttctcattgttcagctcccacttatgagtgagaacatgcggtgtttggttttctgttcatgtgttagtttgctgagattgatggtttccagcttcatccatgtccctgcaaaggacatgaactcatcaaaaggataattttctagttgtcaaacactgggcactctgtagtattcttttgtcctatattgtgtctctctatttgaatgggaaggaaagcttatactgcttaaagcttagcaatcagactaatacctaaaatcagtatctttatactaatgatgccttgataccttgaattgtttttcaaatacatgtgacatatgcaatgaattataaatcactgagagggtaaataactgagaggatgagccaataattttttgtcagaaaatgaattcattttctaatattactttttaaaaccttcttagagagttagaaacattacttttcaagttgtatgaaactaaaattattttccatgtttgattccagtttttcttcgtaatggggggaatattttaggataatgaagtttcaggttttctcaagatgctaggccttagtgtattcttccttagataattgggtaaaatactgaagaatagaaagctattagcagcaaccccattactcttaatagtgaaaaaggaaaacaagtagaataaatgctgactttttttctttcaatagctatcaaagtatggtgcaagttggtggattggacttcaagaagaaagagccaatgatgaatttcggtatgaacctagattcatttgcatttaattttgtttgacaggttttatttgcagaatgattagattcaattttagtgatcaatttgttgaatacccttcaaacattaacttataaattttcacttctctaaccaaagacatgagtgttttttaaagaatatgcttatgaaaccatcccgacaatctagccataaacatatccatcacctccaaaagctttctttcctgctctattcatttatttatttattcactaattcattcatttttgtgatgagaactcttaacataaaatctaccctcttagctgggcgcggtggttcacacctgtaatcccagtactttgggaggccaaggagggcggatcgcctgaggtcaggagttcaagaccagcctggccaacatggagaaactctctctctactaaaaatacaaaaattagctgggcgtggtggtgcgcacctgtagacccagctacttgggggggctaaggtaggagaatcacttgaacccgtgaggcagaggctgccgtgagccgagatcgtgccactgtactcagcctgggtgacagagagagactccatctcaaaaaaaatctaccaccttagaaaaattttaagtatatgatacaatattgttaactataggtactatgctacatatgagtatattttttaaatttaatagaatattatatcttcaatccctacctcagaactctaagaatgatgttggagactggacatgcagaatgagagaagaccttaacatttttaatcttcccacagctggagagatggaacaccagtgatataccagaactgggacacaggaagagaaagaactgtgaataatcagagccagagatgtggctttatttcttctataacaggttattttacttacccatttttgggtttataatacaaactgataattttcaggaggcttaaagtcttttccttgcatcatttccatgagaagtttctgtttatttctcttttcagttgacgtgttcagttttgtctgccataaggcttaaggatggccatttttttctgttcaatccatgcattcatgttcttggaaataatttacatctgaataagtccttcctcataaatcaagacagcaccagaaatgggcccaatgaaactttaaagaaatatatgcctgacaaatacttttttctatggtatttcaatggaagcactttttaaaaaaatctattcctatatccaatttataatgggccagaactttaacctctgtgaaatttacttccattttcctatttaataaatgttttgattcaagtcagtattcttttttcttttactacctgtcatcaattgctgcttgctttagaatggcaactgtttgcaagttggatttagaagcacatttaggttgaagattggttttttaaattctcctcatcagtgcagtgtagttaggttgattgtccactcattcctcttctttctaaccaataaaagataatgatacccattactctaacagattcataactaacctgtgccccaggccaggagagggataaacacagaaaataattttgggtgtgagggcctctgcagagagttaggaaaggaaaatccgtgtggttaatcagcctgcttttaccagcaggtgtcacaacagcctacagaaaggactgttttgagcgtctgggagaatagcagctaatctgcattgaaaatagcattccagcccttccttcaaaatgccaacatcttttgggctcatattcctgatctagaaaactgagcctgcccttgcaattggcatgcattctgccctgttctggaatttatgacttggatgccaataaaatgcattctataatccttattctgaaaatatagctcttctaaattaaaaaaaaaaaaaagcagttagtttgtcggaggctaaggatttgaggatatttcttactgaagacatgtctatatgtgagtctggtttacttaaggatcagtattaaatgctgttttcttggaagttcttgagttaatttttctaaattattatattttctaaagaattataaagtagaaattatctactgttttagaatctttttcctctctgtacattgaaattgaacattttaaaatgaaattgttaccctacaaagtattcttttgctacacaagtcaaatattcttaagattttaatcagttctatgattcaaattgcagtatttatttagatttttttaatttgcaaaatttttacattcttaaattaaaattactgagttggccttgcccagttagctgttgtccctagagaaatctaagatcagtagtttagttcagtttctagattttaaaaaataaattatgaaaaaccatagcctcataaaaatagtgatcaatagagaatgccttcaaagaatcgccattgttcctaagccatttctaacccattttctcctccaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataaggtaagcttgtttttcaaaagttgcctttgtttctcttttgtagacactaattttggaaagtgttcaaaaagtgaaagtggcttttgaaagctgtgagttgtccataggacctggaatttttttgtcacaactttcaagaaatttgagttttccatttagtaacaaatcttttggaacaaaagatttttgtcaaaaacagcctggacactgcccctcgtttctatactcagttttactgttggcatagtcatttattgtgctgtatgaatgtttcattaggtgtaacatatgtatgtatatgtatgtatgcatgtgtgtgtgcatatgcatgtgtgtgtgtgctcatgtgcgtgcgtgtgtgtgcacgtgtatgtatgtgcctgcatgcctgtgtgtctaggttctgctcccaaataagctgtaaatttcagaggacccagactccatctcctactcttgtgttttccctgcctggagccggcatagagctctgcccactagtgaattgagggactaataacttagcttggtcaatgtcatcttaagcctcataaagctggtgcttccatgcagatttgaattaagaaaaaaaaaattgccagtggggatattttaaaccagatttattatttctgatgctgccttcaattaaggcctagtctccctccactcttcatattttataataaaataactttataggccttaggtggaagtaattaaaatgcatcccaaattataattgtttaactcttagaaaattaaaaaacccaaactgtgtcatcatttcatatgctaatatgaaattcctcttcaattgtggacagccaatttttaatctaagtgttcagttatattggcagggctttctctcctttgtgatcttcctcccattgttaatttgagaaatgaggccacttggatttttcacacattcattgagtacccaccagacatttggcactgacttttaaatttttttaatatctggtaaatacacacaatatagaattcaccattctagccatttttgtctactgtttactagtgttaagtatcacatactcacactgtcattcaacaaatctccagaccttttccatcttgcaaaactgaaactgtacccattaaacgactccctgttcttcctactctgaaccccttggcaactgctgttctactttctgtgtctttgaaattgactaatttagatacctcatgtaagtggaatcagacagtatttgcctttttgtgactggcttatttcagttagcataatgtcctcaaggttcacccacactggcatgcgacaggacttccttttgacggttggacaatattccattgtatggatatactacattttgtttatccagtcatccattggtggacatttgagttacgtccccccttagctaattgattgtatgtttatttcttatatcactgaattttaaaaatatatagaattactatcctcattttacatatgagaagacagatgctaacaaaattgtgtgacttttctgaaacttcacagtgaatacgcatcaggccaagacgcactttttgttttctgaccctgagtctggtggtcttgcccctttcctatgcctgccacttcacgttggcacttaaggactgccactccagaaatgcaaattaaaacaacaatgagtgatttgccactgcacagctactagaacggcccaaatccagagcactgacaacactacatgctggcaaggaggccgaacaacaggagctctcattcactcctggtgggaatgcagaatggtacggccactgtgggagacagtttggcagtttcttacaaaactaaacatacttttaccatttgatccagcaatcacactccttggtatttacccaaaggagttgaaaacttatgtatatgtaaaaacctgtccatgaatatttataacatctttattcttaattgccaaaacttggaagcaatcaagatgtccctagtaggtgaataaataaactggtacaaccacacaatggaatattactcagtgctaaaaagaaattagctatcaagcctttaaaacacatggaggaaacttaaattcatattactaagtgaaagaagccaatctgaaaagcctacaatactgtatgattccaactatatgacattctggaaaagacaaaactagagagacagtaaaaagatcagtggttgccaggtgttgcagggagggaaggatgaagttgtggaagattcttagggcagtgaaaattctctgtatgatagcacaatggtggatgcatgtcactagacatttgtacaaactcatagaatgtacaacacaaagagtgaaccctaatgtaaactatggactttgggtggttatgatgtgttaatgcaggttcatcgattgtaacagatgtaccattctggggtgatggggcatgtgataatgcgggaggctgtgtatgtgtggatcaggtgggaaatctctgtaccttcctggttttttttgagatggactctcagtctgtcactcaggctgaagtgcagtgacatgatctcccctcactgcaacctttatctcccaggttcaagtgattctcttgcctcagcctcccaggtagctggggttacaggtgcctgccaccacgcctgactaatttttgtatttttagtagaaacggggtttcatcatgccaggctggtctcaaactcctgacctcaggtgatccgcccgccttggtctcccaaagttgtaccttcctcttaactttgctgtgaacctaaaactgctctttaaaaaatgaagtatttaataatttttttttaaaaaaaagggttgccatgtcagcttagccctatgacacagtgagctcagtggcaccatgagatattttctagaatagtataatttactctaaaactttactatagtaatgaggtacactattttttaatcattgatactttctgtatacttcctattttctcaaactataaaatctttctaccaggtataaattattttcacattttagtatgagaaacttgtagctaatattcaataagacactgagtgttactaagtcttttattaaaacctttggcaattagttttttaaagcatctttatggtcctaaataatgtaacataacatttgccattttaaccattattgagtgtacaattcaatggcattaattacatgcacaatgttatacaaccatcatctctatttccaaaacattctcactatcccaaacagaaactctgtaaccattaagcactaacttcctgttccccatcccctggtaacctctaatctattctctatccctgtgaatgtgcctattctagatatttcatattagcgaactcatacaatatttgtccttgtgtctggcctattcgcatgatgttttcaaggttcatttgtgctttagcatataacaaaattgccttccttcttgtggctgaataatattcctgtgtggcacgggcgtgtgtgtgtgtgtgaatattgcatattttgtttattcattcatctgttgatgcgcacttgggttgttttcaccttttgactattgtgaataatgcttcaatgagcattggtgtgtaagtctctgtttgagtccctgttttcaattcttttgaatgtatacctacgaatagaattgctgggtcatatggtaactcagtagttagctttttgaggaactgacaaatgttcttccacagcgaccaaaccattttacaatcctgctagccgtgtgtgagggtttcaatttctccacatctttgccaactctggctattatatagccatcctagaacacgttaggtgttatttcattgtgatttcgatttgcatttctctattatctgatgaagttgagcatcgtttcatgtgcttgttagccatttgtttatcttctttggaaaaatgtctattaaagtcctttgtccatttttaaattggatcatttgcctttttattgttgagttataggaattccttatatattctaaatattaaaccccatccaatatgtgatttataaatattttcagtcattctgtaggttgtcttttaactttcttgataatgtcctttgatgcacaaaagtttttaattttgatgaaacccagttatctactttttcttccgtcacttgtgcttttggtatcatacttaagaattcactgccaaatccaaggtaatgaagatttgcccctgtgtgttcgtctaagagcttcatggttttagcatttatatttaggttgttgatacattttgaattcactccagtatgtgacaattagtttttcacaactgttagaacaagtttatcctggcatggtctctagggaacaggcataaaggaatgcctagctaatctccaaatcacatttctggtacagatagtgaacaacccaaaagcatgaacacaactgtcctagttactaactcatgcctcctctcatgtgtaaaagaggatttttttatatactttaagttctggggtacatgtgtagaacatgcaattttgttacatagatatacacgtgccatggtggtttgctgcacccatcaacccgtcacctacattaggtattgctcctaatgttatccctcccctaggcccccagtccccaacaggccctggtgtgtgatgttcccctccctatgtccatgtgttctcattgttagctcccacttatgagtgagaacatgtggtgtttggttttctgttcctgtgttagtttgctgagaatgatggtttccagcttcatccatgtccctgcaaaggacatgaactcatccttttttatggctgcatagtattccatggtgtttatgtgccacattttctttatccagtctatcattgatggacatttgggttggttccaagtctttgctattgtgaatagtgctgcaataaacaaacatgtgcatgtgtctttatagcagcatgatttataatcctttgggtatatacccagtaatgggattgctgggtcaaatggtatttctagttctagatccttggggaatcaccacactgtgttccacaatggtttaactaatttacactcccaccaacagtgtaaaagtgttcatatttctccacatactctccagcatctgttgtttcctgactttttaatgatcgccattctaactggcctgatgtggtatctcattgtgggtttgatttgcatttctctaatgacaagtgatgatgagtattttttcatatttctgttgactgcataatgtcttcttttgagaagtgtctgttcatctccttggcccactttttgatggggttgtttgtttttttcttgtaaatttgtttaagttctttgtagattctggatattagacctttgtcagatggatagattgcaaaaattttctcccattctgtaggttgcctgtttattctgatgatagtttcttttgctgtgcagaagctctttaatttaattagatcccatttgtctattttggcttttgttgccattgcttttggtgttttaggcatgaagtctttgctcatgcctatgtcctgaatggtattgcccaggttttcttctaggattaaaagaggatattttaaggaaattaatgacaagtcaaatccttagcatttgataaataattcttagaaacctggaatagttgtttctggttcagccttttgctattatccttcccccaaacttgatttttacccacacagttcacctccatcccatgtgtcctcctgtacacacgtagagagtgtgtatctatgggaatggtggcagtgatggtggagcagacccagggcaaaagagcaagtgaatgcttcccatgaaaggaatagagaggggaataaatatgtgcatgagaatggcggggaggggaggcgccttctgaagctagccctggggcatgattaaaacaccctcatgtagctcagagttataaaaaaaaattattgataactaacagctagatcagtagttttcagccctggtcaaatatttagaatcagcaggtgagctttttaaaaacatcaaagtgcaggagacgtcctgaagattctgatttagctgatctgcatgggatccaggcatccgtatttttttaaagctccctcagttattctaatgtgtggccaatatttacccagcaattcaacagtcatagttccacaactctttcttcaaggcattaggagcatttgattacaaaggatatcatcacagcaggcttcataagtaggtggcaattcacctggcacaatgtcagagtcaccatgcatgtctccccacccacagtgccttctcctgcgcattaatgcctaaaattccaccactggagtttctctcctttgtctcaacactttcctttatttttaaaagggaaatatttttgagattgcctcatctgtcatcaacatcttgaaacaagtaagtttatcagattattagaaaaactgttaataggagagttgatagctgagagcggtgggatggtttttccctattaacaaataaagctacagaaggaaaactgggagataacaatgatggaccttctttacttcacaattctgaaatgagttccaatatattatgtcccattaaactttgcttattgtttgtgaatttcctaggactaatttttattggttatttctaaggaaaaaaatcccactttgttggcaaattaagtgggttttaaaactgagatacacagaaattaagcatcttttctaatgtctcataaatagttttctctgtgtttgacaatgtaacagaggtttgaccaggggtttacccaggaagaatgagtcatctaagatacttgtcccagcagatctgtgggaggaagaaattctaagtgtgtgtgtgtgattaactcttgtgcttctacttacatatttttattcaagacctggattgagtggtaatggctgctttgcactgtctagtttgggattagtcaatatttgattttgtgcataacatagttttttcttaaaaatactctcacctctttttggaatttattcaaattggagcacttcattcattcattcatttactatctcgatgtcgggaattcagtggtgaggaaaaacagacacagccccttctcttttggtgcttacacactagagggagaacaaacattagtaaatcgatcaggaaaatggctgtgtaatttaaaactgtgctgtacgtgatgaaggaaagttatgtggttctagaaaagtgtatagccagaggacctgactgaagtggtcagaaaggcagggaacattaaaaatagggggagctgcatgtgctaaggtcctgcagcaaggtgggagtatgacatttaagaaactaaaggaaacatagagaactagagtggccaaaggtgagacaaaagaagtggaaagggtgataccgtgttggacttctggcctctatcctaagagcagtgggaaacccttgatgggtttaaaactaaagaaggacgtgaccaggaccaaattttaaaaagttactctagatgtagtgccaaggatatatggaagaagggcaagggtgagaaaggtaagagcagttaggaagctattgctgtagtgcaggcaagagactggtaggttgggctaagatagtggtggcagagaccatgaggcagtgggaatggggatgggtgagggggctttttgggaaatgagatgtccaaatggtatggctgttggggagatggagtgggaaggtaaggatgcctctgaggtttcaggcttattgtatgtgtataagtgcatgcagaccgtgccattcattgtgagtaggaacactgggaaaggaccaagtttggagggaactgaatttcatttccaaatattgagctagaaatgattttgagacaaaaaagaattttatattgaaaacccatttagaatacagtaggaccccattaattcacagtaataatcagagatgcattaaacttgatcacattttgcaaattagtaagtaaacaattttaaattaaggatgctgtacttcatcttgctgctttgccttaattattaatgacacaatttcggagtgtgttagtaaatatgttatatttttagaaacaatgaagtcgtggtaattgcaggccacacttccgtagtcaagctagtaaatcctggctgaggcaaacatagaggaagcagaggagatgtttttctggagagatttattgagctaactgaaccaatgaggttcattggtatttatgaatggttcattagtgtaactatctgaacacaaggtgaattcacattaaatgataagacttcccaataattaatatgtgccactctttagaatttgtaattagaggaaagaggcaaaatgaaaggaaatagataaaaggatagttgttataaaattaaactccttgaaagccaattcagtttatttgtgaagcaaacaagacaaaaaggaccagaagaattgaaaatgtattttctctcttagttggcaactcaacctcaagctagttcagtgtttctggtttttatcctaagagtagtggaaaattcctgaagggtttaaactaaagggtgacatgatcaggactgagttttaaaaagaattaccttacactattgacatttggggtcagataattctttcttttgaaagactgacctgacctgtgctttgcaaatggttagcagcatctttgtctctacccattagttgccaatagcaatcccctccccaactgtaacagtgaaaaatatctgcaggcattatcaaaatataccctgaggggcaaaattgtcctgttggagaaccactgagctaaatttagaatgactgacaatgtcatttgacaaccattttagggtctgttgtcttttattttgcttaataaatgtttactaggggccttctctggtgtgatgttcaaagaggagtaagacttagtctctctgcttttaaggggtgtatgatggtggggaaggggtggagaactgaaaaatttggaaattaaagaatgatggggaaagatattgtattagaccagtcttgcatttctataaaggaatacctgagactgggtaactgatgaagaaaataggtttattttgacttacagttctgcaggctgtacaagaagcatggtgccggcacctgctactggtgagggcctcagggagcttacaatcatggcagaagataacagggaaccagcatgtcacatggcaagagcaagcacaagagggtgaggtgagaggaggttccagacttttaaacaatcagatctcgcatgaactgagaactcattgatcacctaggggatggtcctaagccttcaagagggatctgccccatgatccaatcacctcccaccaggcctcaccttcaacactgggaattacatttcaacatgagagttggagggaacagacatccaaactatatcagatatcatttcaaaataaggtaggaaaggatgctttttcaagtgtaggtttccacgctaacctagaattatcctgtagtggcgagatcttaggatctgatctatcaatgactagggttatctgtgttcattgatgagagaattgattatgagagaagaatccccagcaagttccagatgaaacatcctttgcataaagtttctcctgacctctctggaattttgcctgatccattataacctttctcttctatcttttcctctcaccaaactccatctgttcctaccaacattcttaaatttcatcgaactttcagggaaaaacaaacaaacttatcttcaaccctgcctgtcctgccaagtatgtatcattccatttctcatcccataagaaagaaacctctgtggcagggcgcagtggctcacacctgtaatcccaactctttgggaggccaaggcagatggatcacaaggtcaagagatcaagaccatcctggccaacatggtgaaaccccatctctactaaaaatacaaaaattagccaggcatggtggtgcgcacctgtagtcccagttactcaggagactgaggtaggagaatcacttgaacccaggaggcagaggttgcagtgagccgagatctgaccactgcactccagcctgggcaacagagcaagactccatctcaaaaaaaatttaaaaagaaaagaaaagaaacctctgccatgatgcagacatgattctctcttgcataacactcaacttttattgccaaattccacaaccttttctgtgttccctctaacattgatggccaaccttccccttcatttctacttcttcccaggtttctttggtcatacccttgctttctgtcccactgggatcatttatttttcttctctggctcttcccaatagacttagtgaccaaatggctgactcaagtatttagtgaatttaaacacctgatgtgtttgactccccattatttctctctcacttaaagtaaggaagtgtgtttgtaaataaaattgaactaagctgttcattgccacccccagaatgtttttgtttttttttttttagattaaatgtgcccatgtaaactttgcaatcagagtggctcctttttaggaagaatactacttttcattgtgctgaaggcactgttctgacatttcacaagacaaaacgcatccctgcttctgttcctgcctgctgcaaatgcaggcaagtcattaactcaccctaaaagctgctcctctttgttttactgtaacacctttggaggaggtgaaagaaaaatgagttctttctgcccaagaaaattataaagaattttcaaagctgatattcagtgtctttgggaaatttttaattcacttagaaagatacagaaatgaatgttttgttttgacattttttgatagtgccttctgctgaatatccccaaagacccaagcagttggaagaactggacgcatgctcaacatttctgtgctgaagaaggggggaccctggtcgccattgaaagtgaggtggagcaaggtagagtactcaagatccaaccaggccaagataaccatttttattcaagtatttattaaaatatcccccccacctatactaacattcccaaatcaacatttaaaatactgtgttgctgatgatacacgagtttgcagtttgacccataggttttatttcatgatatctgtaaaagttagtgtactgcattgcttataaactgctgggttttggagccttgtctctcaccagtagcagtggaaagaataaggacatattcatggcctatatttcaaaatggctaaaaagtatgatctacatgtaattgcatggtatgatttttagatccctttacatttacctacatgcttttatttgatatttaatcaattatatacttcagtttaaatatagcagataaatcctcttttgtttagaaaggtaattaatgaacactggaaattgttttgttaatgatatgatgaaatctcaggttatccagctaatttctgtcaatttaaactaaaacaaaagtgaaagaaactgcattaccttaacaaggataaagtaacaaattcctataaatgattcataattatgttttgctggcatttaaatataatcatagctataaataggatgcagtgattacccaaatgctttctacagtattaaattagataatgtattcctgtttttcagctttcattactatgaatctttttggccagaccaccagtgtgtggataggtttacaaaatgatgattatgaaacatggctaaatggaaagcctgtggtatattctaactggtctccatttgatataataaatgtaagttttaagatttattttttggagatcactttggcaagatattttattcaagatttgtttactaaagctttttttatttcctatattttgtaggtataaatttatattagttttttattaatatattaatttttaatgtaattttatgtgttccattaatataattactttactcatcacaataattgtttattttgtaggttatgaaatgacttgtgaataagtttattaaatgcgaataaaggaataatggtgtcttaattttaaaaataatgtcttaataaaaattttaatgttataataatgctatatgttatcatacttttgataacgtgtattattttaaagattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaaggtaagaaatatttgggtttttattcctttcatttccaaagtccatccttctctttcatgttggttttacacagctgtgtagctaatgtagctaacagtttcctggctaacagtgtcaggcacttcttctttggctttacataagtttagttatttaatctcctctaccctaggcttatgccctttagtgggattctaaggactgccgaggccacttgagtgatgaccaaatttatgtatctatcttagtcatattaaatggctttactgcttcattctgggattatgtatctgttcaggtgatttttaaaggtcactgagaaaatgttgggaaagaatcaaggaaataaaccaactcatatttgctccttttttggaaccctgaaaatggtctctgtggctaaatgtggcatgcagcaatcttctagatctgatgggcagaacccccaaatggtttctgtgtgaaatgccaaagccacactattacaaatagccaacagggtcaatgaatagtgtgaatgcactataactgaccttgagtactataaataaaaacaacaacagctcatgcttttactgaatgctgggtatccctgtccacaccacccaagaaagccatagttggtgtctagagctgtatggaactctgggcagcctagcatatatttatatatatatatatatatacttatttggaataggaattttacttcttaatgtggcatacgtgtgaagtctctaatgttactatcaactcatcctcaaaaaagcagtgccagagaagctccatttctggttctcagttaccacttaaacattatagtggtcaggaactgaaaaaatgatactagatctgtaacagcaagagtaatatgggaacagcagagccttgtagggaaagaaataatatgagcatgccaggtacttacacacttatgagtacctgaccctgtgccttgagtgtatgcgcggtatgccacaaaatcctcaagacagttctatgaagtaggtaaaagtctcccattttacagatgaggaacttgaggcttaaaaacataagtcatccttgctaggcacggtggctcacgccagtaatcctagcctttgggggaccaaggcgggtggattgactgagctcaggagttcaagaccagcctgagcaacatggtgaaaccccgtctctactaaaatacaaaaaattagccgggcgtggtggcaggtgcctgtagtcctagttactagggaggctgaggcatgagaatcgcttgaacccgggaggcggaggttgcagtgagccgagatcgcaccactgcattccagcctgggctacagagtgagactctgtctccaggaaaacaaaacaaaacaaaacaaaaataacacactcaaggtgtctcagttaaacacaatgattctattccactaccttgatgttgatttattcttggaatgtgccctctgatcactttctctctttggtatttttgggactaacagtgtagattttcctttagagatagtacagaatagtggtgattgagagcataggcaccggagtgcctaccacacatgggttcccacccttctttgtagataagcttcagtcaaggttacttatcttctgtgatcatgatttctgcatctgcaaaatgtggtaatagccatctcacacactttatgtatgtataacacttagcatacttctagcatatatttaacaaacgatatagttttttctattatttccagaaagtattgttcaactacactagttattgtagccaacaataaatattcaagttctgctcctcttctctgtttgtcagatacatatgtgcttacattgggcttgagcccaaagtcttttatctgccaaaaaaattaagaaactgaataagaagagacacaagggcaaagcaagactccccagtttagaacttggtttccaatagatctttctttttcagggcaatgggtggcaaaaccatgctgctcaaaatcacttgttttgaaacttaatggaatcaattacatatggagaaatttatatatgtaaaaatacagacatataactcagtggggaaaaaacagtcaaattggcatttgggtaacatatacaaagaatgtcatttaatgttatgaattgttagcattttaaaatagctactttgatattattttgattttgtatgaataaccattacactgggcacgtaggctgggcacagactaatagcaaagaataaaaatatgataaaagtgtgatccatcacaatttacagaaattaaagagattcattttactttggtttttccatatgtacagctgctgtattgaggtaatggtttcagataaaggtcagtttcccactttgccatttttactggggggagtatgaccggaggaggagagtggagcaagaagcaacattcataggatgctttctgtgtctccatacaatagtgtgtgccttgtgtggatatctcgttcaattccatccacacccctccaagggagaccctcatcatctcttgtagaccataaatttgaggtttagaaaggttaatttgcccaagagctcttagccagttagggccaggaataggattaagtcccagcctcatgacctatccacacctcacatgcttctttccaacaccaaatgtagtaaaaccagtacacagaaattcaagtcactttggatcagaaggtacaaaaactcttaccttgtttttgtcctttaggttttctaaacctttagtctatcctagtacataacatacagaacatatgttctatacatatcctaacatatgttctatacatatcctagtacatatagaacatatgttctatgtaaacagaaaggcaaatgcacatattagagaggaaacacgtgttcataaacacaggcttggttttcacatgatcacagccactcacagactctcaagcaccaatgcttgacaacgtgtgggaaaaccttgccttttaatttataaactttgactctgacaggtgacatattaatagtaactgtttataagaacagtgtgtatttctaagaatttattaactttattttttaaaattccttttagaatttatacatgcaaacattaagcataatagtgactatcagtctcaaaagtgtaatcgagtattttacctgataatatgcacctgtaatattaggtttgcaatgcaatatatgactatgtaacatgtgcctttctgctattaataagcattaagttctgccacagcagtgtggattaagccaagtgtagttagtggagtgaaacccacctaagaagatcaccatcagttccaccaaaaagcagtcaatttgataaaggatggtcaaaactgggaaatcttctagaaatggttcaatctatgtttatgtttttgaaaaacaattcattaaatttcctgagtgttctcattttttcgcatcacttacactttcagatagtgttcttgttttgaaacagtcaattccagaagaaagcactctgatcaacatggatcatagtgacaaggatctatgctaagctttgcctcttcctttgtcatccagatgctgcaaatgacttttgttgctgttcttgttctagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagatgtaggtatcctaactcccttgagacatccttgaataattaagtttagcatctacctccttcatgatctggccactgaaattagcactgaaaaaaagatcccaaaaataataataaatataacacttaaataattggtttatgcaattacctgaccaaccttatgaacagcctatgactacaaaataagagtgcacacctctttagggtaaacatccacttgcctaatgtctggaaattaataccattcaaaggttctctgaaaatttccaagtaccccgatactgccttgcatgtgcactggaacacagctgaaactcaagcactgcatttgggaatttgcggcatttaatgaatccccaagaaaaaacgaatcatgcttcttgtctagaaatgtgattattaattagtttagtaccccttataattaagcacttgaggttttattttcctctagggatgtggtttagagaatacgttattttcatttttttaaataaaatattgtacactcaaagtagtgaaaagtaaactagtctatcctgacccctagttctactccctaatgttagtaattgtgaacactgtcttgtgtgccatctagaaattttccatgtatacacatacatattcatgtaatggaagaatatgtacattgtttttcaagcacaaatgagatcctattctacatgctgtctttaaacttgctttttaatttaatatatctttaacaacttcacatgtcagcacataaaaatctcatgaattctttagaacgcagcatgtaaggatataccacaacttattaaaccattctcctgtgaatagacatttgggttcttctcagtttttcacagttataaacaatgcacaacaaatatccttgtgccagtaggataattttttagaagtaaaattgctgcgtacacttaaaattttgacaagtactaccaaattgccctccaagagtttgcaccaatttacatgccaacaacagtatgtgataatgtctagttttttcacatccttgtcaacaccaggtattctcaaaattttaatccttgccagtgggagagataaatgaatgatatttcatgattatttattgcatcatgtagtacagaatgttttaacttcatgtagtcagttttgctttatagcctctggattttctatgacttggaaaggttttccccacaccaacagtataaaaaaatttaaccaggttttctttaacatgtttatgttttcaattttatgtttgaataattgatcaatctgaaatgtatttcactgtaaaagacaaggtactggtccaatttcacgccgattgctcactagaaaatcattgtggcagggagccaagaattcctaaaaatcaaaaaagatctcatttgtggcagatattcctgtttgtcaagctgtattcacagatgtcctagcccctctttaaaaaggtgtgcagaaatagcaatcgatgtgggaattgtagcatgctcagataacactgggtgatgctgccagccgtcgtggcaaggaaatgatggctcagttttcctccacagaatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctggtaggttcaattctattcaactcaaaaatataccttatttaactactgtatgcaagacactgtgctaagcaaaggatatgaagatgagtatagtaagaactctctcttcaagaagcctctggtctggttggtgatgtaaagaataacagaactacaaaatgatataagagaggtagcaaatgttatgggggttatcaagaaaaagaatgcattgtattcatttggagaaaggtagaaaggcttcttgaaggacatggcagtgcagatgggccttgataaataggtgggtgtagatgggtaataatgggacatggaaaggcattctgaggagaaaagctggatgaaaatggggaaggaagacaggacgaggcttacgtaagacaaagccgatgttgggatttgcctgaatgcaggttaggcgtaagggagaggtgggaaattagatgagaaacatgggcttcaagcatgtgtggaggactttgaggattcatgtttaaataaaagattgataggattccagagctacaataatgatgatggtgatattgtttggatatttactagatatctggctctgcactttacataatatctcatttacacttaaagttcacctggcctaacccctttattaaaaatgaaatgtaaactcagagcattaaatagtttcctaagtgtctcacagctgtccatcaccagtaccaagagtagaaatcaagtttcctgcatagaattcactaacacaagctggcctccttttaaatctctcatttagtaaaagtgcatgtatttacttacattctgggtactgtatcaaataacatacaaattatatatttttagatcaaaacaattcaggattaaatgtaaatgatagccacatatatcttggaaaagctaattctacttctaaaactccataaaagctgtccttcccttttctccttttttttttttttttttttgttagcacttgccttttcttggaatcttgtcctttcaataacaatgcatttattgaatgcttaagaagtgtcaggctctaactcattgaaacttctcaacttgtaaggaaggtggctgtgtggctcacaccagtaatcccagcactttgggaggcagaagcaggaggacctcttcaggccaggagtttgagaccagcttggttaacacagtgagactcgttaaaaaaaaaaaaaaattcaattatctgggcttggtggtacgtgcctatagtcctagctacttgggaggctgaggctggaggatcacttgagcccaggagtttgaggctgcagtgagctgtgattgtgccactgcacttcagcctaggtgacagagtgagactttgtcttttaaaaagttttttgtaattaaaaaaaatatttttaaaggttttgttgttagctctcttttatagataaagaaaccaagtgcaaggtaacatgcccatggtcacgcagctagtaagtggtggagccgggatctcagcatggatgtgtctaactctcatgcttgctctctgaaataaagtccctctggagttcccttatttattttatgttatgctatgttatgatactttattgaatgcattattttctttcacaggtttattagtgggtaaggacttttcaaatctgtgatacacagcactgcatgaaatgcatacatttggaaatctcttttaccagcatcagtcagctgccactctctctgggagtcatagcccctgcttgttccaacctttaggatgctaattgtaaacatgaaagagccaccctcacccaggcagcacccaaactaagcctacaaagctgtgccttaacatatcttgttatgtttaggtaaagattatttctgtcagaaatgctataaactggtcctagttttataatcatttacatgaaacccaatctttcagagtattaccatgaaaatcttgttacatatatttatcttgatcttttatagaatgtaatgtaatatttatctcaataaataaacccagtcaccaccctgaaatcataactggcttttcttcacagaaacaagacaatctgaacacccagagttgtgctcagaaacatctattccctggataaaatttaaaagtaattgctacagtttttctacagtcctagacagtatgagttttgaggctgctcatgaattttgcaaaaaggaaggtaattgtttttgtgatggtaaaaatgctttcatgtgctccttcttgccatttcagtaaacaatgtggatttctttattcatcccattatttagtgactttaggagcaacaaaaactaaactattgaaaaaataaatactattgaaattgcttgtttggaggacagctactatatgaaacaatgtccagtgtagaatttggaaacctaagatgatgtctcagcatactgcactttctgaagaaaacgttccttttgcatgcatttgcattatgaattttgaatgttccctaaaattaatattctatgccttaacttctgacgtgcaagcttgtatcttttaaaaaatgtggttttacttttttaatttaaagtctcttctttataatggaaattttcacttttcaaaacctgagctttacaattaatagtataggaaacattttttaaagtatatttatgtgtaaacacaaatattcctttgctacttgtctctcttataggttctaatcttttaacaatcaaggatgaggctgaaaatgcatttctcctagaagagctgtttgcttttggttcttctgtccagatggtttggttgaatgctcaatttgatggtaacagtaagtgatttgggtagaggagaggacataaataaatacatggttgttaaagctgatgataatggcatctgtgagccagaaaactctccttggatacgttttctgagaaaaaatagcatgaagcctaaagccatttcttccaaaaacaacattgcaacccttttctttacccttttgtcttttaaaataatcccagaacaccaaaaataaaaacaaacaataacatgtttatctttacccttagcaggaagatgcttggctggaactttgtgttcacagacttagtcattgcataccaaaaccatatttactggaaaatatcccaggtttctaaatgttataaaagcacaatagagttatggaaatgtttccatgatgaactgtgctgttaggattcttatttgctactcataaaaaccagagtttgtaataaaatggaagcatggtattcttttctttatgtaattgatggttattgaaaggtacttgtgaagaaaattattttaattggtatggagagcttgttacagtggtgtaccaaggttgggggtgagcctaccctttcgaggaggagtattttaatcaccaacattgtttagaatttcaagcagatggtgataataaaaagcagaccaacttttagttagctgtattgttagttttaaattattttcagacaatacactattgcccacacatgggatggactctcctaccgcccctacccccttggtacatggctggcttggtattaaagaaattcactgtaaaatctttttagaaagtgagccattttgtaatgatgaagatgttaggacttcaaaggatttttctttactcgattagttttgtttatcaaatgatttctttaaatcgattatatatatatatggaatatttcaaaattcaaactgtcacattaagaaacatgataacctaaatgacctaaataagaacactgtacctaaaataaagaggcaactttattaatgcctaccttttgatgttgagtacatcactgtatttactgagttgaatgtattagttcaagagtctcattaaattcaggggctgccatcccattactgggtatatacccaaaggactataaatcatgctgctataaagacacatacacacgtatgtttattgcggcactattcacaatagcaaagacttggaaccaacccaaatgtccaacaatgatagactggattaagaaaatgtggcacatatataccatggaatactatgcagccataaaaaaatgatgagttcatgtcctttgtagggacatggataaaattgcaaatcatcattctcagtaattatcgcaagaacaaaaaaccaaacactgcatattctcactcataggtgggaattgaacaatgagaacacatggacacaggaaggggaacatcacactctggggactgttgtggggtggggggaggagggagggatagcattgggagatatacctaatgctggatgacgagttagtgggtgcagcgcaccagcatgtcacatgtatacatatgtaactaacctgcacattgtgcacatgtaccctaaaacttaaagtataataataaaaaaataaaaataaaaataaaaaaataaaaaaattcaggggctgctttttatggttaattccagtcttagtatgtttgataaccatgcacataattcataatgagtcagcaattttctcacagatgaaaccataaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcaggtaggtaaagtcagagagtaattcttcattttgattctaccttaactaatgttgactgacttctttagcatttaaaggttttaaaatccaagttgagagagtattcagatagattctgacattattgttgtgttctgcaccaaacaagtcagagaatagttcagctccttctttctctgatatgagaaaaaaaatcattataagtcaactcaaagactatgatttttcttgtgtcacccaggttgatcacctaatgggcaaaaaatcattttccctcaagcaaatagaactaggaatgtaaaccagcaaccttcattctggtgactgctactcagaatttttaaggtttatgtttggcctcaggaaatataatctaggcttatgtatatttgctgtagacaagaagatgtgattccctgttgcaagcataatgtgtcataaaagtcacattttaacttaatcatcagtaacatacttagtgtttagtaattaaaaaaaacaataattttagaaatctaagctagaaaattctagtcactgatggtgggaaaat

SEQ ID NO: 12678 - DNA, 45693 bp, Human; identical to SEQ ID NO: 12523
  misc_feature (1)...(45693): n = A,T,C or G

SEQ ID NO: 12679 - DNA, 45693 bp, Human; identical to SEQ ID NO: 12523
  misc_feature (1)...(45693): n = A,T,C or G

SEQ ID NO: 12680 - DNA, 49309 bp, Human
  misc_feature (1)...(49309): n = A,T,C or G
ggaattatttggtttggccaagttaattaggtaacaaatacttttcttttcttttctttttttttttttttttgatacgtagtcttgctctgtcgcccaggccggagcgcagtggtatgatctcagctcactgcacctgggcctcccggcttcaactgagtctcctgcctcagccgcctgagtagctgggactacaggcacgccaccacgcccggctaatttttgtattgttagtagagactgggtttcgccatgttgggcaggctggtcttgaactcctgacctcaggtgatccacctgccacggcctcccaaattgctgggattacaggcgtgagccacagcgccaggcctttttttttttctttcttatacattgtttacactcctcacttactcctgattcttaacagttgccacaacctttcttcatttaaaatctaactcagttcaatcaggaaggtcacttaccttgaaagtcttccttctttagagctggggtgcatggtgttcttgttggcagagtagaaatgagatatcaaggaaaaagaaactgtaacacaactgggaacccttaactcattgtaagaactgcctccaaatcaacttcctcaaaaactaaagaactcttcgggagagagagactggctgataaacaatctaaggggaaaacttttaaagattgtaacactaaaaataattccgtaaaactacaatgcaagtctactcaacaaaactttaaaaatataattttatttttctttcaagagatcatgggaaaatctactattttcgtttaaaatatataacttctatttgttactatatttggatttgagctactactattctggatttgttcccatgtatctgtggaaccaggcagctaattaatctttactcagcatctctggtatttcttgaatgaaaatggaatggattggtggaattaatggctagatgtttagaagacactagttactttgttattttctctgtataatgatgaaagcctacaactatacagagacataaacgagccagggtgacaggttgggaaagatgaagagggaggaggaaaggataggcttgtagccctcatccggtcaaattcccaactttgagcttcactttattgtaaaattagaggctaaaactatttaacgcttccaaaactttttgattcaacaaatgccaattagttactaacataattaatcagtgtatcctgatttttaaaagatattttcctttgtgatttaaaagaaacatgggagttggagttgcagcgtcagtcctgaaggactgacctcgggaggccaggtaggaactgataaactggcaacaaaatcacatgttttcaactgaatatactgatattcaagcgtccagaaaaacaatttcgagcctacgttcacaagtttgccagaaagccctattattgacacagctgcggatctcagacatctgagttagtcagcaccattctgctggaggggattaagactggacgcttcgagcggagttgggaatgttatcatctgaggaaactaaaaggcgccagcagtaggactttctccaaggtctctgacaaaatatgttgcgggaaaagtcaacccgccccaaattcccccgtgtggccctaactcgaggctctggctcctcgcgccggcaagctgaggaagagacggtcccctgcgatttagatacaaacgcgcgcgtgcagggaaggccatcccagggcagacactgccacctccgccgcttccgacgcccgcgctcgcgggagagcctagcgccgcacgggaacctcccgaccaccgccgcagcgcggatgggcgtccccgggagccaatggacgcgccgggaggcggggcagggaggccgagggggcgggatttcccgcacggccgctcggcgcctggagaaggctgtgcgggcggggacggctgcagcccttgccggagagggcgggccggggtcagctgcggcgggcgggccggcgcggggagctgtgggcggcagctgcgtctcctgccaccgccctccctccgccacgatgccggggatcgacaagctgcccatcgaggagacgctggaggacagcccgcaggtgaggcgcgggagctggtgggcgacgagggagagcccagctggccgaccccaggtctggcgcctccgcggctcccgcaggtgcccgccccggcccaggtgggggccgccgccgccctaggtcaccgcccgtcgcaggccgcgcccggagttgtggaggctgggcccgccgcccaaggcccgcgtgggcctgctcggctgggccgagggccgcaggcggagaccgagccgctggtgctcgtgggccgggcggtcacgtacgcgcgcgggtcctttttatttgacgaaaggcgccgtttttatcgcggtgatgtgaggtgccaaatctcgatcctggaattttctccctgagaacctcttcagaaaaattgcagaagggagagaaaccccgatagtcttatttaatgatttccgaggctcagcaagctaaggaaggaaatggatcgtttttctttgggagaggctgtaaggttgtgtgtggagccctaatggcaaagcccgtgacgggtcccggagcccaagaccgctctccccgccgaatgtgcccgtgtcgcggccgtgactgtggtcgctgtcactcgagctgtgcacggcgagggatggacggtgccttcgccgctccgcgactgctgcgctgctccctgcagacttggccttaataaactcatcaaaataaaagccctgtgttctgtgcgtcggaatgatgctgatgtggttgctctagcttaagacagttttggaaaatgtaaccatttaatatgttttcagtactgcagaatgaaagcagctatattttttaaaatgttggcaggggctgtaacttgcatagggaaaacttcatctctaagccgttttacacgataatttaaacggtttaagacggtgttgctggttggacactatttagaatgaaacatttctgaattgttgctgatttagaaatgcagttgcaccatttcgtgtgtctttacagttgaacatggcccccaaagaagaaaagcagaagaggtctagatctccttttcctggatggcacttctgccatggattttgtgccaatgttaattgccaagttgaaatggggctctgattgtagaattgatttgttcttttttattctgaaagttatcttcacaggccagttgcctgctgctaatgtactcttaacagctgatagtgacaaaaagagaaactcacatttggtttatcttgactgccagtatactcggttcaatttttttcttgatgatttctccatataaagttataaactgtatttgtttcagatgatttgcaaaaagtttgtggaattggtcaggtgtactttgtcattttactttttattatgtaagattcaacaggttgccttacctttcttctcttacttggcttttttttttaatagcccataaagactataaacggctcacaatggattgcacactgccctggaaatgacttgtgaggcagagataaactcttgactcatctaatgtcttgaggtttttgccagattagtttacaacttaagaattgtggtttttttttttctttacaagcatgcatcatactagtgtccgttttacaatatatttgtttgttttttgagatggggatcttgctatgtttcccagtctggagagcaatggctgttcacagacactatcgtagtgcactgtgtcctggaacacctatgctgaagtgatcctcctgcctcagcctccctagcagctgggaatacaggcgtgtgccactgtgccagcttttttttttttttttttttttttttttcctgagacggggttttgctcttgttgcccaggctggagtgcaatgttgcaatcttggctcactgcaacctctgcctcccgggttcaagtgattctcatgcctcagcctcctgagtagctgggattacagacgtgtgccaccacgcccacctagtttttgtactttttgtagagacggggttttgccatgttggccaggctggtctcgaactcctgacctcaggtgatctgcccgccttggcctctcaaagtgctgggattacaggtgtgagccactgcgcctggcctgtgccagctaatttttaatgaagtagacacattgatatcccttcaatgttgaaaggcaataaatttgaactaggtaaaatttacttgggaaaattaattggtacaactgggatttaggaagtgtacatacttggaggtgattcttaggtcgaacctgtggcagaatgcaaagccttggatctagggttgacgaggtttttagtcatcactgccactttactaccttctgctttagggcaaatcattcaacttctctgaacctcagctgttgtgtcttaatgacatgtttttatttttgaccctgattaaaaagaaataatagttgcttccttcagaaaaattggaaggtccagaaaagaataacacacaattacctgttggttacccagcaaaaccttattaacagtttgctttctttattctactgttttttttttcttctacatgttttaatggaattgagattatattgtgcataatgatctttatcctgcttttaacttaacattatcacttaagtatcttcacatgtttttacattccaaataaaaacatttgaagaccacacatttccttaactgatttcacaaccctttgctggacttttagagttttcccaaagttttgcttttataaatagggctgagattaatgctttggagcataaattttcttctcagtttgaactattttatctagaatagagtccaagaagcagagcagcaaagaatatgaagacttttaaagctcatggtaagttttttgttttttttttgagacagagtctcactgtcacgtaggttggattgcagtggcacagccatagctccgaaacctcaaactcctgggcacacgccaccaagctcagctaattttattttattttatttttattttttggagatggagtttcgctcttgtcgcctaggctagagtgcagtggcatgatcttggctcactgcaacctccacctcccgggttcaagtgattctgcttcctcagcctcccaagtagcccaactaatctaaaaattttttgtagaagactgggcgtggtggctcatgcctgtaatctcagcactttgggaggacgaggcaggtgaatcacgaggtcaggagtttgagaccgacctggccaacatagtgaaaccccgtctctcctaaaaatacaaaaaattagccgggcgtggtggtggacgtctgtaatcnnnnnnnnnnnnnnnnnnnnttgcactccagcccgggcaaccgtgcgagactccgtctcaaaaaaaaaaaaaaaaaaaaaagaaaattttttttttgtaaagacaggttttcactatgttggccaggctagtcttgaactcctggccttagtgctgggattacagatgtgagccactgtaccaggccctaaaagttttttgtttgattagtttttaattttttttagatcatttagatctaatcaaaagtggcctgccagttgctacctaaaaaagagccttggcctggcacagtggctcatgcttgtaaacacttgagggtgggggttcaagaccaccctgggccaaatagcaagacctcatctctacaaaaaataaaattagctgggcgtggtggcatgcacctgtagtcccagctattcaggaggctagggcaggaggatcgattgagtccaggagtctgtggctgcagtgagctatgatcacaccactgcactccagcctgggtaacagaacgaggctttggctcttaaaaaaaaaaaaaaaaagagcctgggagtgatggaagactatcctgaattacagttacccttcttttagttttgatttatagtaactacgtattaaattagggagaatttgcaagtccaaaatccagctgatcaaacaagcatcttttaagaatactgcctggaacctaggtggggaaaaagcatgtttggaattaccttgcccaaaccagacagttctgcaaaagatcatccattgagccagaaaatcttaagcttatagtagatgccttgtccatatttatatgttgttttgaaaatcaaaatcaaaataaaccttgttaattactaagaacagataatgatctttaaaaaattaattgattttatatgtagatatgtatcttagtgattcatctatgatagaacagtgaagacaaaccccagtcccaaatgggatcttctgtttttgcataatatgaattaatcatgagatgtgcctttcctcccaacattttgatgtctctgattgggattcctcttagagttgatggtatattaacaattgctatcagccaggtagcagtagtaatgtatttcacattgcctgcaaatgtacatacttggttgtttctcctagtagcatactggccaagtgtagtctctcagtgttcaactaacagatcaattttgccaccatttgagaaaggaatatcagtcctggttgttgtccgaaaaccttcttttgacacctggtgagatgtcaaatgacatcatcaaaatttgctgaatgagtatcagtttcttggaagaaaatattagggacaaaaatggagtacttctaagaaatacttacctcctcatggcacagagaatgataatgtataggaaaacatgcatattgatgactctcgagttgaaaagtggttcatgggcccggtgcggtggctcacgcctgtaatcccagcactttgggaggccgaggcgggcagatcacaaggtcaggagatcgagaccatcctggctaacacgatgaaaccccgtctctactaaaaatacaaaaaattagctgggtgtggtggctggcacctgtagtcccagctacacgggaggctgaggcaggagaatggcatgaatccgggaggcggagcgtgcagtgagccaggatcacaccactgcactccagcctgggcgacacagtgagactctgactcaaaaaaaaccaaaaaacaaaaaaacaaaaaagaaaagtggttcataagattcgaactctgtgaagttttagaaataaatttatgatgcttatatttgttatgtttacatgagagctgtatatgataaaattctgtgtgaaggtctgttttcataaatataaggtaaaaaattcaagacataagaaaaccttaaatcatagcttaattgccagcattgttttgtttgagtagtacaaaaatgaaaatgatgcatcttacaatggataccatcgtagatttgatgaaatggtaccatattgattctattttttaagctactaactttaaacaaacagcaattatccagtgttgaagttgatattgttagcttaaaatagggaatctgtttcaacttgctttgcgctaagaagagcttttaaatttaattatgctacaagtttttacataaatatgtaactccttgaattggaattacccatttttagaaaaaaaaaaaacaaaacagaaacgaagcggcagattttttttaagaatggcagtagccaaacaagatttcctgatgctttcttttttacatcttaaaatagcactatatggaattgtagtggagtgtttgaaaaatattctgtcaaatctaaatctctgaggcctggggaagtggaggactgaaaatagggacttactggcatcatgattttgtgtcctttccccttctttatactatattgacttagcttcctcctctgaaaataggaagctaaggaataagttgatttaagaaaaaaaaatttttggccatgtgtggtggctcacacctgacctgtaatcccagcactttgggaggctgaggtaggagaattgcttgagcccaggtgtttgaaaccagcctgagcagcatagtgagaccctgtcactacaaaaaatagaaaaaaagtagccagacatggtggcacatgcctgtagtcccagctacctgggaggctgaggtgggaggattttttgagctcaggaggtcaaggctgcagtgagccgagatcatgttactgctccagcctgggagaagaatgagaccctatctcaaacaacaacagcgacacccacaacagtttctaaggctgaggcataaattatttttagaataaaaatatatcttttagattttaagctgcagttatctccagtagttattggtattttcattcttcccctgggcctttgggatgtaatgtgagtatgtctaccttgcctttgatagccttagtttccttatctttgacaaatttttattgacattctttttttttttttttttttgagacggagtctccctctattgcccaagctggagtgcggtggcatgatctcggctcactgcaagctccgcctcccaggttcacgccattctcctgcctcagcctcctgagtagctgggactgcaggggcccgccaccatgcctggataatttttttgtatttttagtagagatggggtttcaccgtgttagccaggatggtctcaatctcctgacctcgtgatccacccgcctcggcctcccaaagtgctgggattacaggcgtgagccaccgcacccggcctgacattcttaacatttacttataagctttcccccttaaaataaagataatttaaaaaaatttttttattttgagacagagtcttgctttgtcgcccgcccaggctgaagtgcagtggcgtgatctcggctcactgcaaccttcacctcccaagttcaagctattctcttgcctcagcctcctgagtagctgtgactacaggcacgtgccaccacacccggctaattttttgcatttttagtagaaacggggtttcactgtgttaaccaggatggtctcaatctcctgacctcatgatctgcctgcctcggcctcccaaagtgctgagattacaggcatgaactactgtgctcggcctaaaatgaagataatttttaaatgtgcatggtagaaaaatgacaaaacaaaacaaaagccaaacaatatagacatgtataaagaagaagaaaggaaaacccccaaattgtgcattcggaaaaacctagttagcattttatatgctgaagagtcggccatgttggggagggtgtactgtggtatttttagattaggacaggaaggggtttggcctcttctagcaaaaactgtagaagaaataatcatactaaattatcctgaagtaagacatttaaaatatttatactacatggaatgctgttaatttagctttgaacgtttctgttgatttgttcttagtttatagaatttttagtttatgaaaatatacctctgttgtttctcctaaagtttgtgtgacatagttggaaaatacctctgctttgttgaagtgaaactaagaacaaaaaaaaaagacttcttaacattactatcaaaagagacaaaatagattaaaactcagaattactagaactttaatatcctacgatttttgcttcctttagaaaaaatatttttccatctgatttgtataatgattaacataaacttattgctattgttttatacagacaaggtctttactaggtgtatttgaagaagatgccacagctatttccaactatatgaaccagttgtatcaagctatgcatcggatttatgatgcacaggtaaaacactaaggactaacttgatgcttttaaaacacgaatctttaagcctcatgaggacagatagtgtctgtcttgtttaccactgctttagccctgtgttaggctcatagtaataaatatttgttgaatggattaatgaacattgagtgtattacagaactgacatttcaactactagtgtacagtttgtagtactacaaaagtgatagacgattgaagcatctgcccattctccccaaacatagtttggggggaaccccccattaaactcactgatagtgatctttcctaagatttgaatgaagaccccatgtcatcactggtattttccctaatcatgcttattacaatcttatggagcacttccccacccccacttttttttttttttttgagatggagctttgcccttgttgcccaggctggagtgcagtagtgtgatcttgggtcaccacaacctccacaccccaggttcaagtgagtctcctgcctcagcctctcaagtagctgggattacaggcatgcaccagcacgcctggctaattttgtatttttagtagagacagggtttctccatgttggtcaggctggtctcgaactcccgacctcaggtgatccgcccgccttggcctcccaaagtgctgagattgtacccagcccccttttttttttttttggagatggagttttgctaatgtctcccaggctggagtgcaatggtgcaatctcagctcactgcaccctccacctcccaggttcaagcaattcttctgactcagcctcctgagtagctggaactacaggcatgcactactacgcccggataattttgtatttttagtagaggcagggtttcaccatgttggccaggctggtctcgaactcctgacctcaggtgatctgcccgcctcggcctcccaaagtgctgggattacaggcgtgagccactgcacctggccaacactttccctttttcagtggaggatttgaaagttggctgcctctgtctagttaaaagaaggcactaaaaattagatgtacctctggagtacaagaagatgaagggtatgactaagttttcttattgaccagcaataaaatttgaagctatgtttggataacttaattataagcttaaacagcaacctaggttctgtaatatactttctttgggattaattaagcgtacaagttttatttttttcccttctcatattgtttgctttctggcttcacattttcattatgtacttaagagttgctatgttgttgtttagtttttccttgtgatcaggctctgaagctttgctttctgactacagagatatatgattaatatgttaaagaaatgttctctttgttatattcaccaaaaaaactaaattaaagtttttcatatggctgtgttgctatgttatatgactgggtcaaccacattttggttgtatgttattaagtgcttactgtagtctagtatcagcatctacagagggcaataatcagtcatcaacgtagatgctctaaagattttgctaaggttatatcagtttatttctaggctttaaagtatttagtgcttagtttttattagcaaaaaacaaacaccaggaacactgctgaattcctggagagtgtctattttatggtttgagttttcttttaaagtgctttaatggtagtacccctttccagtgatttaatgaaggttttaaaaaacatgtacaatatttatgttaagtgataataaataaattaggtatttaattagaaaaaactaaaacttttttcccagtaatatgctaatttgaatgctttttccatagaatgaattaagtgcagcaacacacctgacctcaaaacttttaaaagaatatgaaaaacaggtattgtatatcaaagttttaaaagcataattttaaaagtatagtatctgtatagatagactttcaacaagaatccttaagttttcttgaattcacagaatatgccattgaaatttcatgatagcacttatgttcagataattttaatgatttaatattaaatacagaggctatctagtttacttgttttctttttacaaatgaagaagctgtgacttgctgaacattacagtgttattggaggaactggagctaaatgctaaatctttgaacttccagtacagtgggtattccaatatgccatgtcaattgcttacttaataaacaattaatgtttattatatacattacacaattttagttaaatgatattttagagctttttcaaaattttggaagttttctgaagttatttaaaaatgtaaattatagtaatgtcattcccaaaagacacagcattgaaactttacctcatctgtttcttgcttttcagcgttttccattgggaggtgatgatgaagttatgagctctacattgcaacagttttcaaaagttatagatgaggtaaacgtttattttattttgcttgattaaatggtcttataattgagttacccagttgcttagcttttattttatgaataaagctctattaaagagatgactaaagaggaaccttaattccacatcctggtggctggctcatcaaaacaatactttctttacctgattaaacattgttttccaggaataaacttacagatgtgcttcttctatacgcagtccgtgctaacattcagtcttgacatgtgtcatttgatgtaggcagggagagaagagttaggtagtgaactgcatctgggttctttgtggttgctcttttgctattaagcaacattttactgtttagtctttattaatcctgctatcctaaacagccagaatcaaccctgaattcctcaaatcagtcatcacaacaaatcattaaaacaaagacctaaaaggtaagaggaaaaaaaggtagtgagagattatggagaatcgttaactgttctctactgttgcagtaaaacctcttcttttcacatggaccattcgatagtcctgtgttttctagactcttaactggaaaagtaatttttttgaaatattttaataacccattatagcaaaatgttttaccgggaaatcaagataaagaaataatgtaatttttttcatttaaaaaaattgtggtaaagtacgcatagcataaaatttgtcattcatgatatttagtgcattcacagtgctatgcaaccataaccactgtatggtttttaggacattttcatcatctcaaaggaagccttgtgcccgttaagcagtgtattagtctgttttcacactgctgataaagacatacctgagatgagtaatttataaagaaaaagaggtttaatggactcacagttccatgtggctggggaggcctcacaatcatggcggaagacgaaaggcacatcttacatggcggcagatgagagagaatgaaagacaagtgaaaggggaacctcttagaaaatcatcagatctcgtgaaacttattcactaccacgagaacagtatgggggaaactgcccccatgattcagttatctcccatggggcccctcccacaacatgtgggaattatgggagctacaattgaagatgagatttgggtggggacacagccaaaccatatcaagcagtcacttccacctccctgctccctcagcccttgtcaaccactaatcttctttctgtatggatttgcctacttttgatatttcatataaatggactcataattttagacttctttatgtctgttttcacttagcataatgtgttcaaggttcattcatgttgtaatatgcctcagtacttcattccttttttggctaaataaaatttcattgttatggatataccaagttttgtttatctggtcatctctttatatatctgtgtatctgtttatctagtcattgtttatttgtgttgtttctaccttttaactagttcaaataatgttattatgagcattcatatacaagattgttttttttgttttgaacaacagttttcagttctcttgagtaggtacccagaaatgggattgctggatcattgcatggtaattttatgtttatttaaaagttaaataattttagaaaaccaccaaactgttttctacagtgcctgcaccattttacattcctaccagcaatgtaggagggttccagtttttccacatcctcgccaacaattattttagtttgtgtgtatttaaaatttttttaaaaattatggccatctgaatgagtgtgaaatggtatctcattgtggttttgatttgcattttcttaatgtctaatgatattgagcaccttttcatgtgcttattggccatttgtttatctttgaagaaattatatagatcctttgcccgtttttaaattggttgtctttttattagttgtaaaagttctctttctagatacaagttacttatcagatacataattggcaaatattttctcccattctgagttgttttttttttttttcactttcttgatggtgcgctttcatgcatagaagttttaaattttgatgatgtccattatatattttctcttgttccttgtgcttttagtgtcatatgcaagaaagtgttaccaaatccaaggtcattctgtgttttctaagagtttagtaaatggaattttttgactatatagtattttgtactatatcacataatttttagtgttttcctatataaaatatatcagaaccatttttactagattatgtttaatttacataacactggttaaatgtctgtgtatagttatttggcctttttggtctttctttttctagcttagctcttgtcatgcagtgctttcaactcaacttgctgatgccatgatgttccccattacccagtttaaagaaagagatctgaaaggtattgaagtcaagcttatgtttactttcattggctgtgagatcaacacttgtaaaatgcatattactctgtacttacaccatttctggatgacagcctatgccactcttactttgctcagttaccaaacatttataggagctcctgctagatgtcaaactagatattgagaaataccgatatggataagatatcccctcttttgagaaattctagagaaggaagtgggcacatgcataattacaacacttatgtctcttataattagggaatgagcaaggtgctggcggggctgttaggagggggtcagcaaggctttacccaaggatgtgacatgagcattgaacagtgaagaggaatttgccaggagaacagtcattgttctgttagagggactagagtgcacaagatatggcttttagaaatacacagcctatttgacagtagcaagaaactcagtgtggctgcaatgctgtatgtgttagagtgaggcaggagatgaatccagaaatagagtagatgggagtaggtcatgctaagaggctagaacttcagattatgagcgaaggagaagccaatgggggtctttaaggagagacacaattcctttggaggatggaatagagtagccttgttatgtaggagactagactgggaagttgtgggagtccagtgagatatgaccaaggcctgagttaggatagtggcacagggtatagaggtgtgtgtatgggccgaagtggcaagaggtaggggtactggcacatctaacaatctgcaacctagtcgtttctgggttttatttttacccacttaggattactaggtgatacaatgagagttttatagagttggttttgctttcccataacttgtaatctcagccatacacacttacttccaaaatatgtagagagattaaaaatattgaactaatgtatcagtgaatggtaaagtatttaaattatacatggaatacagacaaatgtgtattatactattctacacctacaccatttctggactgcaacccgtgccacctttactttactcagtcaccaatacatctaatgtattttaaagatggagttactaattgtggttgtgatcctcaagaatggtcatttctaaggtctagaacaagatctcttttcttcagtgtaaggggactgaatggcataatcttattaatgagatgttttgtttctcgtttagcatttgaatatttagattcatatatcaaaaatgcatgattctggcactaaatcagaatatttgcatatcttaccatttacagtgggtttttaaatttgtttttatgtcatatcactaatttgtagcaagtagattttctggtggtgtaactgttgctaatgatagtaaatgtttcatagactagctgaaacacagagtagctttttcaccctgaatgttgaactatgaaatattattttgagttttaattatagtttaagtagcagttattgttttccaaacaaatgtatttcataaatgtgccaaacttaaattattcttgaactttttcagaaatactaacattaaaggaagtatttcagattgcaagtaatggtaagccctataatttgcacacttatttcttgcagtgatgtatttgtttatcagtgcatatctgtggccagattctttgtaataattgaaaaaaaaccaattaaaaataagtgaacattacttaaatcagtattgctacttaaattacactgtttatacagtgtaatttaagaaaaatcttaaggaaattaagtcttacaggttactatcttcataatgcctaaagaggtagtgtaatattttacccttcttgttcttttatatatcccaatttttctttaatgagtgttatatatatatatattttaagatacagggtcttgctctgttgcccaggttggagtgcagtggcttttcaagccacaatcatagcatactgtagtgatcctgctgccccatcctcctgagtagctgggactattggcatatgccactgtgtctaagctgcgtttgctatttttgtactagaaaatactttaaaaagctttagtgcattagtttccttggaattaattttttaaaaaccaatttgagaagtagacacataatttaggggaaatttggctgtggggaaaattgagtgcagtggtcatgtggtaggaaattcttgctttagtacgtttgtggaaaggtgcacatgtgaagaccattgaaagcatttgtaagttttgaaaagtactgttgtattgttaacactcatttcttttttccagatcatgatgctgcgattaatagatatagccgtttatcaaaaaaaagagaaaatgacaaggtgtggtacatatttattccttcagtgtcataattaactattcattaggtggtttagtttttcctctatcaaaatagagccagcagttactttgtatgttttgttatattactattagtttattctttccttctagctgttcaaaacctttctgataatcattgacctctttaaacaaaatattttcttctgccaaaatttgatgttataagtaaatataactattctggaaatttaactgatgcccagtatataacattgccttttgttgctttgtattttgatgacatggcattggttctgtttgaatatataggtgtgttcaaaaatgtcttctgagatagagtggtcacacacataatgaaattctgttatgaggccctccttatttatagacatatatatcttttgatatttgttcaaggagtgaaatacagaaatattacactatatttgaggagaaatgcattcaagtaaagatgagagtacagagtattaacaggtttttttgggcgtgccttaagatcatgtctttctccagcatctagtccaaggcttgatgtgtaggtctttctagatgcttgtgactgaggtgatctctgtgcctgggtgttggtgtctgcagccttggctgcagctgctggtggaaacacagtgactgcttgtgggaatccacagttgggtaggatttactgtgcaacagctactgtgacaaaggaaatgtttctcacacaaagtttagtacaaagattgatttccttttcgtttctaattttagctgcagactactacttaatggtgtattgataaaatgtatacatttgagatctctattagtcacttggccttagagaagtagttaaaggctctgggtataaaatttgatatattttacattacttctggctgctcaaagtattttaaaaaacactctgtcaccaacttcattttatttaaaaattcattgagcacctaatatacgtcaagcagtctgttgggtaccttgggggaacaacatgaataggcttcactcctgccctcaaagactggatactccacatttattgaaggctacctgtgtgaaggcatgcaggtggactaggaaccagagtacaaggatgacaagaaggcatgaattaactctgttattagttaaatacaataataggggttttaataaaatgctgagagagcacagagagggcagcagttcactttgattggtgaattgggaaaggttacactttttttttttttttgagacagggcctcattctgtctcccaggcaggagtgcagtggctccgtctcggctcactgcaacctccgcctcctgggttcaagtgatcctcctgtttcagcctccccagtaactgggattacaggtgttagccactatgctcagctaatttttgtatttttagtagaggtggggtttcaccatgttggccaggctggtctcgaactcctgacttcaggtgatctgcctgcctcggcctcccaaagtgctgggattacaggcttgagccaccacacatggccagcaaaggttacacttttagaaggtgacatttacattaaagataagtggataacaccagtttggaatcggagagagtgctttcctgaaagaaaaacagcctttcagaggcacatggtggagttgggagagtgtaaagattaagagtactctgtgacaataaaggaaatgttaggagatatggcagaaagggtaagaagtatattagtaccagattactatattaatgaccttgaaatttgtgttagagggagtggacagccgccaaaggattctaagtaggtgaataacatcatgcaattgtgttatagaacaaacatactaatgaaaatgtgaagaggacaagactagaggatatccagtgaaaggaattggaatagtttgcagagatacaatgaaggcctcagctaaggttgttactgaaaatggagaggaaggagtacttttgggagatatttttttaagtagaattgacaagacttgtggtaataggaggaataaaaaatgagtcctagatttcttggatgtctggatggatcctgtagtaattaagaaaggtaagaaacaaagcagaagaacaggttttgtgtacaaaactatcttcagttttgtacatttttagcacataaacacacataaagaacccagctggagatgtgtttactctgtcacttgggaaggtgagagggaggagataaaatttgtgagtcattgagtcattggtgtattggaatattagaatattcttcgtacttgaggattctaaggaaagcaggaaggcagaagaacctaatgcctattacataataggtattcaataaatatttgttgtctgaataaaagaactctagggagcacacgtatttcaagtatgggtgaaggaagacaagcaagtgcaagagaggaagactgatagggagagaaccaggaggggagaatggtatgctgtgaactgatcaaagtcaaagactaatgactaagctaataacaaacaattgtctgccattcctccttgtcgtaagctttctctgccatgcttagtttagttattgtaccattcttagttacgtacagaattctgttttcaatatgcatttttttttttttttgagacagtctctctctgtcacccaggctggagtacagtggtgtgatcttggctcactgcaacctccccctcccagggtgaagctattctcatgcctcggcctccccagtagctggaattataggtgtgtaccactgcacctggctaatttttttttccatttttaatagagtcggtttcaccatgttggccaggctgttcttaaactcctgacctcaagtgatcgtcccgcctcggcctcccaaagtgctgggattacaggcatgagccaccacgcctgggctcaatgtgcattttgtaaattatgtggttggaagttaaacaggaaaatttgcttaaccagtatgttgaaggatttctaaaagatcagaaaacaggaacattaatgctcaattgcttgtgatactcaattccttgggtaggctcttctccacagctcctactgaagataatacaaaattaagtaaataatagcagattatttacttaattatttaaatcttttcattcaaaggtgaagtatgaagtaacagaagatgtgtacacatccagaaagaaacaacaccagaccatgatgcattatttttgtgcattaaatactcttcagtacaagaagaaaatagcattgttagaacctctacttgggtacatgcaagctcaggtaaatactgtactgtatttggattataactgtcctaaaagttttatattaagcttgatatttacattaagtataagggtattataaactattttcaacatccttgtttatgtctgtgttttaagaagttatttttaaaatgtcatcagactattattttaaggaagttaggaagaatggttttccttgcaaatgaagatttcaaatattttaggtaaatgaaaccacttgttcaccatagctggggactgagagaactaaatgaatttcagagttacacctattgctagagcttcaactaaacacttgcttcataatagatctgaaaaagaataaacaagtttgagtttatcccatattccttgcatacttcctgagttaaaaataatagatgaactccaacgtgcccaaagagtacatcaggaagggggctagaaaatttgggtagtataagacaaagtgtcagtctcctaaaaatcaagagcttaaagaaaattgagggcaggcacggtgccttatgcctataatcgagcactttggtaggccgaggtaggaggatcatttgagtccaggagtttgagactagcctcagcaacgtagggagaccccatctctacaaaaaatgaaaaaattagctgggcttggtagcatgcctcggtgatcccagcaacttgggaggctgaaatggaaggatcccttgagcctaggaggctgaggctgcagtgaggttttattgtgcagtctggatgacagacgagaccctgtctcaaaaaaaaaaaaaaaaaattgaatctatttaggtaaaagagtactttactgattattcctcagatagaaaacttatctttgtagtaaacatgaaatactttatataatttattggaaatactttaaaatttattttccaattttaaaagattgttaaccatatgtatatattacttgttccaattcaaaaaatataaaaggatatgcagtggaatttaagtctaacttccttaatggctccctgtgcagtagaagtcacaaactacaatgtatttttacacaaatgggaatattcctttgttttttacttaaccatgtgtcttagagattgtttatatgatttactttaagtattgcttaatctatttttgtattgttcaattccccccactccccactctccagataagtttctttaagatgggttctgaaaatcttaatgaacaactggaagaatttttagctaatattggaacaagcgttcagaagtaagtatttttttccttaaaattgaaaatgaaatgatgtgaatgataacagctcaatgacataatgtaaagatatttatcatttactttcctgagggaatattttccctgccatgagagtttcttatgtggttcatggttacttcttgtttttttttaacctcttttttccacagattgtgaactttgaatttcataatagtgataattttattgattctacactcagttttatgtctgaatataacagacacataatagtaactccccataagtgaaattatctttaaacttgaaattgtgggagtttgatgggagattactaaatattgtttccaagccatgaaagcttagagagaaagcagttcttatcaggttcaaaatgccgagcagtgtatgtggtcagtccacggtatggagagagatgaaagtgattgttgttttaaaggcacagggcagaacagtttgaaaattacgccaaaatcaggcattcggggggcttcatttgttttttgaatttagtattgtttccaaaatatctaagtttcaaataaactgtaaacctgttttaaaatatattcgtgttgttttaaccacccatgccgctcttcctctctttaagaaaacatacccgaaacaaatatgcaggtaaacatgattggtaaggagttctttattggttgtgatttgtagcaaataatctgttctgtgtcagtgttcgcagggaaatggacagtgatatagagaccatgcaacagacaatagaggatttggaagtagccagtgatcccttatatgtgcctgacccagaccccaccaaatttcctgttaatcgaaatttaacccgaaaggctggataccttaatgctaggaagtaagaaaactattgttatttttgtatattgtgtatcatgtaagacaataccaaatgaatatagtaaataattgatgtctgtcatattttgatttttattaaaggttgaaactttttagaggtgttagtatttatgtgaactttttgacagatgaagtacatgaatacttttcagaagtaaaatcctacctagatatttattgaataatgtagaatgataaaagaagtgaaaccagggctgggcatggtggctcacgcctgtgatcccagcactttgggaggctgaggcgggtggatcacctgaggtcaggagttcgagaccagcctggccaacatggtgaaaccccacctctactaaaaatacaaaaattagctgagcatggtggcttacacctgtaatcccagctactcaggaggctgagacacgagaatcacttgaacatgggaggcagaggttgtggtgagccgagatcccaccactgcactccagcctgagggacagagtgagactctgtctcaaaaaaaaaaatgaagtgaaactaatttgagtttaaataaatattcacatattgtatcataacatgagaatgctatgaaatatcatttatcctactttaatatatttgtaattatagcaccaagtcaaatgttagttttcacctgatgataggatgaagcaggttaaccctagaaataaaataaattctgttgttttgaatttactcccttggaaattgaactataacctatattttatggatcattattataacagccacagtttgataatttccagccttgttttggaaactgtatacacattcacaaaagtgagtcaacatacatgaatttattttagagactgaaagcatatttatatttattttcttggcatcttggtgcctcttcgcaagccagttcattgtaacatgctttatcttgtgtctagctgatgatgagatttcaggtatgttgttattaaagagtgaatgtgctttcttcattcagtaaaacaggcttggtgtcatctacctgggacagacagttttacttcacgcagggtggaaatttaatgagtcaggcccgtggggatgtagcaggaggcctggccatggacatagacaactgttcagtgatggctgtggactgtgaagacagacgatattgttttcagatcacctctttcgatggaaaaaagttagtattttttttctactactactaatctatagtatattaaacttctgaaatgtgagataattcctttttgtttagaaattttatggacattttaggttcattatgtattaagataaattgctttttaatcttgtagaaatatattgaatttttgtctctggcttggttaaatggtttcttgatattttgaagttgtcaaagcaatgtcatatagtaaagacctgtgatttcatgttagggaactggaactgaaaatcctgcatagtatcagggaagacagaacaagttaatggaaagagtcctaaacctggggtcagaaggatcaaactctggatccattacttactgtgtggtctcagacagtacagaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaatcccagctctttgggaggccaggcgggtggatcacctgacatcaggagtttgagaccagcctggccaatgtggtgaaatccagtctctactaaaaatacaaaaattatctgggcatggtggtgggtgcctgtaatcctacctacttgggaggctgacacagggagaattgcttgaacccaggaggcagaggttgcagtgagccgagatcgcgccactgcattccagcctgggtgacagagtgagactttgtctcaaaaaaaaaaaaaaaaaaagatactatagctcactatcctttatcaaaatggttgtttaatttcacattccttctacaaacatataatgaatgccaatattgtgtggatttatcacactagatgttggaatcactgtattcatttatcaaaattaccaacttgttaacatgttacttactattaagtatttactttttgcttaatgcttaccatgatttcccatttcacattcctggtgtgatgcaaaattaataaaaattattattttctcaaactctaatatctatagaaaagcgaaataatgatatgttagtgattaacattgaaatatttgatttaatattaaaggagaaataatgaagtaaagttttttctattaggatcattgatgtatatttgaaatatatatgagttcataatatatatgaaatatatatgataagttgaaatgcattgccttcactgaaatgtaactttgtcatggtctgtcttctgaggatcagcacctgttccctttttggtacatcttggcatagatagtcaaagtcagagctgttaaagtctgcatcctgatacctctggtggtctccttttcctaagataccgttggttgtgttttgtttttgttcttttaatatcgatttttatatatgcctttaactttaaagattaaaaagttacctcggattatgttgaaaatacttttttaaacagttgaggctcaaacgtctcttctcttccagatcttcaattttgcaagcagagagtaaaaaagatcatgaagaggtaagattttacctagttcatttcttcattgacattttaaaatatttttctgatgacaaaacatatattaatgtgttcattgtagaaattttggaaaatcctagttaattaaaaatctttctttttcttttttgtttttgtaaaagtctattgtcctcgagcaatattcttaagtttctcacagaattttatagtgggagggaccttagagatcatctctgctattttaaaggctcagattgagaaatgaccttgtgactgttgctgtctggcaggctgttagtatcatgaggtgacagtttaatttattcccttctctcaccaatcctttgagacactatttgctacactaagaacatagtggcagcagatgtgacatggcaggaagcaactaaagctgaaaaccttggagaaatgaaagatagaaaaacaaaaatttgggagtctctgttcttcctcatgagccttttatttttggctccatttttactcctagtatatcagatatggaaggtaaggtattagcaataattgatgcttcaaacctttatcttgagaaacattcttccatgaaaatgtatcttagcttgatttttagccttttaatttggcattataattgtgttggtaaaagataaaagttggaaatgctatagagatctacctttatttacttcttatggaaaagagtaatattaaaacttgcttttagtctctgaggaacacagacaaatgtctctgttctctgcatagtttgccaaacaaaatatttgtttagattagtgaggctctttgggcacttgaatcctcgagagtgaagcagaagatgtagagcagagattgttttctatgctaattatttataaacttgacagaagggaggcatgtaaaatatattcaccaagaatatatttatcttttaaatttttttacatttgtgttaattatgatacccgagttcacactgtcttgtttggtggggattaggaggggaagtgatataaaaagataaatatagattattaagtataatttaacatgattgctatattttttattgccttatatgaattaaacttgagattcttacataaatctactaaatgttttcatatatttaaataataaaaatgttgaatgtgcttttatatatatttatatatatgcaccctccttatgaaatgttttcttataaggaagataaatatattacttctaatgaaacatctgttatgaaatgttttcttataaggaagataaatatattacttctaatgaaacatctgttgcagttgagtattgaacatttgcctttacaagagaagctttgtagaaaaaaaattatatttttctattttttcctcttgcagtggatctgtacaataaacaacatatctaaacaaatatacttaagtgaaaatccagaggtaatatttttattttatgttacccagatctagcaaaattgagtaattttgtggcttacatgtttttattaattcataatttctcaggttctgtaattttttaatttgaccttgaatgagtagcttttttttttttttttttgagacagagtctcgccccattgcccaggctggagtgctgtggcctgatctttgttcactacaacctccacctcccaggttcaagcgattctcctgcttcagcctcaccagtagctgagattacaggcgtgtgccatgacacccagctaatttttgtatttttagtagagacaggatttggccatgttggccaggctggtctcgaactcctgtcctcaggtgatctggccatctcggcctcccaaagtgctgggattacaggcgtgagccactgtgcctggcctgaatgagtagctttaatgtgccatgaatgtaatgagtggtcttcctagaacaataaattatttcaaaagatactcagtcaaccaacaaatatttattgggtgtggactatttaactctgcgttgagcaccatgaagaaaggaaatacagaagaaaattgagccatggcctctgccctctaggagcctatctgtatggagagacaaaactaaaactttaagtaacatttcagataaaacaggatgtaactgaaagcatatggcgatgactaaaggcttaggttttgagaatagttttgagaatattaagatcagtgtggactttagagaaagctctgtggagatggtggaaacctgagttgggtaggatttgtttgttttgaggaaaagaagacacagtgcagataagagaaaaaaagaatacaaatgcagaaatggcaggtttatgaaactagcagtgtaattaaagattcttttttttgagacagagtcttgcggtgttgcccagactggagtgcagtggtgctatctcagcccactgcagcctctgcctcccgggttcaagcgattctcctgcctcagccttttgagtggctgggactacaggcctgcgccaccatgcccagccaatttttgtatttttaatagagacagggttttgccatgttggccaggctggtcttgaacttccaacttcaggtgatccacctgcctcggcctcccaaagtgctgggattacaggcgtgagccaccacgcccagccaagttaaagattcttgatagagaatacaaaactgaaatgtgcatacaagtcacttaggggtcttgttaaaatgcgtaatatgattcagtatgtctggggtgatacagcgtgaattcccagttttgcaaattatattttgtgtggcaaggatatcaaaccagatgaaccctgaagtgtagacacagccacaggtgcagtccaaacatacaggtagaacccaggggtacagagaattctggaaggagtcaagtaggtactgcagtatagttggaagaggacttgactctaggacaggagctgcctgacctctgccactcttagtgggcctgtccgtgctatgggagtccaggcaactcctggctgatgatttcagctgaggctgggagggctaatttctttgggaggctctcactcttctaaattgtaatctgctgttgatgtaatggtggattagatgggaggcctagactagtttagtaactgattgatatgaaggatgaaagagatgactaaggtaaagatgacttccaggttttaaacccaagggaagagaagaagaatttgggaaagaagagttctgtttttatcttaacggctttgaggtgccagctaaggaatgcctaggaggaagttttgaaccatagaaacaaaatctcatgacctccaaaatactcgtaatttgttagttttataatgttattatatttacattgtaacatatttattacaattatgtctaataaaataaattatgagtttaattacggaaaatcagtgttaactatagagaaggcttttgcttttagtaatttgatctcctgccaatctagcttttcctttttgtaaggttatttgggaacaacaaaaaataccattaaaatacaaattaaataatttattttatcatttaggtcatacagtgtttggatttgaatagtttgtaatacttacagtcttttactaccaattatcagaactctaatttttagttaatatttcctaggttatccagaattattttatctgtattagtgagaataggaattttgatcagtttttagcattgtattagtcattttgctaaccataagacacagaagtgcaaaattgttatgtgattattttttctaatttaaagaccatttttatggaatagtgcctgtagtctcaactactcaggaggctgaggggggaggattgtttgagcctaggagatcaaggatgcagtgagccataatcatgccattgcacgccagcctgggcaatagagaacgtatctcccaaaaaaagaccatttaaaaaattgtgaaaaaatctgtaaatttaccatgttaaccatttttaagtatacagaaatgttaactatatgtacgtgattaaaacagatctctaatttaaataccatttttatttagccagtattttaaataaaacagtaagtctaaagtatttcttatggaaagctttcttattttcaattttttggtctgaaaatatgacagctttataaattaataaacagatacttctgagcataaatatattctggaaaattgtgaaaactttaccagcatagttataaaatactcatattttgtgaatatttcctattccttctaaatttctttattcaacaaatgtatcgattgtccattgtgccaggcactgggctgcatgttagcaatacaaactttaataaaaaatatctggtagttaaaaatgtaaagaaaacaatattttctttaaaaatttaaagtgtgcaacacttgcagggaattttaaaaaattaaaaagcaatatctaataattatgtataagtagaaaatcagatttttttgctagattataggaagtaagaggaaatcagttatgtaccctaatattaagacgagggaatatagtactactttagtagctctaatttatattttaagtgtaactcagaagcattctaacaattcagagttacattcaaacttttggtttgcttactttactaatattagtccttttttaaaaaaattgaaataggaaactgctgcacgagtaaatcaatcagctctggaagctgtcactccttccccatctttccagcagaggcacgagagcctgcggccagcagcagggtaagttaccacactgagttatttaaagaaggagatgggctatttaaagtatctgtgatctgggattatgtttgtactgaaacttaagacttctcattgacttataatattgtgttttcttttttcatagtttgttaaatatttaatatccaaaagggaaaattaaatgcaatgccttcttgttttatgcttagacaatctcggccaccgacagctcgaaccagcagttcaggatccttaggatctgagtctacaaatttggctgccctctctctagattctcttgttgccccagacaccccaatacagtttgacataatttctcctgtgtgtgaagatcagcctggccaggcaaaagcctttggccagggaggcaggtgggtgatagcatcacaggtacattgtgctgtggtctgtaaggcttataatcccctgtctgcatttcagagtcatctcttatttataatgtatatcagctatgttgtactttctttgtttaattatgtaacatattgttagggaagaaccatgcaggtttttttctctatgtcttctgcctcagttaaggagttaagataatttagtttccaaatatttaattctgtattgcttattaggtctatttcttggatacttgctcttaaaattgcagaagaaagttgatagctgtctttaggtcatgacaatttttaaaaaattcttgagggtaatacatgtgatataggtttattagaaaatattatcttataccagaataagaaatcttcaggaagttactaaaacattatcactattatgaattatgaatgagtcattgtttagttgtatgatgaatattctcaccaaagcagttaaaatttttccttggctgtgattgaaggaaacatgacttaaggcaaatcatttattaagtagagtggacacctaataaactgataatatattaatttggatatacatggctgtgacccagaaaaagtcatttacatttgatcacagaaatacacttagcatttgatgtaataggacacatactaaagagattaatttcctgttatcttactgtcagtgtttttttagaaccacttagctctctgcttccaaaacctactttgttttgttttgagatggggtctcactctgttgcccaggctggagtgcagcggcatgatcatagctcactgcagctttgaccttctgggctcaagggatccacctgcctcaccctcctgagtacctgggaccacaggcgtgcgccaccacacccagctaatttttaaatttctttggtagagacgggttcttcctgtgttgccctagcagatctcaaactcccaggttcaagcagtcctcctgcctcggcctcccaaagtgctgagattacaggtgtgagccacaatgcccagccctccaaaacctactttgagttgtacttttcttccttcactgtggtgtgccacaagccatgcacactaaggaggaaggtagcttccatctccagttcacttttctttttgcattgttacttacgctttaagaaatacaggtttaaaactagattataggtaacttgtaacatgtacttacagaacctaaaaagaagtttttacaattccaggacattcttggcatttttctcaagcaactaagattgcagttaaataagtgttcctctgtgctagcttatttaaattcaagaacttttgcaacatggtttattatgttgattttttgttgtgtatgtctaaacttccaattcatctgtgtcttctaaagtgcaccaacattgatcagttagtgtgtgagggcagaggccttcatcatagtaatttagtgatcaatagtgtttcttaataggatggggcattttagagctttttttttttaaatgttaactgtggttttaataattagatttcttctatgtggctcatggtaactgaccatgtgttcatattttcttctaaactttttaggcgtacaaatccatttggagaatctggaggaagtacaaaatctgaaactgaaggtaagacagatgtgcagcattcatatattttagaactgcttctcagcaaactgtgaataatttattgtttatatttgctctgctactaagctcagttttaatgctatctttacttcagaatttcctctacttacttatagtacacttgaagcaacagaacttaatctgacttaagatgttgtgattcacacaaaacgatagactctcatacttttgactttatagtcaaattcagtgcctaagatacctttcaagcttttcctaacagctgatgtttctcttctggtactggagcataaattttgtttttccgccactaactatttatttgaattctaaacttacagaaatgctgtaagaaccaccagttgttgtgtgtttgtgtgtgtgtgtgtgtgttgagacagggctccctatgttgcctaggctggtctcgaactcctgggctcaagggatcctcctgccttagcctcccaaagtgctaggattacaggtgtgaaccaccacgcctggcctcagaactgccagttgttgaagcattacttttagctatttgaatttgaaaccctaattttcctataacttggaatactgtagttaggagttattttgaaatgtctcccttaggctgttgaatttttcactagaaaacctaaaaggaggcagtgtattttattcttttggaaaagaaatatggcgaaaaaaataaaatgtaaatttatacagtaaaaaaaaaatatgtaatacaccttgttctattatagattctattcttcatcagttatttattgtccgattccttggttcaatggaggtgaaatcagatgaccatccagatgttgtttatgaaactatgcgccaaatcttagctgcccgggccatccataacatctttcgtatgacagaatcgcatttattagtcacttgtgactgtttaaagtaagtaaaaccctcccttaaaaaactgtagaaaaaagatttacatgatttcagcctaattaaaatttgttttccaatttttaaattattattttaggttaattgatccacagacacaagttacaaggctcacggtgagttccacatgatttaagctttgttttaggtccctttgtatatatacacatcttacaacttgataataatcctgatcctgtatattcaagtgtgatagtatcagctatgactggtctttggctgttgtagttaagtctatggccatctccaaaaagttgtcattgaacattttatgtaacttaaaagaattaacacaattctttttgtaatttttttaacacagttctttttgactttgtaaaatgtgttaatgactaataaaacaaatgtaatattcaacaacctttttctgcttgttaattcaaaccaaatatgacattacttgtttctgcattacaagtctgttaaaataattggctttaatatattaaaatatttatatttttagaacttagcatatgagtttgtcacaagtgctgctgtaatgacttgtaagatctcatgtttgcttctgatgttttctgtggcagtttccattaccttgtgtagttttgtatgctacacaccaggaaaataagcgcctttttggatttgttcttcggacatcaagcgggagaagtgaaagtaatctgtcatcagtctgctatatatttgagtcaaacaatgagggggaaaaggtacatggcttttcagaatatctctgtcataaccacttactaattgattcttactaagatttaataataattaaattcttacaaattaaattagttagtaattactgattgaattctttacaatttatacaaatttatgaggcacatgtgaattttgttacatgtatagaatgtacagtaagcaagtcagggtatttagggtgtccatcatccaagtacaatacatttttgtgaagtatagtcaccctactctgctgtcagatattaaatatattctttctatcgtaatttatggttgtaccctttaatcagcttttcttcatcctccccctttcctcatcactcagccttcccagtctctgttgtctgtcattccacactctgcctccacgtgatcaattttttggctcccacatacaagtgagaacatgtgatatttgtctttttgtgcctggcttatttcacgtaagataatgacttctagttccatccacgttgttgtgaatgacatgatttcattctttttatggctgaatagtactccattgtgtatatgtaccacattttctttattcatttatctgttaatgaacatttagattgacttaatatctttgctattgtgaatagtactacagtaaacatgtgagtgcaggtatccttttgatacagatttctttaattttgggtagatacccagtagtgggattgttggatcgaatggtagttctatttttagtttttgttgttgttgttgtttttgagacggagtttcactctgtcgcccaggctggaatgcagtggtgcgatcttggctcactgcaacctctgcctcctgggttcacgccattctcctgcctcagcctcccgagaagctgggattacaggtgcctgccaccatgcccggctaattttttgtatttttagtagagacggggtttcaccgtgttagccaggatagtcttgatctcctgacctcgtgatctgcctgcctcagcctcccaaagtgctgggattacaggcgtgagccaccatacctggtctatttttagttttttgagagatctccatactgttttccatagtggttgtactagtttatgttcccaccaacagtgtatgagttccccttttttctgcatttcaccaacatctgctattttttgtctttttagtgatagccattctgactagggtaagaatggctcattgtcattttgatttgcatttctctaatgattagtaatgtcgagcatcttttcatatacctgttggctgtttttgtgtcctttaagaaatgcatattcatatcctctgcatacttttaagtgggattatttgattttttccctgttgagttcgttgtatattctggatattagtccccagttggatgaacagtttgcaaataatttctcccattcaacaggttgtctgtttactctgttatttctttggctatgcagacactttttagtttaagtcccatttgtttatttttattgcctatacttttgaggtcttaggcataaaatctttgccgagaccaatgtgcaggagagttttcccttcattttcttctagtgttttttttttctatggaaaataacctttttttttttttttttttttttttttgagacagactcttgctctgttgcccaggctggagtgcagtggcacaatcttggctcaccgtaacctccacctcctggattaaagtgattttcctgcctcagcctcccaagtagctgggactacagttgtgtgccaccatgcccggctaatttttttagtagagacaggatttcaccatgttggccaggctggtcttgaactcctgacctcaagtgatccacctgccttggcctcccaaagtgctgggattacaggcatgagctgccacacccagctggaaaaagaacctttaatagaacaattattgagaatatcgtactaacaaagtttctcaagagactaattagagctaaaatggtgaaagtaggatgatctttgtttttcgttttttgtgggtacaaggggtgtgtgtgtgtgtgtgtgtgtgtgtgtgtgtgtatgcatttttttttttttttccagatggagtcttgctgtgtcacctgggctggagtgcaatggcgcgatcttggctcattgcaacctccgccccctcgggtttaagcgattctcctgcctcagcctcctgagtagctgggtctataggcatgcgccaccacgcccagctaattttgtatttttagtagagacagggtttctccatgttggtcaggctggtctcaaactctcgacctcagatgatccgcctgcctcggcctcccaaagtgctgggattacaggtgtgagccacctcgcccagccaggtgtatatatttatgcagtacatgaaatattttgctacacttatgcaatgcgtaataaccacatcatggaaaatggagtattccttcccttaagcatttatcctttgtattagaaacaatccaattatactcttttagttatttttaaatgtacaattattattgaccgtagtcccccgttctatcaaataccaggttttattcattctattttttttttttaatcattaaccatcctcccaccccccatccccacactacccttctcagcctctggtaaccacccttctgttctctggctccatgagttcaattgttttgatttttagatcccacagataagtgaaaacatgcaatatttgtctttctgtgcctggcttattttgcttaacataatgacctccatgttccatatatcttattgcaaatgacagaatctcattcttttttatggctgaatagtactccattgtatgtaagtaccacattttctttatccattttctttatccatgtatcatccattcaaatgacagaatctcattctttttttctggctgaatagtactccattgtgtgtgtgtgtacattttctttatccattcatctgttgttttttttttttttccattcatctgttgatggacacttaggtggcttccaagttttaactattgtgaaccgagctgcagcaaacatgggagtgcagatgtctcttcaatatactgatttcctttttttaggtatatacccagcagtgggattgctggatcatatggtagctctatttttagttttttgaggaacctccagacttttctccatagtggttatactaatttacattcccaccaacagtgtacaagggttcccttttctccacatgcttcccagcatttgttattgcctttttgctataagccattttaactggggtgagatgatacattgtagttttgatttgcatttctctgatgatcagtgatgttgaggaccttttcatatgcctgtttgccatttgtatgtcttcttttgaaaaatgtctattcaaatattttgcccagttttaaatcagattaaggtttttcctatagagttgtttgagctctttgtatattctggttattaatcccttgtcagatgagtagtttacaaatattttctcccattctgtggcttgtttcttcactttgttgattgtttcctttgcagtgcagaaactttttaacttgatgagatcccatttgtccatttttgctttagttgcctgtgcttgtggggtattactcaagaaatttttgcccagactgatgtcctggagagtttccccaatattttcttgtagtagtttcatagttcaaggtcttagatttaaggctttaatccattttaattatatttaaaaaaatttaaaaaaaaataaaaaaaataaaaaaaaatttttttaaaaaatatttttgtatatggtgagagagaggggtctagttttattcttctacatatggatatccagttttcccggcaccatttattgaagggactgtcttttccccaatgtatattcttggtgcctttgtcaaaaatgagttcgctgtagttgtgtggatttgtttctggattctctattctgttgcactggtctatgtgtcttttttttttttttttgccagtaccatgctgttttggttactatagctctgtagcattgtaatttgaagtcaggtaatgtgatttctctaattttgttatttttgctcagaataactttggctattctgaatcttttatgattccatatacattttcagattgttttttctatttctgtgaagaatgccattggttttttgatagggattgcattgaatctatagattgctttgggtagtatggacattttaacaatattgattcttccaatccatgaacgtggaatatgtttccatttttggtgtcctcttcaatttctttcatcagtgttttatagttttttgttttttttgtttgttcttttgagacagagtctcattctattgcccaggctggagtgcagttgcataatctcggctcactgcaatgtctgcctcccaggttcaagtaattctcatgcctcagcctcccaggtacctgggattacaggtatgcgccaccaccacctggctaatttttgtatttttagtagagatgaggtttcaccatattggccaggctggtctcaaactcctggcctcaagtgatccacctgtctcggcctcccaaagtgctgggattacaggcctgagccactgcgcccagcctgtagttttcattatagagatctttcactttggttaactcctgggtatttaattttatctgtggctattgtaagtgagattactttatttatttctttttcagattgttcactgttggcatatagaaatgctactaattgttgtatgttgattttgtatcctgaaactttactgaattcatcagttctaatagttttttggtggagtctaggtttttctaaatataagatcatcatatcatctgcaaacaaggatagtttgacttcttcctttacaatttggatgccttttttcctctcttacctgattactcatcttccatctaaaaggtggaaaggctttttgtttttctgcattcagtatgatactagctgtgagtctgtcatatatggcttttattatgttgagctatattccttctataccaagtttttttgagggtttttaatcatgaagggatgttgaactttatcaaatgcattttcagcagtaattgaaatgattaaatagtttttgtcctttattctgttgatgtgatgtagcatattgattgatttgcatatgttgaactatctttgcattcctgggataaatcccacttggtcatgataaatgatctttttaatgtgttgttgaatttggtttgctagtattttgttgaggatttttgcatcaatattcatgagatatattggcctgtagttttctttttttgatatgtctttgtctggttttggtatcaggtaatactggcctcgtagaatgagtttggaagtattcccttctcctctattttttggaacattttgggtaagattggtattagttcttctttaaatgtttggtagaattcagcaggaaagccatcaggtactgggcttttctttaccaggagactttttattatggtttggatcttgttacttgttattggactgttcaggttttggatttcttcgtggttcaatcttggtaggttgtatttgtctaggaatttatccatttcttcttgattttccaatttactagcatgtagttgctcatagtagccacgaatgatcctttgaatttatgcagtatcaattgtaatgtcacctttttaatctccaattttatttgagtcttctttttcttagtctggctaaatgtcagttttatcttttcaaagaaaccaactttttgttatgttgatcttttgtattgttttcttcatgtcagattcatttatttctgctctgatccttataatttcttgtagtatttttatagttttgggtcttatgtttaagtctttaatgtattttgagttgatttttgtgtatggtgagagggaggggtctggtttcattcttctacatgtggctctccaatcttgccagaaccatttattgaagaggatatcccttccccagtgaaagttctttgtcacttttgttaaagatcagttggctgtaaacaagtggcttcgttcctgggttctctattctgttccattggccatgtgtcttatttttataacaatcccctgctgttttgcttactatagccttgtaatatattttgaagttaggtaatgtgattgcctccagctttgttctttttgtttaagattgctttggctatttgcattgaacctatagattgctttgggcaatatggttattttaactatattattctgatccatgagcatgggatgttcttttgtgtcttcagtctctttcatcagtgttttgtagttttttgtgtaaataaaattcttatataattctaagatttttggaaaaaactcccaaattttgcctaggcttactgagctgcttgagcaaagcatctctgaatagagccaagctgatggtttgggccttctgactctacagacccatgttttccctgccactgatagctggtgcaatcttttagcctctcatttatgttgggaaccaaacattatgttgggaaccaaaaccagccattttcagatgtcttcagctgagaatagcattagcagctgcatgcttcttcctcgtaggccttactgtgacagtaatgaatttgacataacaagaagtggggtatatatgaaggtgagagtcagcagtggaatcctgtagacttcaaggaaaacatacaaagccttggtttgggggcttgagcattcttaaatatgcttttgcttgaagcaatgtattaggattagttataaaactagttccatcagttatttggatacttgacatttttgctttgttgtgagaactgcctgaatttttcatactttttctctttttagatatgtgattctgttggactggcaaaacagatagctttgcatgctgaactggtaagaatccaagatgtggctgggcacagtggttcacacctgtaatcgcagcacattgggaggccgaggcgggcagatgacttgaggtcaggagttcgagactaacctggccaacatggtgaaaccccatttctactaaaaatacaaaaattagttgggtgtggtgtcgtgcacctgtaatcccagctactgaggaggtctgaggcacgagaatgacttgaatccgggaggcggaggttgcaatgagccgagatcacaccactgcactccagcctgggcaacagagcgagactgtatctcaaaaaaaaaaaaggaatccaagatgcttgattttccaagaatgttaactaaaatagtatattagctctttcatattagcaagtaaataaaatgattttgctaagcaaggttaacagtgatactattaccaacatagcatttagaatttggataattgtttaccattgaatataaactgttgatgtgctttcttatgtataaatgcaaaaaaatattgaaaggttaccatgtgatattaactgaaatgtctaaaatttaaagttatttcatatttaattcattagttttattcatctgttctttaggatcgtagggcatcagaaaaacaaaaagaaatagagagagtaaaagagaagcaacagaaagaactcaataaacaaaaacagattgaaaaggtatacagtcctaatgtctggatctttatgtgttgtttgtgaagacttaattcagcactatgactttcagatttgaatttccaaatgaagggctgtttctgcttgttcagccacttcataaacagatgattcataccatagcagaaaagggtcacatctgttttttgatatgatgtttacattatagttacgttgacatgtaatatgactgtttcaaaaatataccagaactttaatatttcagaggaggttgtctctgtcaaagcagttgagaggctgtgtagacttaactgccattgctgaaagccattttgccttctatgggggggaaataaataaatatatatgttatatgaaatatataatgaaatgtatatttttaatattgccaggagtgtcaaatcattgtccatccaacagaataattttaaaagacaaatttcagagcaaaacttgaagaatgcattaaatgatccatgaaattgtaagagcgtgttatgggttgtagattgacagtaggaatagaaaagaggagacagctgggatgcttagaacagatcaataagcattggctgtgggctggctctctggacaaagaagagggaagtggcaaagatgacattgaagtgaggctttcttgataggcgaggctgagggaaggtgacacctgatttagcaaagatgaattggacagggatggagaaaagggctggagaggggaagggaaaggagtgtgggggtgatccctttcgagggttttactataatatatagtgagagatgattgatgatgggctttatttggttgttggtcataaaaaaagaaagataaaatattagattttagtttgaatgctggcttttataggatggtgccaaaattcattttggtgttgtattgtttgggtgtagcttttctttttatcaagttgtcagaagtatgcatacatatttatgacagaagaagtggctctcaagaatgtatcttaactgcataatttgccatttgactgcagacaagtaacttagtttcttttttgtcttttccactaggacttggaagaacaaagtcggttgatagctgcttccagtagaccaaaccaagccagtagtgaggggcagtttgttgtccttagcagtagccagtcagaagagagtgatttgggagaaggaggaaagaagagagaatcagaagcataagcttatacttttggtagatattcccccttggaatttgacagtttctatggtgaaatggcagaaggtaacaactatgttgaaatatcaaggaggagattaagctttatatttgcttatttgttgtagctacattttaaaaaaaagattgaacttgatgacttaggtttgcattgatcttttttcccccttaaacataatgtactatgtattaacatctaaaggaaacctgctcatctccctgaagcagactgctgaggaattacatttgctcaagaattttttccgtcaaattgtgaacttttaattcttgcattgtaattggctgtgtccataagaaatcatttattcttcaggcttagacattcatggatatgcttttctttcattaggaacattttgctggtgatgaggaagcatttagctgaataagtttaaagccctttatacagagaattctacaagtttgcaaatattttaacaatattaaatgtgcaatagaacttttataaaataattagaacagagattttacagttaaggtttcaaattgtggcaggtggtactgttgatctcagggtactttctgggattgctcacatttctctaatgtactgcacttgatgccagtaggaaagaagcttaagtgtcttcagttcaagattgatagagcccttggcattttattatcacattcttagttctcaggttgggacttcaattactgctgcagagcagtagtggttaaaaataagatattggaatttattaaaagatttttgttcaatacattttagattaggattgacaagtaaagatactgctatggaatgatacattgtattttctgcattgtgtgaaatagtttttattgaaagtcaagtgacatttcaaaagaagttctataacaattatgtttcatgcttaaagtaaaaattcccagagtttagtttagaaaatgtaatcttttaaatttcagactgatatattcccagtattttcataatgccatgttttgataaagtactgaatcaccactttatatccacaaaggcaaataactaatgtatgataatagaataatttgcactaattattgtaaatatgtctactcttcaaatgagtaaaaggtccaattttgtgaaagattgaaaatgaattgaatgcctagtagagtataggagaagttgaccaaggaaggatttaacctggtgccaaggttaaaataacatttctctactgcctattgtttatgttaaaccttaattttttttctgtaatcacttttaacactgctaatagaaattatgttttcatgtgtttcacatgaaaaagtatatatatacaaagttaatatagtgggtaaaatactttacatagtcacacatttacaaatttttcaagaggttagccactaagactttaataattttacaagggaaaaagcctttttttttctttgatatacagttttttcttcttagttctgcattagaaatggcatctgttttaggtctcaaaatataactcggctgtttcacactgtatatgtacattgttttctgtaggaataggataatgatatataggatcatgatattccttctatccatgtgccaaatgggtgtaatgtttatttactgatgctttatgttaccaaaacatacagtaaaaaagtagaaatttatgaaatacttttgataaaaagtttattttgtgcttaccaaaaggaatgctttcacaatagtgtatcagttcttttgttttgttaaagttggaatttattctgttgccagcatttaagtagtcatggcaagtcctgtttttaagaccttttggagactggagctttctgttccattaagtcttttgtttatactacaaattgtcacctcacttagttcagatgaaatctgttactctacaaggaaggtgttcatcattaggaggcagctttactaagctggtgctttgcatggtagcaagtgctgccctttatcagcaccctgggtcatagtgtaggctagagttaaggcactggcagacttagggatgctggacagacctgtagttcgttttaagtcatgttcacaggaatttctacaataataaacccatcatctccataggtcagatcgaagtgcattccaatgctaaatagaagttatgagtgggtttaacaattttagatgattcagcttttgttccattactgttgaactatatgaactattccattactgcagagatttaagtatctgttttaataagctctttttgttatttaaaggctgcccatgggtttctgcctagtggtaaagctgattgttaccctcctttgaaatcccttctagttctgagatgctttgagggtaactggattcgattttgggatatcttttctcacattcagacttacacttaatggtgttagaaatcaacaaaactcctttttaaaaagaaaagatattaagcctgcctacttctacaatgcattctgttacctatttgaacagtatgtttgtaactatggcaatgaagtcagtagataggaaaccagttattccttctacctttaaaaattttgagaacttgccaaccagggactaaagctattatcttgaacagagtccctaaagctagtctagtttttgccacatctgcaatgattattgtttaatttcaaaagaatcctcaggctctacaatctaggggtggtaaatgtgtttccactatacttgggaaaaggtcagtaggatgtgcatcctagggaagataaaatcgtatatggtaaaggcatttgagttaattttgcattatatctaggaaccatattatttaaaatttgaatcctattaatgctgagagatcctaagagctagtatgttgtaaaacctgccacctgaataaaatgaaaaaaaaagtgtttttttgagacagagtcttgctctgttgcccaggctggagtgcagtggtgtgatcttgggtcactgcaaactccgcctcccaggttcacgccattctcctgcctcagcctcccgagtagctgggaccacaggggcccaccactgcgcccggctaattttttgtatttttagtagagacggggtttcaccgtgttagccaggatgttctcgatctcctgacctcatgatccgcccgcctcggcctcccaaagtgctgggattacaggcgtgagccaccgtgcccggccctaaaatgaaattattaatgttggttctgaaacaacctcttagcattcagattgtattttaaatacttaaacacaccaattgtagaaagcaaccctttatttttagcaagtttggtttactcttctcccatgagattttgtctttctacattaactagtaagacataaagatttgaaactggaactatattatactttttaaccaatctctgtggcttcactcatgaaatttacttcagttaatatgagactgggggttaagttgtaactaatatgcaaaattgctttgtatatttggtgattttgtaatgtaagtgaattgattcttatttcactgatactattaatcatgcagtgtacaattcaaaatcatgcaatgtttcactttagaattggatttgaagaactcgactttatgtgatcatggtattggtatacatgtggggtggagaacttattttttcattttgtcacaataggtatatactgacaaggcttcaggaaaaaagttgttagaagattttttaatgtataataaagtccatgatttttgtacagtgttttttaatgaaatatttgatactctgaactttatttctcaaagtaatttcagatgtttgtaaaacaatggacttcttaagctgttatgacattataaattatacagctagcccaactataattccacagcagctaaaatgaaaaaaaaaagtcactttattgggaaaagtttgttatagaagcaaactaatcgatcactggtgactgtttttcttttagcaaaggaaaaagacttcattaattgacgtatacttgctactgtttggtcctacttacagaaattcctctaatttacaggggcaggttattgtgcataccacagtatagcttggatttgtaatttcaatactaatgcatattcatcccatgtgctctttatagtttcttatgtcaattagttactttcttctgggatttagtgttttgtcttggattttatagaaatgtatatatacttttagaaggtacagggaatagatgaaattaactttagaattatataatttatctgatataagtgcatgtatagcctaaatatatttctatattgaaagatataatctaccactcacttaccagtttgatttaaaaaataactattcatgtcagctatataaattttttaatgtaaaaaaactataaaaataatttaaagtctgtgcttactgaaatagtctatatagccattaatccctacactagaaaaaaaatcatatagcttcagtttccctagaatggactatctaattcttttaaaaagtaccaagactaaacatgtaaacatcaaggccatagctgactgggctgtagtgaaaatggacgatatcattctacctgttttccctgttgatatggcttctaaatgtgacacaagtatggttgaatgaatgtctttttcagtttctttcctcactttccacacatagaaatgtatacttacaggcctggcacactggctcatgcctgtaatcccagcactttgggaggccaaggcaggcagatcacttaaggtcaggaggtcgagacagcctgaccaacatggtgaaaccccatctcatctctactaaaaatacaaaaattagctgggtgtggtggcacactcttgtgattccagctactcgggaggctgagacatgagaatctctggaacccaggaggcagaggttgcagtgagctgagattgcaccaccacactccagcctgggtgacagggcgagactccatctcagaaaaaggaacctatacttacatgcagtttgaaatatacagaaataaaaatttaacgtaactgccatcggtgagcctcttcatgtccattatcaggctaggttcaatacagaaaccataagccatcattcatttgaaaacacttgtaattccaattccagtgatcacattaaccggtaaatggtcagccatagccaggattttgtggaaagaagggacacacatttctcaatattgaaatttcaattgagggttctatttcaattaaatgaattaccctacctctgtacttgactctacaaagaaacagtaatagacactaagctggtattgggactttcccacaagaacagcaaactcctgagtcatgtactggggtaagtatatattcagtccaatcactgaaatgtacagtaggccccttatcgctggtttccctttgtgtggtttcagttacctgcggcccaaaactattaaaaggaggctgggcacggtggctcatgcctgtaatcccagcattttgggaggccaaggcgggcggatcacctgagggtcaggagttcaagaccagcctggccaacatgatgaaaccccgtttctactaaaaatacaaaaattagccgggcatggtggtgtacacctgtaatcccagctactcgggaggctgaggcacaagaatcgcttgaacccgggaggcagaggttgcagtgagctgagatcatgccaccgcagtccagtctgggtgacaggacaagactccatctcaaaaaaaaaaaaaaaaa

SEQ ID NO: 12681 - DNA, 34544 bp, Human
  misc_feature (1)...(34544): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatgagaactgcttgaacccgggaggcggaggttgcagacttgagaccatgccactgcactccagcctgggtgacagagcaagtctccttttcaaaagaaaaatgaagattccctttcattttttaaaaaaattaaatcagagtaactgctgaattttatcaatggctttccacatttgataaacaatatattgttaaaaccataccggcttttctcctttaagctattagaactctaacgcttttggttcaaggctttaagctcttaccagttaatatagagatacttttcggagtgttaacactttaaagctatcaacagccatttctcctcagtctggctgatggtgcagaaaatcagaggagccataaggattcaagtagagcctcaagggcacaaacaggttcagatgggagaagacccactggctcttacctgcccgcagatcgcaggcgcaggagaaaataagacaactgcactttccccttttggaccctgctccgctggtttgcagcctggaaaaactcttcctcccctttcatcctgctccctcaatctctgctcgtgaaaatcctacccatttttaaacgctcaaattaaataccaccttctcccactgagtcttcccagatcccctagatgtccctccaaatccctactccttaatgccacatcgtatagtgtgaaaccccaccgcggcaggaatcacttaactgtcccgtgtagaatcaccgtttatttctctctgtatctccagcgcctggcagtgtgcctggcatacagtgggtgctccttccatgctgaaagaaagactgacagacgggaggtgtgcccctctccatccgtctggcccttcccgccagggccttgcagggcggactccacctcggcagagggcatcccagacccctctccagccccggaagccggattgcctgccatgggaagactacacttcccagcgatcccagggaaaagcgaaaaccttttggctttgacagccgccgccacaagtctttccgcctccccagcccgcccgggagctgcgagccgcgagctggattatggtggcctgagcagccaacgcagccgcaggagcccggagcccttgcccctgcccgcgccgccgcccgccggggggaccagggaagccgccaccggcccgccatgcccgcccctcccagccccgccgggagcccgcgcccgctgcccaggctggccgccgccgtgccgatgtagcgggctccggatcccagcctctcccctgctcccgtgctctgcggatctcccctgaccgctctccacagcccggacccgggggctggcccagggccctgcaggccctggcgtcctgatgcccccaagctccctctcctgagaagccaccagcaccacccagacttgggggcaggcgccagggacggacgtgggccagtgcgagcccagagggcccgaaggccggggcccaccatggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacggtaaggtggtcaggccagcccttagccctccgcctgcatgagcagaggggagacaggatggggatgcctcaagctagcccctgctcaaatgggctggtggggacagcaggagggacccctccccagccattccccgggggtcacgtggttgttggcagaagtgttcccaagctccccattccctcctcgtctcccctggctgcctagttccccttgctcctcatctgacacatacgccgtctggaaggatttgaggcaagacagacacatcagctggggaccctgacctggaggaagggtccgccacaggggcactataacaggtgtcagccccctctgacagtggcccagtccgagtctcccaaatcccaccactctagaggttggccacccaaccttgtcccctcctctgattcccaccattgttcccagtacctccaggaccaaggaatcctggcagcagttgaataagcaccttgctcccaccatctgggctgccactggtacggcaaagtgaggttgtcgaggcccccctgactgcactccgcccggaagccctggacaggctcctgccgtcccctcctcctccccttctccctctcgcggtctacactccagcccctcccccaccccacacctccccaggccagaggggaactgaactgagcctggtgaaagaacaaatggtaggaaaggagccagagctcccttttaagagtgggactccttccatggcgggggagaggggagttacagagaaaacactgttatgccctccccatccttcctgacaatctccaaggtaccttcaaggtggctggtggaggtggcaccctctgcacctctgtgggtgagcagccctccatgtggggtgctgtggctgacctctgtgtgcatctgccgcctctgtggggcagtccgggcccgggcagccctgtggttctgtgtatgctggtgcgtgtcaccttgaatctgatcctgcacatctgtgagccacctccggatctgtgtctgggaagtctgtccttgggagggtctgtgaaggtgggagtgtgtttggggtgggcggaggggacagccacactttcctgaacttctcagacagctggatctgggagaaacacaaacccccacctcccaattactttacagaagccagccttcctaggtgcgtgctccccagccctacctctcagctagtcgaaagcctggtcttccccactttctcatcctctttcctgtgcaccataacttccccagcagtagtctccagtgggaatttgggagggcaggacagaagccaaatccaggccctgagcaaacagaacgctagatgatatcgtcagggagcagcaggtatgcagagacctgggacctactcctgtttctgcgactgacatgctgtgcacactgtgcatggaccccatggcacgatgcaggacggggctgcagaacccacacaagctttgaggtcagacagtccacgaatcccagctctaccacccacagcttttcctcttctcagctgtgtggccttgggcaaattgcataacctctctgaaactactgtcatatctttaaaatgagtaggaaatgagacctcctttgcaaggtaattgtgaggattaagttgtgagggttaattgttctaggtgctttcacccagaacaatacaccagcatataaaactgacctccaacaaatatgaagtcactttatccttgtctggcctgttctgcctcttcaattctatgcaatgaggcataaaaactcggatgtcctgggcctccacgttttacatgtataaaactggggtatcctgtaatcccagcactttggggggccaaggtgggcagatcacctgaggtcaggagttcgagaccagcttggctaacatagcaaaaccctgtttctactaaaaatacaaaaataattcgccgggcctggtggcatgcacctgtaatcccagctactcaggaggctgaggcaggagaatcgcttgaacctgggaggcggaggttgcagtgagacaagatcgcaccattgccctccagcctgggcaacaagagcaaaactctgtctcagaaaaaataaaaacaaaaacaaaaacggggtatccattgctgtacttccctgatcccctgaaataatgcatacatcctgcagcccagtacttagcagagagtaattgctcaataaatgtcagttccttcctcgttcctttctagaagaggaaagtgggcttaaagttcaacaccagtccaggaagctagtgccagggagcccacaactaaagcaactgtgtggcttgcactatgatttctaactaagcctgcatcagccagtctctgctctctggtggcttggactctctccccatctgtctgtaagaaggacgccctttcttcctacctggcgcggctgttgtaagtgccaaatgagaacttggatggcattgtattctgaacaagaaaaagtaaaatttggggagcactttctctgtgctaggcaattaattggtggtgcctgggggctgatccacaaagagacaagaagacatgttttctgcccacatagagttacagtggaagtgaaagggcggaagtgacgagtacaaggtcatccatgcagatatactcaaagcgaggtcggcaaaccctcattggagtcagctaaaaatgtaaattccctggccccatccctgacctctagagacaggatctctgacagtggggccccgtagtttgtgcctcaaatttgagaaccatttatggctggacgcggtggctcacgcctgtaatcccaacactttgggaggctgaggccggcggatcacctgaggtcaggagttcgcgaccagcctggccaacgtggtgaaaccccatctctacgaaaaatgcaaaaattatctgggcatggtggcaggcgcctataatcccagctactcgggaggctgaggtaggagaattgcttgaacccaggagacagaggttgcagtgagccgagatcacgccattgcactccagcctgggtgacagagcgagactccgtctcaaaaaaaaaaagaaaagagaataatgtatttataggagtgcagagagtgagtgccacaggtgttcagaaagtgataaactcatccaggaaagccgcaccagggacatgtgctctgagcatggtcttgaaggatggacaggagtggcaggctattcccagggggcagatggcaccatactatcccactgtactgtaattgcacgttacacgtatgtccatgtctgctccttcccaccctacccccttaaaattgggagagtccacagtgaatgagaggatgagttatggatgttagggcttaagcatggttgtttaggagacaatagagagccagtcctgttaatattacaggtttaggctaagaccagataagtttgggtaaataaaatagagccaaatagccataaagcttaaatgtgagactataaggtttggactttggccttcagatataagggaaaatctgaatttattggggcaggggaatgacatgaagaaagcaatctttcaggaagagacatctgaattttaaaaagagtgggggctgtgtgtggtggctcacgcctgtaatcccagcactttgggaggccaaggcaggtggatcacaaggtcaggagttcgagaccaacctggccaatatggtgaaaccccgtctctactaaaaatacaaaaattagctgggtgtggtggcgcgtgcctgtagttccagctactcgggaggcagaggcagaagaatctcttgaacccgggaggcagaggttgcagtgagctgagattgcgccactgcactccagcctgggtgacagagcaagactccgtctcaaaaaataaataaaaataaaaagagtaggactgaaagacacaggcacagggggctgtcacaacagtccaggtgtgaggccctctatgacaaggagggcatgaggctgcaataagatggaaagagaaaggaagggcaggatgcagagaacgtgccagggcaggtgggaaggatttggtgacattggtgtgaagggaaaggaagagggcatcaaagatggttttgagattctgatctggggtgaactggaggataacaagactgtgggaataggaaaggtggcaggaggggatggcttatagtacttgtatacaaatttatttgcttgtttattaattacagggtctctctctgttgcccaggctggagtacaggggcacaatcgtaactcctgggctcaagtgatcctcctgcctcaggctcctgagtaacttggattacaggcacatgccaccagccccagctgattttttcaaattgtctcactatgttgcccaggctggtctccaacttctgggctcaagtgatacttccaccttagcctcctattagtttttcccttacagcaattcctgcaatatataaaaggtctttacttcagtgagctgtgattgcaccactgcaatctccagcttgtcagaggatgacagagaccctgtctccaaaaaagaaaaaaaaaaaaaaaggtctttatcactcacagtgtctagcagaagaaatggggttgaaaggttaaaccactggccaggtagaaggccagtaagttaagacctgtttcatccttgttcttcctactgtgccatttgtcttggggaagaagaagttatcacaagcatccctcttccattctcccattacacctgcttatatctccattactacacttgtaatgtattacaactgtttttgtgtttgtttctctcataaaacttcaagctctggccaggcgcagtggctcacgcctgtaatcccagcactttgggaggctgaggcaggaggatcatctgaggccaggagttcaagaccagcctgaccaatatggtgaaaccctgtctctactaaaaatacaaaaattagccaggcgtggtggcaggcgcttgtaatcccagctgctcgggaggctgagacaggagaattgcttgaacccaggaggcagaggttgcagtgagctgagattgcaccactgcactccagagcgagactctgtctcaaacaaacaaaacttcaagctcttaaggacaatgtctttttaattttatttatttattttgcagtatcctctctttgtgttataataatctataacaataccaagctcagaacatacacctaaaaaacattgagtgaatgaatacataagctgcaagcctctaaacagaactgttgacaggcagttgtaaatgcagaactgtagctcttagagaaagtatttttattcttttaaacgaaagggccaggttcagcagctcacgcctgtaatcccagcactcaggtgaggccgaggcgggtggatcacctgaggctgggaattggagaccagcctgcccaacatggtgaaaccccatctctactaaaaattcaaaaattagccaggtgtggtgctgcatgcctgtaaacccagctactcaggaggctgaggcaggagaatcgcttgagcccgtgaggtggaggttgcagtgagccgagattgcgccactgcactccagcctgggtgacagagtgagaccctgtctctaaataaataataaataaataaaaggatgttatctcattttgatattatgagcatcactgaccaaacataggataataaggtaactgttaggagtgaaatttggtgatagtcaattcagtttaacagatatttgttgagtacttgcctactgtgtgtagaagagaaaaataatgccatagtcttagcccttggacagctcacaatctgatgtgagacatagacataatacctaaatattacacaaaaccaaatgcatttggtacaaatagtgaaacagtggatcttggaagtgcacagagagaagcagctacttctgacatggtattaggcacagcttgctggaaaaggagggttttgttttgtttttgtttttgagagggagtctcgcccagggatccacccgcctcagcctcccaaagtgctgggattataggcgtgagccaccgcgcccagccaaaacggaggtatttgaaagaggagaaagctttgcaatatggagagtggtgaggaggagcacttcatgaagaaaagcgtgaactgtggtgagaagccagaaggcatggtggggatgccatggggctgacaggactttgggttttattctgcaaacagtaaggaatccttgtaggtatacgagaagagggatgatatcgtctaattttagttccaggaaaacagcttcagtgtgcagaataacttggagagtctagcatcatgactctagacatgcaaacaaggatctcaggatacgggggcctgaaagaggatggtggcagtgagggtagaaaggaggaatcagcattcatccatcgtttaaccagttattctctgcgcttgatgagatgtatggggtgagagagagggaagaggagatgatggctttatttaacctctctgactttttgtcagggaacaaagcaacaggggaaagcttttgaagcacaatatagtttttttgtttgtttgtttgttttgagatggagtttcgctgtgtcacccaggctggagtgcagtggcgcgatctcagctcactgcaacctccacctcctggttcaagtgattctcctgcctcagcttctcaagtagctgggattacaggtgcccgccaccacccccagctattttttttggtatttttagtagagatgggggtttcaccatgttggccaggctggtttcaaactcctgacctcaagtgaccgcccgcctcagcctcccaaagtcttaggattacaggtatgagccaccgcacccagccaggaagtacaatatagtttaccaaagtttatgtttattattctgctttaattataagggataggtattagcatatctatttcagggataaggaaactgagacccagagagactaagtgtcttgtccaaagtgattctgttaagaagaacagagtaggggttcaaataccggggcctttccttcctgtgttctacgatctgggacatgcctttgagatgctagtgggtcatcctcgtggaagtattcagccaccagctgacagtgggaatctggagagaagttagaactggacaggcagacaggactcatccacagagaggccaagttaaaaaatagacttgttctttgagggaacagagagggaaaggagaaaaatgattaggaaaagaatattaggtatagacaagggagcaagagaaaatgatcagagcagtagaaaactatgagggctcagagtctcagaaaccaagaaggaccaggtggtttttctttttttcctctccttccctgcttggcagggttctgtaaagggacctcagcggtgagggagaaggctgggagcagtcaacactctagatccccgcccttcctgtcaccaagccatccccatccccccgccccaaatctcctgagcatcccaggataactttgcttttattgtttttatacagtggacttctgggttatatttttttaaaaaagagtttttgcaataaaaaggttgaaaaccatcgagctcaaagaaccaccctccaaattagacaaagccagcaagaccccggctccataagttgcctacccagtccctgccaccacaactggctttcctggattgggcctcgggttgcacacaagcccttgctggagcactcatcctgtcattccaaacctctcctctactccccagaccagtaaagaagagtttagctgggagtgagggggcattgagaaagactgtgctctctctaaaagcactaaggtggaaggtcaggaacccttcttgggcctctccaataaagggctgggcagaaaattccagttgaaaatccagaaagaggccaggcacagtggctcacacctgtaatcccagcactttgggaggccgaggcaggcagatcacctgaggtcaggagttcaagaccagcatggccaacgtggtgaaaccctgtctctaccaaaaatacaaaaattagctgggcatggtggcacgtgcctgtaatcccagctaatcaggaggctgaggcaggagaatcgcttgaacccaggaggcggaggttgcagtgagccaacatcatgccactgcactccagcctgggcgacagggggaagactccatctcaaaaaaagaaaatccaggaagagaaacacctcccagggaagcccccatacctaatgactaacttctgtctctcctgggagccttctctttcaggtgcctgggcaggggagagttctgggaaggaaccagaacattttctgagttctggagctgccctgagattctcctggcaggatgcgacagcacctgagtacatccttagtaccgcagccttgggtactatagccaggtgtttcccaaaataggagagctgggctgtgctggggagaatgaggaaatcagcagaactggggggattctgacgtgggggagctgggactcctaggtccttttcctcaaagcaaactggccaagctctgcctcctcccatgccaacttatcctctgtcaccatatttcctgagctgctgtcactctggggccaccctctctgctgcgcactgtaggctgggtgtcctcttgcttggtctttcaaggtcagtgaatctcatcacttagccttttttctttttttttcttgagacagggtctcactctgttgcccaggctggagtgcggtggcgcgatctcggctccctgcaacctccacctcctgggttcaagcaattctccagcgtcggcctgccaagtagctaggactacgggcacgcacaaccacacccggctaatttatatatatattttggtagagacggggtttcactatgtggccagaatggtctcaaactccttgacctcaagtgatccgcccacctcagcctcccaaagtgctgggactacaggcgtgagtcactgtgcctggccctaccacttactcttttccaaggcctgtggaggttttgacaggtaggacaaggagtgagttctagcatctcccaatggcttgaataaacaagcccatgtgctgagcgtgacacaggtgccatggtcagcttcattttcaactgaggacagagcaagagaagattcaagccactgtaacctgtgggtgggacaaggttaaataacaggaaggacttactgtctgaccatgaaaaacaggtggcgaatagctgctgtgataccttgtggagcatgggttttccaggtgggttccgcagaggctaaaggtgctgaagagatgcctcaagagccagcacaggcaggggagggaagcagaggaaatcaaacctccccttcaaacagaacacctctgtctttttctctcttgtacactaggatcctgcatacaattggaaaaggggaaaaggattccgctgctttattttttatttttatttatttatttatttttgagacggagtctcactctgtcgcccaggctggagtgcagtggtgcgatctgggctcactgcaagctccgcctcctgggttcacgccattctcctgcttcagcctcccaagtagctgggactacaggcgcctgccatcacgcccggctaattttttgtattttttagtggagacggggtttcaccgtgttagccaggatggtctcgatctcctgactttgtgatccgtccgcctcggcctcccaaagtgctgggattacaggcgtgagccactgcgcgcggctgattctgctgctttagaaaaaaaaaagtttgaaaattactgtcataaactcttggaccatcgacatccatcattctattggagtaggaggcactggcaaatattagttgagccgggttacaggctgcggagaaatggggcatcccatccaaagggggaaaggtatactagataaggtttggggcgacccagccacattgggactccttgaaaaaccagccagaggtggggtaagtggcgccagggagcctgcttgctcccaggtaccaatggccagctacagccaggagaggcaagtggaaggcagaggaactagctgggaaaaggagtccatttgcacagggctggctgatttgttcaaggtgggaggaacctggacaggacccagtcgctggactctgagacaggagctgtgtgctctgttggccataagcccctccccgctgctgactttaggctcctcttgtccttccttgcccccttttctcagccttgggtaagctcaggtctggaaatcacttaggaaaagcagatgaagctgactcacaaggttctgggactaaggaggcctggagtcactataactgctctaagaaccacaggaccctgggtggatattcaccaacatggtgaaaccccgtctgtactaaaaatgcaaaaattagctgggcgtagtggcgggtgcctgtaatcccagctactcgggaggctgaggcaggagccaagattgcaccactgcactacagcctgggtgacagagtgagaacccacctcaaaaaaaaaaaaaaaagaataggaagagtccatagggtcataggaattaactgcagggaatgaggcagttgctgtcaattaaaaaaaaaatcattacggagcatctactcagggctaggtaacaattaggtaataagcaatacaaatgctccctacccttggtggagctcatagtctgtgggacaggcagacattaaatacatgattaaaagtgtgagtggtagacaaagaagcacaggtgctactgaggatttgcaagaggaagaacctaatcttatctgggcgtcaggacaagacctttgaagaaaggatatttaaagtgtaatgtgaacatgagaacagggaaagaatgctgcagacaaatatatgcaaagatgcacaagtgagagatcatcgtgctttcgggaaacttcacaagaagcctggtgaggaaagggaactggcaagagatgttcacggggttgacctatggttggtgccttcagggtcaaggaccccaggatttaattcagatagtttgtgtcagttatctgatgctgggtaacagactactccaaaatttagtggcccaaacaagaatcattttttcaggattccgtgtgttggcttgtaatttttctacagatcttacctgggctcacccatgtggctgcattcagctggtacgtcagctgggggctggactaacccaggcctgttgggcctctggttctgtgaagtctttcatttggaaggaggcaagactgagctacttcacacagaatctgaggacagcgttccaagagggcaattcccaatgcacaagtgcttatcaagcctctccttgcatcatttgctgatatcctgttgcccacagccagtcacatggctaagcccagaatcactgtcagaggggatcccacaagggcatgtatggggggcagggtggttcattagtataacaatctatcacatacttcctctccaaatgggagagacgggaaggtcaaggagatgaaagaccacacttaaggcttggtcagaaccaacggattcttgtcctagctttgtggcatgtgtaagatgggtgaagttgcttactcactctaggtctcactttccttctctgtaaaatggaaggcttctaaatctcaactttagctgaaagccttgttatgcaagaatataggcgtcttccctctttagccatgaggcccacacagaagaaaatagacttcctattgaataggaagaagaattggagctagagcccccactccagaggcttttgcaaaagtgctatgaccttggggtagtaccaataaagggtgtggattcttaataatgagagatggttcagaattggaaagagtctccatctctccaggccactaaacagatgccccttgaaggcgtttttcatccagaagaatctgagctatcgctgtctgctggtgagagctgaggccaagaaaggtgggatttggggaacaaagagcttaccctaagcttgccagctccatacctgcctcatcacccaagatctactgctgagaactgcaggggaacatgcagagtgaaacctgggcaggtgtgcctttccctgtggggcttgttagcacttcccatgaagctgccttccctctgaggcccccagggacacgtttgtttgttaaatgattgacattgacctagttctgaccccaggctgcagctccctgggcatctgtctcctgggtctgcctgaccccaggggacaaagacgatgactcccggatcacaggctgcgtaaatacaggcaggtgtcatgccaggggccaggtgagaggaaggcaggtctaagctagagccacacctataacctaaaacacccatggtttgggagccactgagagatccctccatcccccaccacccaaaaaacagggtagattagctctttcaccttttctttccttcaaccattcattcattcaagaaacattattgctaggcaccgtgataccttagtagaacactaaagacattttaatagttttaaattcgatatgaggggaggtgagattcagtgtataattacagagtgacaagttctatggaagattttattttattttgagacaaggtatcactctgtcacccaggctggagtgcaatggcacgatctcagctcactgcaacctccgccttctgggttcaagtgattctcgtgcttcagcctcccaagtagctgggattacaggtgtgcgccaccatgcctggctcattttttcgtgtttttaatagagacagagtttcaccatgttggccaggctggtcttgaactcttgacttcaaatgatctgcccgccttggcctcccaaattgttgggattacaggcgtgagccaccgcgcctggcctggaagcatttaagtaagaaaatataacctggtctctctccctaaggaagtcccttgagctcagatggcaggatgtgtaggggataagtagataaacctgcaagtggagaggaggatggtccaggcagagtgaagctgatacaacagcctttgcgagagggaccatggctggtgtggggaactgagatatctgaggtcagtgtggctggcagcagagctttatgggttttttggttggttttgttttgttttgttttgttttgtttttgagacagaatcttgctctgttgcccagacgggagtgcagtggcgccatctcatctcactgcaatctccaccttccaggttcaaacgattctcctgcctcagccttccgagtcgctgggattacaggtgcctgccaccacacccagctaatttttgtatttttgtagagatggggtttcaccatgttgcccaggctggtctggaactcctgacctcaggtgatccaaccgcctcagcctcccaaagtgctgggattacaggcgtgagccaccgcacccggccagctttacgtttttaatagcaaaggaaaactgtttacataggagggttaacagtcaaatttgcactttgaaaagatcactctggctgcagtgcacaaaacagattggacaggtcaagagaagatgtgccaaaagcagctgggaaactactgtgatattccagggtgagctgatgatagcttggcctagggacagcaaaagaaataaggaatgaatacattcaagagacttgtaaggagcttaattggacaggacttgttgatgcactggatagagaggtgaagaagaggaaggtgttaggatatgtctgatactgctgacctacagaacagatgggtgatgctgccatccactagtattaaggacactgggaggccgccacccgaatgggaaagatgcgtttggtcaacttgggaaaacccggaattgaccccttttttttttttgagacggtcttgttctgtcacccaggctggagtgcagtggcacaatcatggttcactgcaacctcaaactcctgggctcaagcgatcctttcacctcagcctcctgagtagcagggaccactggtgcccatcaccatgcctggctaattttaaaaattttgtttgtagacatggaggtgtgtgggagggggtctcactatgttgtccaggctggtctcgaactcctggcctcaagtgatcctctcgccttggcctcccaaagtgctgggattacaggtgtcagcccctgcacccagcccttgaggtatctttgaggcacttgggtgcgtgcgtcgggagctcaaaggagaggaaaaagctggagttaggagcttagacatcaccaggatctaggtagatggcttagtgggagagggtcgttagagaggaagagggccaaagctcaagccttgagaaaggagcctgccaaggagacagagaacacaggacctgagaagatgaaggctgacttgaaaaacaccttcagtgtttggtgacatgaagtcaccggtaactgtagtaagggctgttttatagtggaggaatggaggcgaaacccagttttagaatgggttgaggaatgcgtgggaggtgaagaaatggagacagcctggctgagcgctttggttgtgaagggagaggagagaggggactggaggcggatgtgagattaaggaagttttttgttttgtttttgttttaatgaagagatgagcatctgtaaatgtcaacaggaagaattcagatttggtggagatggggccagggtggggtggctgtatctatgtgagggaaaagggccaaggaagaggtgggtgcctgggaagggaggagggacttgactccccagcacaggtggcagctcatgaggagcctggaaggggcagccgcaggcaggttggtgtggttggctgtgggagatgagggcagtctcatcccctggcccagttcagtgacccgagaggggaacccagctgctggggttcggcggctgcagcccctccaccgctgcctctgcccaggccgccctgaactgccctgtttcataatgagcaagcagtgcctcagccttgcctcgggcccgtcctgttaagagccccccccatccccccgcttggaatggagcaggggtggggaaaaggctgccgggactggccagggctcccattcgaagcgctgaaggacaggaccagaattacttctctcgggcgggagcacaccgcagagggcagacgggtcgacatttgctcgggagagaagcccaactgtttattctggttttcttttgtgtgtgtgtgtaaggtggagaggggaggcagagagcagtggggacctgaaatcgtagtattggggtgggtgagagggatgggagtggagggggacgttccttcctgggctcggcctggccccctttggggtggcagggggaaaggctggggctggaaggacagcaagagcgcccagggcctcagggctggggtgggagtaccctgcagagagctccctcctgcctcgcaggagaggaagggggaggcagggaggggcagggacagcaggagcccccaggtcaaagctccactccagtgtaaagcagtagccatatttgcttagaacttgccggatgttccctcccttgcacaggccacagagacttgttgtggaggagatcctctttctttggggtccagtgatagcagggagccctgtaatatgaggccagccccccatgctgggagctgagtcctgagaatggggaagagggttcgtggggagagggtgggtgaagaagccttcttaatcattaacctggttgatttcatctgaactgctgagcctcccagctctattgattttctctgaaagcacagcatctggagctggtggctgcccagagaccggggagagagaccacgggtagaggtaggggaagaggggcagggaggggaatggaaaccaggccaggagtggggggctgggaaggagggaggagacaaggtctgagggccgggagattgtcagaggagtctttggggatgtgaggaggccaggaggtctaagcaggcactgggggagggcacagtcagcacagccacagaggcaccacggagagcaggaaggagccagagaggatctggcagagaggacgaaactgaagtccagagaagcacagtgatctgctcaaggtgacagggtcagggcctgcaccaaaactgaggtcagttgatttcactggactgaggagagaagatacagaaatgaaggcccctggggcagaggagaacctgaggtgatggaaagtcggcaagaggcgagatgcaacttacaaattaccatttttctgagggtggggcctttcctttttttgcctgtgaggatatagtagactttcaaaaaatggctctggtctgactgaaggtggggtcaggccatcaaaggaggaagaaagggccaaggagaagtgatgctagaggccgggcatggtagctcacgcctcagcactttgggaggccgaggcaggtggatcacctgaggtcaggagttcgagaccagcctggccaacgtggtgaaacctcgtctctactaaaaatacaaaaattagccctgcgtggtagcgcacacttgtaatcccagctactcaggagactgagacaggagaatcacttgaacccaggaggcggagatggcagtgagccgagatcgcgccattgcactccagcctgggtaacaagagcgaaactccatctcaaaaaaaagaagtgatgctagaaagagctggacagaagggaacaccaagacacctgtccatcttcacttagccaaatccagggccctgacaagatgggttttcaccaggacattttatggggctcctggctccccactatttctgacagtaggattcctaggtctgtgtcacctgtgagacagaaggggagccacattctggtggcagggacagaaccacacgcatggacactgatgtgccatcctggtccccacaggtcccctgaccagtacagctcctagaataggtcttctctgagctggaggggataagccagactgcttcctgggagaattgaaaaggagcagggggccctgaagacagaatcagtcaggtacacagtgagcaggggtgatgtgacggtagagagacatgggaacagagacagcacacacaccacatagctctgagatgacgcacaaaatgttatgactccatagactgaagcagacacagcgtttcttttcttttctttttttttttgagacggagtgttgctctcgtccaggccggagtgcagtggtgtaatttcggctcactgcaacctccgcctcctgggttcaagtgattctcctgcctcagcctcccaagtagctgggattataggcgtgcgtcaccacacccggctaatctttgtatttttagtagagatgggattttactacattcaccaggctggtcttgaactcctgacctcaagtgatccacccgccttagcctctcaaagtgttgggattacagttgtgagccactgtgctggcctcagacacagcatttctaaggccatgttgagggtgccaaaggaaaccaagatattttaccccagaatatactactttgacgtattttgagtcggctgtcagagggccagcacacagaagtggccctgcaaatctggcttttgagggagatttgcatctgcagagaatctgcattgatgcaacctggctttctctgaggccctccctggtccaaatctaggaaagattaactgaaagtctgacatgtttaaaggtctgaaagacacatacatcacctgttttctctgaggggtgttacctatgaggtttcattcatataaaaagaccacttttactggcctggcctccgtttatccctcccataactatttttgccaaagtccaagtcccttttttttttgttgttgagacagggtctctgtcgcccaggctggagtgcagtggcatggtctcagttcactgcaacctccacctcccagggtcaagtgagtctcatgcctcagcctcctgagtagctgggactacaggcatgtgccaccatgtccagctaatttttgtatttttagtagagacagagtttcgtcctgttggccaggctggtctcaaactcctcacctcaggtgatccacctgcctcagcctcccatagtgctgggattacaggggtaagccactgcaccttgcccaagctcccattctttctgtaacctcaagatggtataaaatcatcaaccatctggctatctctttgacttcctatatttttttgactcccttgcatattagttcttctactaatctgccttttttcagttggtttttcagcagacctgcagagggcacaggggaagtgttcctttggcccctgcagcaccacaggaccccaggtcctgtctgtggtcgtggtggtaacgggtgccagcctggaccagtcctgcatcgtggagcttcactctggacattctaaggggcagactgtggctggggcgtgagggataataaaggtggtgtgaccgaagcctcctgtctatactgtcttttctctcccctttctctgacagctcaacatcctggtggatacaggcagcagtaactttgcagtgggtgctgccccccaccccttcctgcatcgctactaccagaggcagctgtgagtcctggggagagcccgggggaagtaccttttccaaggatccagggctaagaagggtcaggggaggggtacagagagaaagagttgatcctcagattttcttcttgccagggaaggggaagggcgaaaaaaagacagtgaccaggagagacagggtgaagtgggtggtgagaggagctataccatgggaaagggtgaattgagaggtagccaggaagtgcttcagtgctgagacagggcagcctcctgtgggagggaaaggaagaagagcccatagctcacagaacaatcttagggggcccattttctctgcctgaatggggagacgaaaaccccacatcccctcggtgtctctcagttctctaacaccagctaagtctaagctgaacaggcctcagtgacggctccccttgctgtgttcttacccaggggccactctaggtggctttgcatagtccaaggacatgaaggaaagggtctttcataaacccctctgcctagaccagtatcagaactgaaagctgaaatatctcctccatgcaccacccagggtgccaccagttggattcagcttactggtgaaaggggggttgaagaggactggtgaaagtgggggactggtgaaaggggggttgaagtgggctttaagataagaggcagtgaggggtaatctggaagcccccttagcataaaagcaggaagaagaagggatgagaggacaccaatatctgagacatcagtgtgtgcaaacgtgagtagaggcttaaatcctatccttggacttgtaggcagctgcaaaacgcaccttccctgtttcctctaatgtcccaatctaaaagaagcagtcagggaggagggtgcaggtaggatcgatgaaagggcattcactccagttcctcgttccagttccatcactgcccccaccacacacagaagccctggttagtggtgtgattaaacacaggtggggctgccacatgttgagcacgtttcacagaagtggtgtgtaataccaacctgcttttctgagatgcttgaacaaaccccttctctagaacttgctgtagaggttccacattcaccctgcctggcactttctctaccactcggatggtaccactaggttccaaggcagtaagagagtcaatggttccttttctcggggagcttgacggagccagagggcggaagagatgcccactagctgtccctgcagcagcagcagcagcaggcacaatgcacaaagcccaggcttgttcttcacagggcctgagctcaagatctaggaatatgagcaatagataggagagcaagcctcaccaatggttcccttcatctatctgcaagcccactttacactctgttctgggtggtgagtctagggatgttttgctgagcagcctgaaagcagactctaggattcccctgagatgagataaggtggtgtttgggagtaagtttaacttagatccttataccagttgtggttatgcatccacagatctctgccttctttccacaggtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccagggtgagaggaacagggcttggccctacacactctatgcacactgcactatacagagaaggaattaggagagagaaggggaattagcagaaggagggcaacaatcagtttaaaggattatttaacaggggtatagggtggcagtctaaattttagccctatagagggcagaaccatagtgacagaagctgtgataggtacaagaataggctgtgctttctatgtactcttaagatctttttttttttgagacggagtttcactcttgttgcccaagctggagtgcaatggtgcaatcttggctcactgcaacctccacctcctcggttcaagcgattttcctgcctcagcctcccgagtagctgggattataggcgcccaccatgacgcccggctaattttttctatttttagtagaaatggggtttcatcatgttagccaggctggtctcgaactcctgaccgcaggtgatccgctcacctcggccttcctaagtgctgggattacaggcatgaaccaccgcgaccagccactctaagatctttaataaaggcccccataaatttgaagcaggttaggcatagggggatcaaagatatatgaacctggccaggcgtggtggctcacacctgtaatcccagcactttgggaggccaaggcgagcggatgacctgaggtcagaagttcaagaccagcctgaccaacatggtgaaaccccatctaccccatctctactgaaaacacagaaattagccgggcatgttggcgcatgcctataatcccagctactcaggaggctgaggcacgagaatcacttgaacccaggaggtgaaggttgcagtgagccgagatcgtaacattgcactccagcttgggcaacaagagcaaaactctgtctcaaaaaaaaaaaaaagatctatgaatctgtgaacctatcaatactgtcctgtttgcattgccagggctcctgctaacccttcctctgccaaatctcagtgccttaagatggtctttcccaaggagcatcccccaagccttcaaatttgccttccagtttagacaggaagctggcctctgcctttagggccgtatgaggactcactccttgtctctttctgccaaagcctgacgactccctggagcctttctttgactctctggtaaagcagacccacgttcccaacctcttctccctgcagctttgtggtgctggcttccccctcaaccagtctgaagtgctggcctctgtcggagggagcatggtgagtaggtcctcagagaggggaggtcctggcattgagggagagatgggtgccatcctctccccttcctgaaagctacaccacagttttggctccgatacttagaatcaggaggaacctctttatattccctacccttactttatttttccattcttttcttttttgcgttattccagaaaggaatcaaggcacctatggtaaacttggaaaggaaggcaattaggaaaatttcaaaggaaatgaaaataagacctgttgaattaaaattattcagtttgatggtcagaaggcagagatataagaagtttgtctatttattaattaattagaacaatggtgaatggttctccaataagcagagaaaataaaacttataatataaacaaataaccattcattcaacatttattgtggcagtttagatttaaataactttatatcaagggctgtatgattctgaaacaaataattaaaaatcccggaaagtcttttctcctgaacacatttaagaaactagaaatcactttgggtatgatttgtttagaagcaggaagatgaaaagggtagcctgtagaagaccttgccaccccaagaaatcactgatcttattgcttggtccttgggggactcactctccttctgtgccaggacacgggtacctgcctctttttttccctagatcattggaggtatcgaccactcgctgtacacaggcagtctctggtatacacccatccggcgggagtggtattatgaggtgatcattgtgcgggtggagatcaatggacaggatctgaaaatggactgcaaggaggtaagaaaaccaagggagagcctgggaacataagggggtaggcagtacaatgtgaaggaagactctggttatcatgttgggaggatgaggcagaggtaataggacctgcagaaagggttggaagttgagcctagaacagtcaggggcttaatggtcacacagcaggatctgcggtttggggcctagggactggtagtgaaaaaaaaaacatggaactagttctgatgtctggactctagtcactgccttgcttcgtagccttgggcaagtcttttgtgagacagggtgatagaatgaagagtcttgtctttggagtcaggaagacccagatctgaatctagctctgatttgtactagctatgtacccttaggccagttactattctgtgtctcagtttccttatctgcaaaacaggtaaaaacaactttctcagaatatcagagataatgtgtaaagtgtttatctctgtggttggcagtactcaataaaaggtaactaaatcatttatgtcttccttccctagattcttatgtatgttaaattagaatagatataaatgtactaagaaaagttaaaagcggccgggcgtggctgtaatcccagcactctgggaggccaaggcgggggcagatcatttgaggtcagaaattcgagaccagcctggtcaacatggtgaaaccccatctctactaaaaatagccaggcgtggtggcaggcacctgtagtcccagctacttgggaggctgaggcaaaagaatggtttgaatccaggaggcagaggttagagtgagccgagatcacgccactgtactccagcctgggtgacagagctaatactccatctcaaaaaaaaaaaaaaaaaaaaaaaagaaaagaaaagttaaaagcactaaacaaggtatttttattttcaagtttggagactacctgcccacccaagattaacaagaataaacatttaccaagtgccttctctctgctgggcacgattctaagtgctttacattgctgatttatttaatccttacaataaccctttgaggtaggtgctatttttatcctcactttagagatgaaggaactgaggcacagaggttaacttgtccaagcaggtacacttaggaggtgccaaagccaagatgccaacccagctggggccccagcagtaaccccctactgcccagagcccagcatcaaaaaccttttgactcttttaactctctcttttccctcttagtacaactatgacaagagcattgtggacagtggcaccaccaaccttcgtttgcccaagaaagtgtttgaagctgcagtcaaatccatcaaggcagcctcctccgtgagtggactaaggatgggggtaaaagagatggtacagtgtcagagggaggcggtgagagtcacattcttcagcaacagccaagatgtctgcacttagacccttctactcagagctcttaaaacactcttcccctagccaggcgtggtggctcacgcctgtaatcccagcactttgggaggccaaggtgggcagatcactaggtcaggagttcaagaccagcctgaccaacagggtgaaatcccatctctactaaaagtacaaaaattagctgggtgtggtggcgcacgcctgtaatcctagctactcagggggctgagacaggagaatcactttaactcaggacggtggaggttgcggtgagccatgattgcgccactgcactccagcctgggcaacagagtgagacactgtttcaaaaaaaaaaaaaaaactcttcccctttatggctgtcactttgctcatcacacaatcccccggtacaaaagtttgacatcacactccctctctcttcctgtaatcctctggttggtttacccctccccactttagatatttcactggaaaagcaaatgaagggcccagttaatgtatctgaacatgggaggggcgagatgataaagaggcttttcctcattgttatccccttcttgccaacacagacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcaggtatgtcccagcctgagtcagggggatctctcttaaaagtacacactgggagacagtgagcaggtatggcttgccagaacttggaagacaaaacagatgagtagtgtccagcagtaaaggggtctcagaaaacccgttagagctcagggatggtaaagggaagggcatagatgcctacaaggcagagatggggtgaaggagagtgaggaagacactcaccctgtgattgcttacccctagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatggtgagagtgccagggctgagggtttggggtcagtctctccatattttccttgtcaaacaacagttagtatacctgggtccctgtcagtttaggggagggtagtaacagttgcctcaaacccaagtcaacagttgtgcaaaagctagtgtcaatgctcgtcctttttttgtactgcctgccataatgaccactgcctggattggtaacctctgttggaaacccagagcagcaagagttacctgggtaccttgggaagctcttgatgcaagggtagcagactgagtctatagtgaccctgtcagctgccacatggtgaggctgaatgctacttcagaaaggtggcagggttttgcagttggatttcagcagcagaaagttaagtttactagatttggcttttggtcaagggggtggcttttggtcaactcagaactactgacttttagttatcactcctaccagctgggtatacaaggaagggctgctgctcccagtgacttgggaagggagacaggcctctacctggtgctggcttcccagcctgctcctaaatatctcctgggaaggagattagataacttctgcatgggctaatttcaaggcctcactatcaggaagttctttttgttaactcctctatgacaatgagagctgtccattcacatttgccctctccccagtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggcgctgcctccgctgcctgcgccagcagcatgatgactttgctgatgacatctccctgctgaagtgaggaggcccatgggcagaagatagagattcccctggaccacacctccgtggttcactttggtcacaagtaggagacacagatggcacctgtggccagagcacctcaggaccctccccacccaccaaatgcctctgccttgatggagaaggaaaaggctggcaaggtgggttccagggactgtacctgtaggaaacagaaaagagaagaaagaagcactctgctggcgggaatactcttggtcacctcaaatttaagtcgggaaattctgctgcttgaaacttcagccctgaacctttgtccaccattcctttaaattctccaacccaaagtattcttcttttcttagtttcagaagtactggcatcacacgcaggttaccttggcgtgtgtccctgtggtaccctggcagagaagagaccaagcttgtttccctgctggccaaagtcagtaggagaggatgcacagtttgctatttgctttagagacagggactgtataaacaagcctaacattggtgcaaagattgcctcttgaattaaaaaaaaaaactagattgactatttatacaaatgggggcggctggaaagaggagaaggagagggagtacaaagacagggaatagtgggatcaaagctaggaaaggcagaaacacaaccactcaccagtcctagttttagacctcatctccaagatagcatcccatctcagaagatgggtgttgttttcaatgttttcttttctgtggttgcagcctgaccaaaagtgagatgggaagggcttatctagccaaagagctcttttttagctctcttaaatgaagtgcccactaagaagttccacttaacacatgaatttctgccatattaatttcattgtctctatctgaaccaccctttattctacatatgataggcagcactgaaatatcctaaccccctaagctccaggtgccctgtgggagagcaactggactatagcagggctgggctctgtcttcctggtcataggctcactctttcccccaaatcttcctctggagctttgcagccaaggtgctaaaaggaataggtaggagacctcttctatctaatccttaaaagcataatgttgaacattcattcaacagctgatgccctataacccctgcctggatttcttcctattaggctataagaagtagcaagatctttacataattcagagtggtttcattgccttcctaccctctctaatggcccctccatttatttgactaaagcatcacacagtggcactagcattataccaagagtatgagaaatacagtgctttatggctctaacattactgccttcagtatcaaggctgcctggagaaaggatggcagcctcagggcttccttatgtcctccaccacaagagctccttgatgaaggtcatctttttcccctatcctgttcttcccctccccgctcctaatggtacgtgggtacccaggctggttcttgggctaggtagtggggaccaagttcattacctccctatcagttctagcatagtaaactacggtaccagtgttagtgggaagagctgggttttcctagtatacccactgcatcctactcctacctggtcaacccgctgcttccaggtatgggacctgctaagtgtggaattacctgataagggagagggaaatacaaggagggcctctggtgttcctggcctcagccagctgcccacaagccataaaccaataaaacaagaatactgagtcagttttttatctgggttctcttcattcccactgcacttggtgctgctttggctgactgggaacaccccataactacagagtctgacaggaagactggagactgtccacttctagctcggaacttactgtgtaaataaactttcagaactgctaccatgaagtgaaaatgccacattttgctttataatttctacccatgttgggaaaaactggctttttcccagccctttccagggcataaaactcaaccccttcgatagcaagtcccatcagcctattatttttttaaagaaaacttgcacttgtttttctttttacagttacttccttcctgccccaaaattataaactctaagtgtaaaaaaaagtcttaacaacagcttcttgcttgtaaaaatatgtattatacatctgtatttttaaattctgctcctgaaaaatgactgtcccattctccactcactgcatttggggcctttcccattggtctgcatgtcttttatcattgcaggccagtggacagagggagaagggagaacaggggtcgccaacacttgtgttgctttctgactgatcctgaacaagaaagagtaacactgaggcgctcgctcccatgcacaactctccaaaacacttatcctcctgcaagagtgggctttccagggtctttactgggaagcagttaagccccctcctcaccccttccttttttctttctttactcctttggcttcaaaggattttggaaaagaaacaatatgctttacactcattttcaatttctaaatttgcaggggatactgaaaaatacggcaggtggcctaaggctgctgtaaagttgaggggagaggaaatcttaagattacaagataaaaaacgaatcccctaaacaaaaagaacaatagaactggtcttccattttgccacctttcctgttcatgacagctactaacctggagacagtaacatttcattaaccaaagaaagtgggtcacctgacctctgaagagctgagtactcaggccactccaatcaccctacaagatgccaaggaggtcccaggaagtccagctccttaaactgacgctagtcaataaacctgggcaagtgaggcaagagaaatgaggaagaatccatctgtgaggtgacaggcaaggatgaaagacaaagaaggaaaagagtatcaaaggcagaaaggagatcatttagttgggtctgaaaggaaaagtctttgctatccgacatgtactgctagtacctgtaagcattttaggtcccagaatggaaaaaaaaatcagctattggtaatataataatgtcctttccctggagtcagtttttttaaaaagttaactcttagtttttacttgtttaattctaaaagagaagggagctgaggccattccctgtaggagtaaagataaaaggataggaaaagattcaaagctctaatagagtcacagctttcccaggtataaaacctaaaattaagaagtacaataagcagaggtggaaaatgatctagttcctgatagctacccacagagcaagtgatttataaatttgaaatccaaactactttcttaatatcactttggtctccatttttcccaggacaggaaatatgtccccccctaactttcttgcttcaaaaattaaaatccagcatcccaagatcattctacaagtaattttgcacagacatctcctcaccccagtgcctgtctggagctcacccaaggtcaccaaacaacttggttgtgaaccaactgccttaaccttctgggggagggggattagctagactaggagaccagaagtgaatgggaaagggtgaggacttcacaatgttggcctgtcagagcttgattagaagccaagacagtggcagcaaaggaagacttggcccaggaaaaacctgtgggttgtgctaatttctgtccagaaaatagggtggacagaagcttgtggggtacatggaggaattgggacctggttatgttgttattctcggactgtgaattttggtgatgtaaaacagaatattctgtaaacctaatgtctgtataaataatgagcgttaacacagtaaaatattcaataagaagtcaaactactagggttacttttttttcctcaatcagagtctcattttatccatttggagtagagtggctaaaacaatactgaggcttctggaggctttcggtaagcaaggcatctggttggacagtgggtgagcaccaggctttaaatctgcatacatgagccttaaggaaatggactagaggctgagccaaaccaaagcagaatggccttagagcaacagcaggttcctaggtggtttttatattgtatttgaaaacagccctgggcagggatatcataatttcaaggccaaactaaacatcatcttccctacaatctgcatcccccaaaggaattgcaagatgagggggaacagactgtttctgcataatatacatagtttcatttacgaacattggaatacagactttctatacacacattacctatataataaaaatgtacatggcatgagtatatgtcactgtataaatatagagttttagaaatcttgaacccgcgcttcctgttcacatcagtttctcttcttcttcctccccagtcaggtccgtcatttaagagttggacaaaagggacaagtgtcatttgtgttggtctgggcccagaatttgatacactggaaagaaagaaagacacacctcaggtttatctggaaaaacaaagggaaggaaggagagaatgccaataaggttcaacaaggcctaagtcagaaaagttcttacactgaggtacaagaggggctttttttgttgctgttcttttttctttttttgagacccagtctcactctattgcccaggctggcgtgcagtggtgtgatctcagctcactggaacctctgcttcctgggttcaagctattctcctgcctcagcctcccgagtagctgggattacaggcgttcaccaccgttcctggctaatttttgtatttttagtagggatggggtttcactttgttggccaggctggtctcgaactcctggcctcaagtgatctgcctgcctcagcctcccaaagtgctgggattacaggtgtgagccaccgcgcctggccccaagaagggctattcaatggctcttaccctaaaagaatcctcagtgcaagtgaacctgtcctttttatgaggaacattaacaatgagctgttgaaaatgttcatgatgctgctttttgttgaatgtctagtgtggcttgctcccccttaggatccattttgcctgagatgagcatctctgttctaagacctgacaccctcaaatcttattcaggaatttttcttaccaagaatttagatgtaaattcagtttctacctcttggaaaagcaaaatgaacaaaacaaaatgttgttaagagggaatcatccctgctactaagagacttaactctgctggcaacataaaaaaataggaatgacttgtcagtctgtgaagataatctctaaccggcaagccctccaagctgttctgttaatggagttactaatctcatactcaggtcctccattccattcctctcatctaggcaaagtcttctgacaatgctacattttgaacaatagttagatatgtgggattatcactcattgtcaattttccaagaaagttatttagtgcgcagtatgaattgcttatccagtcccctgaagggaatggggtaaaaagctgagagatcctaactgcagtattctgaattctgctaatgtttaagccacaatttactgaaaaccttatgattagacattagagaccaggtgcactggctcacgcatgtaatcccagcactttgggaggctgaggcaggaggatcacctgagcccaggagtttgggaccagcctgggcaacataacaagaccttctctctactaaaaaagaaaaaaaaaattagctgggcatgatggcatgtgcctgtaatctcagctactcaagagactgaagcaccttgagcctaggggattgaggctatagtgagctataatcgtgccactgcattccagtctggg

SEQ ID NO: 12682 - DNA, 63187 bp, Human
tactcaaacgttttttggtatgtttggggacaaaaacatggtttgaaattggcaagtgagaatcagagcaagataggacaccatctgggtgctctactgttttgtattctaggtgtctggacaatttagaggtgagggagttcaagagccagtttgtgtttctgtgcttcacaaagccacccttgtctaattcttgataaccagagtttggttagacagggactgaaacaatcctagtgcataggaatcacccactaaatacctgttgaattgagtaggcaggaaggcactatctgaattgactacaaaattgcgggtatgaaaaactggattgtattcaactaggttggtaaatttgtttagactttcaaattatctgaatagggtttatttggccaaccttatgcataaatctgtgtattccaaccttgataaaattaatttattgcaattaagtttgtccaggattatgtgagagagtccttcatttcatttctttagttaccaggagatgttcagggctcatctacatctcctggttaattttccttcagctttttctgtgtctcttccctaattctctttgagttcctgggagaaagaggagggatatttaaatgccctttgacatacttaattttctttgctatgggcaaagttaggaagcaaaattgactatagagttgttttttttgtttttgtttttgttttttttttttgagacggagtctcactctgtcgcccaggctggagtgcagtggcgcgatttcagctcactgcaacttctgcctcccctgttcaagcaattctcctacctcagtctcttgagtagctgggattatagggatctgccaccacacccggctaatttttgtattttttttttgagatggcatctcactttgttacctaggctggagtgcaatggtgcgctctcggctcactgcaacctccgcctcctgggttcaagcaattctcctgcctcagcctcccaagtagctgggactacaggcgcatgccaccacacccggctagtttttttgtatttttaatagagatggggtttcaccatgttagccaggatggtctcaatctcctgacctcgtaatctgcctgcctcggcctcccaaagtgctgggattacaggtgtgagccactgtgcctggcctaatttttgtatttttagtagatacagggtttcaccacgttggccaggctagtctcaaactccttatctcaggtgatccacctgcctcggcctcccaaagtgctgggattacaggtgtgagccaccttgcctggccttagagagatttcataacccaagcgattctgtgaatagatctgtatttgagacagagatgtagagatcagcagcccaaggtactctgtgaaaaaaggatagataactgcggagggcttccgtttttgtttgtgtagggaaacttggtaaaaggggaataaagaacagtgagaaaagtataaaattgtatctagaggttactttggaaattaaaaataatgttatttgtacttagtaaaacaaagtagtaaaagtttgctctttttttttttttttttttgagacagtctcactgtgttgctcaggctggagtgcactggctggcgcaatcttggctcactgaagcttccgcttcccaggttcaagcgattctcctgcctcagtgtcccgagtagctgggattgcaggcgtgcaccaccatgcctggctaatttttgtatttttagtagagatggggtttcaccatgttggccaggctggtcttgaactcctgacctcaagtgatccacctgccttggcctcccaaagtgctgggattataggcgtgagccactgctcccggcctgttaacccttttttactacagagaacttggaacctgtttcatcacttttctgcttcttccaggttcttgatacatatttgccagacttcaagatttcagaaaaggggtgaaagagaagattgcaactttgagtcagacctgtaggcctgatagactgattaaaccacaggtaaggcagtgaccataggaataaggaacattaatatatcagcttcataagtgtttaaatgactaatgtaattttataaagtaacacatattttggaaggaaatttatttattatgaaaagcaaaaagaaaataaaatcacccactatcccacctctcagataaaccatggttagccttttgatagatttctttataatttttttctatgtctatatagtcattccttgatatccatggggaattggttctaagaccttcccaggatatcaaaattctcatatgcggccggttactgtggcttatgtctgtaatcccagcactttgggaggctgaggcaggcggatcacctgaggtcaagagtttgaaaccggctggccaacatggcaaaaccccatctctactaaaaatacaaaaattagctgggtgtggtggtgcgcatctgtaatctcagctacttgggagactgaggcaggagaatcccttgaacccgggaggcagaggctgcaagtgagccaagatctcatcactgcactccagccagcaagactctgtctcaaaacaaacaaaacaaaattctcagatgctcaagccctggtataaaatgatgtgtagtatttgcatatagcttatgtacatactcccacatactttaaattatctctagattacttataatacttaatacaatgtaaatgctatgtaaatagttgttatactgtattgtttagggaataatgacaagaaaaaaagtctaggctgggtacagtggctcaggcctgtaatcccaccactttgggagacttaaataggaggattgcttgaggccaggagttcgcgaccagcctgggcaacatagtggcaccgtgtctctacaaaaaaaataaaacataaaaaaatttaaccgggcgtggtggcacctacttgtagtcccagctacttggggggccaaggtgaagggtcacttaagccaaggagtttgaggttacggtgagctgagggcaccactgcactccaacctgggtggcagaaagagaccctgtctcaaaaaaagtctgtacatatgcagtacagatgcagtttttttttttttttttgaggcagagtttcgctcttgttgcccaggctggagtgcaatggtgcaatctcagcttaccgtaacctccgcctcccaggttcaggcgattctcctgtctcagcctcccgagtagctgggactacaggcatgccacacctggctaattttgtatttttaacagagatggggtttctccatgttggtcaggctggtctcgaactcctgacttcaggtgatctgcccgcctctgcctcccaaagtgctaggattacaggcgtgagccaccgtgcctggccttgcagttttttttcccccaaatatttttgatctgcagttgattgaatccacagatatggaactcatagatacggacagccaactgtatttcatttttaaaaaaatcatacactaaaaacttttgttaatttttttaacttttttttttttttttttttgagtcggagtctcactctgtcgcccgggttggagtgcaatggcgcgatctctggctcaatgcaacctccgcctcccaggttcaagcaattctcctgcctcagcctcccgagtagctgggattacaggcacccgcaaccacacccggctatttttgtgtttttagtagagacggtttcaccatattggccaggctggtctcaaactcctgacctcatgatctgcccacctcggcctcccaaagtgctgggattgaggcttgagccaccacgcccggcctctaatttttttaacttaataatcaggctatgaatattttcccgtgtcattaataaattttcttctcttttcttttttgttttttttgagacagggtcttgctctgtcacccaggctggagtgtgcacttcagtggcgtgatcacagctcactgcagcctccatctcctgggctcaagtgatcttcctgccttagcctctcgagttgctgaaactacaggtgcatgccactgtacctggccaaatttttctacaacataattttaatggctatatggtattccattatttggttctttatattacttttaccagtgaaattgctggtctaaaagaatgcgtatttttggccgggcgcggtggctcacgcctgtaatcccagcactctgaggaggctgaggcgggcagatcacctgaggtcaggagttcaagaccagcctggctaacatggtgaaaccctgtctctactaaaaatacacaaattagccaggcatgatgacgggtgcctgtaatcccacttactcgggaggctgaggtggaagaatcacttgaacctgggaggtggaggttgcagtgagccgagatcgcgccattgcactactgcagcctaggcaacagcgagactccatctcaaaaaacaaacaaacaaaacatatttttaaaaacttttgacatgtaacaccaaattgccttgtaggaagattatgctgatttacctaaaacagtatatattcacataggcataaatgtataacttaaaataggtaatatatttgcatggtgcaaaaatcaaaagaatataaaaagcttcatggtttaaaatcttcctccagccttgttacttcttcactctcaccatccataggtaaacacttttttttttttttttttggagacagagtctcactctgtcaaccaggctggaatacagtggcacaatctcagcttactgcaacctctgcctccctggttcaagtgattctcctgcctcagcctcccgagtagctaggattacaggcacgccaccacacctggctaatttttgtatttttattagagatggggttttgccatattggccaggctggtcttgaactcctgacctcaggtgatccacctgccttggcctcccagagtgctgggattacaggcatgagccatctaataaacacttttattaggttcttgggtttgagtgtttgtgtgttattccccaaaccagataccttttgaagggaataaatctctataaaatgaaatgactgctatttgactaggattgtaatctgcagccacactgtcaaccattacaaactttttcagcttcatactattggaatatcagattactttgggtttctactaagatttccttttagtattttacaaagctctctgtcattatctgtcctagtagtaaacagcatcattgatttccatctaggtcctattagtcataggtggattatggtttgttgagttctatggataaattatagcaaaactgagtttgtaatccttaaaaaagggcaatatgaaacatacaagtttgggagagaaatgataggaaatatatttgcttgaagtttctggacagtgatgaattagaacaagtgtccatgtgtcctgtgctgacttctgagtgttggacagtgagggattgtcattggattttaaattgacccaattttggaagcttcatagatctgtttctgtaaacagatccaatttcaacatagaagttagcaaacataaatgtggaaacacaaagtccattaaacttccttcagacttagtttgtgactttgattaacagttaaaattgcatgctggattatgttgccatttactgactgctgctaatcccttatatacaagaaaaaaatgtaggtgttttctctctgggtaagatgaaagtaactccactctattttacttgtggtaatgtaacaggatctcttatcccttgtgaaagtaggagaggatgtccctggagaaatggcactgcctgggatgggaccatcttaactaactatacttctaatgaagtcttgtcttactctgtttattctattatattaccagtttaactcatgactttctctttaatagaaataggcaagtcatatctcactgactggatagcaaggtgtttgagagcatctgtcacaccaaagtctttgttttgctcaggagctggtagtcccctatttcaccctgcttagaatgcaccctcttgcagctttccccaacccggtctgaacctgcaccttttgatttatagagcttgtcaagactagttatttttggtttgagagtgaagaaagatgggaggcaatgggaggttaatttcagatgaatgtgggaacaggttacattgctttgtctgcaatcttcctaatttgtatttgtcttccccttccatttatctcttaccctagaaaaagtcaacgttcattcttagcttgtagaactccgcaggtctgtctgtatcttttaagtattttttacatcaggaaaccatctctgatcctcttttatgctgttctccttctctgcacttccagagcgctctctgttaatgccctcttgcagcaaggatagccctatattgtaattgtttgcattcccccattcaattgtgcgttcttggagggaagagatttttttttgttgttgttgtttgagaaggagtctcgctctgtcccaggctggagtgcagcggtgcaatctcggctcactgcagcctccacctcctgggttcaagctattttcctgcctcagcctcccgagtagctgggattaaaggcacgtacccaccacgcccgctaatttttgtatttttagtagagacgggtttcaccatgttggcctggctgatctcgaactcctgacttcgtgatccgcctgccttggcctcccaaagtactgggattacaggcataagtcactgtgcccggccgagattttatatctctatctctgtctgtctgtctgtctgtctgtctatctatctatctatctatcgttttagtcttcgctttttggaaacaaaaatgggctataagacacgatggatggcattgaataggcagtttttagaggaacctaattggttcatagcatacaggataggctttttccttgggtctttgtaggaatattggtcattaatagctatttttccatgcagaatatttctagttttgcaagaatctgaagctgtggtagattcagataattttgaaatgtgaagctgattctcttgcttggcaacttgatttgtttgggggaatgtggttgacgcatgtgccttttttttttttttttttttggtgagacctgttgacagaaattcaatcttgattaagggacgcaggaaggcatccagttcccaccatgcctggggctctctcatttaaacagctgcctttggctctggcctgttccatttcccactaggccctgtggactttaattttggaagatttcacatcctcatatttattatttctgggggaggtagtgtcgtgaaaccgaaattacccagtagttagcttttcgttttcttgatgtacttgtcctatcagccttaattgaagagagtcagacttctcaatggatatgtatttatttattctctttttccagggagaggggatggtctcctgagttggccattctagaccaaaatatagcttaaaagaagcttttttaaagaacaggtcatgttaggaaaataatattttgtttttaaaatttcacctaaagattaagtgtacttaggtttgcacccctcgccgtttgttccccactaatcaaatgtagtcttagacctcagaggacagcctttcttctgctgcttgaaccctcttcatagtctctttactctagaatatcactgaggttttcactaaccaccatcttatatagaggaaaaacttcatatggaaaagtatacttaaaaaaagaggaatcaatggattttttaaaaaatttatgggaagattcagatcagagctttccaaatatatttataacaggatttgtaatttgctaaagttttctttatgagcatatcagggatgcttagttttcataaagggcaggatttgtctttgttgaacaggatcttatgatttgattacctacctcctttttgaagcaatgtttataggaaaacttgtgcattagagagaccccagattttggaatcctgcagacttgttcttttaaaactcaacactgctatgtattagtttggtgatcttggaatagtgtaacttctctgagcttgtttccttgtttataaaatggtgatggtagcatttatttataaagacatctatctattgtctatattgttaatgcagtttaaacgagatgatttatgtgaagtgtctggtaaggtgcctggcctacagtagacagtatttggaagttattatctcttgctccatgacatttgttatttatctatttaaatgtgaatttttttttttttttttgagacagagtcttgctttgttgcccaggctggagtgcagtggcgcgatctcggctcactgcaacctccgcctcctgggttcacgccattctcctgcctcagcctcccgagtagctgggactacaggcatccaccaccacgcctggctaatttttttgtatttttagtagagacggggtttcactgtgttagccaggatggtctcaatctcttgacctcatgatccacccgcctcggcctcccaaagtgctgggattacaggcgtgagccaccgcgcccagcttaaatgtctatttttaaataaataggcagtggataagaacaccaccttcggtgtctattccatttggaatcctggctttactgcttcttagctgcatgactgtgaataagtagtaaatctctctgtgcctcaagtccctcagtatagaatgaagataataacagtacctactttataggattattgtgaggatttagtgagttaatacatgtaagacactgtcaacagtgtctggcatgtcataagtgctcattaagtaatagctgttggccgggcacggtggcttacgctagtaatcccagcagtttgggaggctgaggcgggtggatcacttgaggtcaggagttcaagaccagcctggccaacatggtgaaaccccgtctactaaaaatacaaaaaattagttgggcatggtggcaggtgcctgtaatcccagctactcaggaggctgaggcaggagaatcacatgaacccgtgagccagaggttgcagtgagccaagattgtgccactgcattccagcctgggcgacaagagtgaaactctgtctcaaaaaaaaagaaaaaagttaatagctgtttttatttttaactttttcaaatttatatacccttttattaagtcaatgccccaggaatcatttttagttctatatagaaatcttattatttgtttatttttaattttttaaattaattattattatatttttgagatggagtcttactctgttgccaggctggagtgcagtggcacgatcttggctcactggaacctcctcctcccgggttcaagctattctcctgcctctgcctcccgagtagctgggactacaggcgcatgccacgatgcccagctaattttgtgtttttagtagagacagggtttcaccatgttggccaggatggtctcgatttcttttttttttttgagacggagtttcgctcttgttgccccggctggagtgcgatggtgcgatcttggctcactgcaacctccaccccccaggttcaagcaattctcctgcctcagtctcccaagtagctgggattacaggcatgcaccaccacacctggctaattttatatttttagtagagacagggtttctccattttgaggctggtctcgaactcctgacctcaggcgatccgcccgccttggcctcccaaagtgctgggattacaggtgtgagccaccgtgcccggctatttatttatttatttatttatttatttatttatttatttatgagacggagtctcacactggagtgcagtggcatgatctcggctcactgcaacctctgcctcctgcattcaagcgattctcctgcctcagcctcccgagtagctgggattacaggcatgtgccaccaaactcagctaatttttgtatttttagtagaaagatggggtttcaccatgttggccaggttggtagttctatatagaaatattagaaagagaatatgtaacatttgggtaagttaatagtcaatttataggccacgtaaatgggaaggattatttccttaaatcaagagattagacaatcattgcttgtcatgaatatttaataaaaatttgagaaagctcagtttcttttgggctgcaaacatagatctagggaaataaatactgcttaactattttgttgttgttgttgttgttgtcttttaagagacagagtctcactctgttgcccacgttagagtgcagtggtgcaatcgtgggtcactgtggcctcaaactcctggactcaaatgatcctcccacctcagcctcctgattagctgggactacaggcacacaccaccatgcccagctacttaggaggggttgaggagggaggatcctttgggcccaggagttcgagtctagcctgagcaacaggctagattctttaaaaaacagagatgaaaaagaaagaaaaaaaggatgtgaagggttaaatttgaacactttccaggtagttttcagcatcatgctttggtggaatcatggttttgaggctaagtggggttgctgcatgttacattcctgcctcttccttcccccagctttagtcgtcttcattacattcatgcctgggaagccttcccagtgacctgagttaggcattaagatcatgggaatccaagattttcccatgtcttctagcatatttgttcacaagaaaaggaaaatttcctccttgcagcaaggggtttttaaccactgtcagtaccatggaatctttcactaaaaatcctttgaatagaaatgtggtcaaggagaggaaaggtatcagcagtgataataccttacaatagtgtatttcatagcacttgaagtagcttcttatttgattatggtaagaaggtaggcagagaattagtgacttgcctattgtcatatacatgtggtaaatgccagagagggcattctggacttctgttagttggaattgcttttgactacaggtgacagaaaatgtggctataatggtttatacaataattattattattttctgagatgaagtctcactcttgtcacccaggctggagtgcaatggcgcaatctcagctcactgcaaccttcgcctcctgggttcaagtgattctcctgcctcagcctcccgagtagctgggattacaggcacctgccaccacacctggctaatttttatatttttattagagacagggtttcaccatgttggtgaggctggtctcgaactcctgacctcaggtgatccgcctgccttggccttccaaagtgttgggattacaggtgtgagctaccgtgcctggcctatttttttttagtataagaagtctttttagcaggtcatggaaaattgtaaaaaacaccagaagtctagaggtatatagtagctgatatttgatctttaatagtcattagctcattgatgttaagccctatgtttattgttctcttggccatctactcatgtataccagatgactgccatagctccagcttgccttcaaggcaagaagaaggataaagggaaagggcaggaataagggctatagctgttttcaggaaagaaaattttttcctaggaatccctcagcagattcttacttagttctcattggccagaactgtcccatggctaccccaagcttggaaagtggctatcaggaggtaacttccattttaatgtacttgctactgttttggtcatggtcaatgaaaaatatttaatcgtaccttgacttcagccatgttaatttctaattctctatacttagagttcatactgtataatttaaacaaactgtcttatttattgtgtatgataggaccttaagcgtctatgtagatgttaagttcctttgtgttcaggactacatctacttttttttctttttttttgagacggagtctcgcactgttgcccaggctggatgcggtggcgtgatctcggctcactgcaagctctgcctcccgggttcacaccattctcctgccttagcctcctgagtagctaggactataggtgaccgccaccatgcctggctaattctttttgtatttttagtagagacggggtttcaccatgttagccaggatggtctcaatctcctcaccctgtgatccacctgtctcggcctcccaaagtgctgaggttacaggtgcgagccactgagcctggccgcttagatctactttttgtgtgaagatatagagtgtcatccttgaatgttactgagaaacattcaagggcacacagcttatggcccctagcaagtacacactattgtgaaccactgacaaaaagcttattgagttaagcttaataatgaaagtagaaatggaggagagaggaaaatttagactggggataccaaagaacccctattccagacagaagactatggagaatggatttacttggaaataaatacagtattcttttctatgcaaatagcttaacttcatgaacacccttctttaattcacaaggtaagagggcagaaggatgtagaaagaacattgtgctgaagtcacgagcctcaggtccagatctggctctgtttttacgtaactgtgtgatactgggcaagtcatttaatctttctgatcttcagcttctaggttgggaataattgctgctttacaggattgttttgcatatcagaaagaatacatatttagtatatcatggcacctggcatgtaatgaacacctctggtaactgtttttaccatgatccttaggatttttgttgtgtgatcttggagaacccctttttgctttaagttaatatcttatagactgcaaaggttaggtgttaatcaaagtttcctcccaattctaaaatatcatgtttctacactaagtacctcaattagagcattgttataaagatacttgtggaattctggctgcagtgagcataggagagaccatgggaagatgatgttctctggggtctagattgatgtcactgtataaatgaaatatttgttataacagatgtttctggccgggtgcggttgctcatgcctgtaatcccagcactttgggtggccgaggcaggcagatcacctgaggtcaggagttcaagaccagcctggccaacatggtgaaaccccatctctactaaaaatagaaaaattagccaggcgtggtggcgcacgcttgtaaccccagctacttgggaggctgagggaagagaatcgcttgaacccaggaggtggaggttgcagtgaaccaagatcatgccactgcactccagcctgggcgacagagcaagacaccatctcaaacaaaacaaaacaaaaacaacaacaataacagatgtttctgagacactataaggaccagaagtacattatttttatttattttattttttgagacagagtctcgctctgtctcccaggctggagtgcagtggtgcggtcttggctcactgcagcctcccgggttgaagtgattctcaccgagtagctggaactacaggtgcagccaccaccccaggctaatttttgtattttcagtagagatggagtttcaccatgttggccaggctgttctcgaattcctgacctcaagtgatcctcccgccgcgtcctcccaaagtgctgggattacaggcatgagccaccactctcagcccctagtccattttgaattgccctagtccactgagagaagctgtgaaatgctggccaaaccactgaacggctatgtaggttgggagtaactaatctcatgattcatctcagtggatagcttatgtggtatagtttagagaaaatgagtgctgcagtgcccagagttggggagagtttggggaactggcacactcctggtaatgtaagtgggtgtttttttcttctgagggacattttcacagtatgtgtcaagagcttttgacccagcagttccacctcttaagatttatcttaagggaagaattatggatgtgtacagaaatttagctacaaggatgatgctttagcagtatctttaaagtgaaaatattggaaaaaggctgaaaatcaaggataagtaattatggaacagatacagccattaattgatatgtctatatttattgacatacaagaatattcataatatgtgaagcagattcaaactgtcaatgattcatttaaaaaaataatagtttgtatatatatgagggagaagacatctggaatagtgtagcattataggtttatttatttatttatttttgagccggagtctcgctcttgtcacccaggctggagtagagtggcgtgatcttggctcactgcaacctccgctgcctgcgttcaagggattcttatgcctcagcctcctgagtagctgggattacaggtgcccaccactgcgcctggctaattttttgtatttttagtagagacagggtttcaccattttagccatgatggttttgatctcctgacctcgtgatccacccgccttggcctcccaaagtgctgggattacaggcgtgagccaccgtgcccggccgcttttttgtatttttagtagagatggggtttcaccatgttggccaggctggtctcaaactcctgacctcaggtgatccatccgccctggcctctcaaagtgctgggattacaggcatgagccactgcgccacactagaaaggtattaatttaaataaacatttattcaagtgattactggcatctacctcccttctaagatacagatacttttaagtacatgtcgttccctggataaaaacaaatggctggccgggcgcggtggctcacacttgggaggccgaggtgggtggatcacttgaggtcaggagtttgagaccagcctggccaacatggtgaaatcccgtctctactgaaaacaaaaaattagcaaggtgtggctgtgggcgcctgtaattccagctactagagactgaggcaggagaattgcttgaacccggaaggcagaggttgtggtgagctgggatcatgccactgcactccagcctgggggacagagtgagactccgtctcaaaaaaaaaaaaaagacaaatggctcattgggtttcattggcaaattattggccactgagtgtggcctttaggctatttatcagattactttcagctattttattaactagattaggcttgagtaggagctgactttaaaccttcacaggtttccacaagatagagtgcaaaacttcgtacgcaggagtagggaggggcctatttaacttgttcccttatccttgcttctgttcctatgctgcatgttgtgactcttacgtgtatttcaaagttgtcgtctttatactcagaaatagtattttttgagaatatttctaagaaaagacaacttatatttgacaaaactgtgttgaactcttactatgtataatgcactgtgttaagcaccttgatggttggatggatggatggatggatgaggtatacacaagtgagtaaaatctatctttgtttttaggaacttcgagtctactgggagagacatttacatagttaatataaaattggatgataagtgttacagtggagatataaacaaagcacaattggctttggagaggcaacaattttgtatgataggtggaaattgggaaagagttcatagagatttgacctggactttgaatgatggataagattttggttggtaggcataaaaattagtggtgtattttagaaattgggttattcagggcagagagagaataaattgggctagaggaggctagaaatgagaaaatggtaaattgagggaaaataatgacatggtgaatgtaaaacacctagcacagtgtagatacttatcaaactttgcctcttttaaaaaacatttagaaaatttatttatttattttatttttatttattattattttttttgagacagagttttgctcttcttgcccaggctggaatgcaatggcgcgatctcgactcactgcaactttcacctcccaggttcaagcgattctcctgcctcaccctcccgagtagctagaattacaggcgcctgccaccatgcccagctaattttttgtattttttaagtacagaagaggttttgccatgttggtcgggctgatcttgaactcctgacctcaggtgatccacccgcctcagcctctcgaagtgctgggattacaggcgtgagccactgctcctggcctaaaatttatttttaatttcaattttttctttttggtttttctttatatttgctgattacttaaagataatttttatttttttagagatagggtcaactacttacagataatttttatctttttagagacagggtcaactgttatacttagagataattttaatttatttagagacagggtctgtctatgttttgtaggctggacttggactcctggtctcatgtggtcctccctcctcccaaaatgctgggattacagacgtgagccactgtgtctggcccacttctttctaattccaaacatatctacctcaaggagtatctttaagttacctgaaaaactaatgtttaggttgattggacaaagtaaggctattttcagtaaattctaggtggtttgcaaaattacaaacgtggtagtaaaaccaaagtaatgatgggaatttacttagatttatgtgcaaccatttctttcctcagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttggtaagtgcctgctttctctggctattttaaggattagtggcttgctttgtgctgaagacctttcaataatagaaggggttgcaagaaaagaactaaaatatcaacttctttctgcaccaagacattctgtcatccatgatattatgggaataattgaaatgcccagtatttggggaatggattgtaagtacaaagcatatgttgttttgtagttcagaatggcagatttaagctttagggacctatgggaaagttcagatgaaccagtgttcaacaaaactccatgctcaaatatgtctgtagtgatggcagccacataaaaactttgtctactatcattagggatagattatatcacagctaggatattgacattcatacaatctaccagttttactcagatttctccagttttacttgtatgtgtattaagttctctgtggttttatcacctgtgttggtttatgtgtctaccatcacagtcaagatcttttataattaccctcacctccctcctgccacccctccctcaattcattttttttttttttttttttgaggctgtagtctcgctctgttgcccaggctggagtgcagtggtacaatctcagctcactgtaacctccgccactcttgttcaagcggttctgcctcagccgcccaagtagctgggattacaggcgcccaccagcatgcctaactaatttttgtatttttagtagagacagtgttttgccatgttggccaggctagtcttgaacccctgacctcaggtgatccacccacctcagcctcccaaagtgctgggattacaggcgtgagccactgcgcctggccctcaattcatttttaaatggaaggattatgctactaagaacccattcccagaaacagtattgcttggccaatggtaagtaagaatgtggttacatttttacattactttgaaataatatctgagactagttgttgaggcccctttgattctttctctcatgtctccatcctccttatcgggagaaatcactatgaatatgtggtggggaacagaagtgagtccattgcagctgtacttatccgtatagtgcactgtccaaatgtgttgacaggtgccattttttggaaaaggactttaatggcatctagtggggatcctgagaggagtcgtctgttggaagtggtgtgggaggaagggtaaataaatacaagggccagctgtcctgcggggatcttccccatgcccttgcttcactggaactgtaaggaaatggctgggctgtctgaggatttctttttctaagcttttctttaaaataaaaaagaaaagaaaagattagcctaagaatactgttaaatacaatttggaagaaaaaaaatgaccccactatttttccaaaactaccttagttttaaaacatttttatttttttttctttttgtttttgccagagttcttttggctaacaaaactacctcagttttaatatattactttccaatttctttcccaaataaatagtcacatctttctacacagttgcaatcagaatgtacatgcacagggtagttattgctgtgtctcactgcattcctgaaactatcagtaggctgttggtagaacagacccttcactgctttgtactgacttctgggcacagtagaatctaagataaaatttcttgagagaacctagctctgctctaccctcacacaccccttattcctcccaccaccccactgaggaggaaactctgtaagactatacagtatctcttgtaagccctacagtttttgatggttacagttttctttcgtttttttttttttttttttttttgagatggagtcttgctctgtcgccaggctgtagtgcagtggtgcggtctcagcttactgcaaattccaccttccaggttcaagcgattcccctgcctcagcttctcaagtagctgggattaaaggcatgtgccaccacgcctggctaattttttgtattttagtagagacggggtttcaccatgttggccaagacagtctcgatctcctgacctcatgacccacccgcctcggcctcccaaagtgctgggattacaggtgtgagccatcgctcccggctggttacagttttctttaagaggaacatgatatatttagggagtagataaagccagttcatatttgtatgaccctaaatgtgtaccaaacaaagataaggagttattcacaatgcagaatctgtacttttccttttttataatacattgttcaatgttgccagtttttagtgattgttcttatagtctatctcggatgtgtaatgtgtactttttcttttgattgctagaactttgcttgtacttgccacatgagttggaagtgtactggtagggagctttagtttgcattttaaatgcgtgatagtgatttgttttgcttccttgctgatcagacaatgatgatcttcccttttcacagaggagaaggccaatttggagaataagttactggggaagaatggaactggagggctttttcagggcaaaactcctttgagaaaggctaatcttcagcaagctattgtcacacctttgaaaccaggtaagaaaacatcttagaaaaaagctccttgatagaatggtgggacagtgttttagaagcctgaggttctgggaaaattacctaaatgctctatctctttgtttattattggtgaaatgggctaattcatttcatgataaatgtaaaactaatgatgtgctacacttaaaaaaaaatctcttggagcttaagctaacatagaatttttttttttttttctttaagatggggtctggttctgtcacccaggctggtggagtacagtggcacagtcatagctcactgcagcctcaaactcctgagctcttagtaactgggactacaggtgctcaacaccatgcctgactgatttttaaaaaattttagtagaggagtctttgctagccaagctggtcttgacctccgggcttcaagtgatcttcctgcctcaggggcttcccaaagtgctgggattataggtgtgagctactgttcccgggggctaacatagaattttattgccagatacgtaactgttatctttttgtgacaagatttaatgtaacctaacctgggtctgggtgggaaataaaacagcaagaaagaagactgtactgcttgccattgtacaagaattctttgagttatgtatctgattttaaaagatgatggatcgcttctcggccttttggctaagatcaagtgtaaaagatgattgacatttaaactggtgggtactggatctgcagaatattgtctgtttggttagaacataagaagcattctttaagaggtcataaaatccttcttgaaattgattcttttgaaaaaaacagctgtatttagatttaactcacacatcatatgattcacttaagataaacatttcagtgtttttaagtatattcacagagttgtgcaaccatcatcctatcagtttagaacatttgaaaagtattatgtgggtaaatctgaaactggtctccatcacaccatatgactactctcacctccctcctgtcacccctccttcaattaatttttttttttttttttttttgagactggcgtctcaccctgttgtccaggcaggagtgcagtggtatagtctcggctcactgtaacctccaccacctgggttcaagtgattctcctgcctcagctgcccaagtagctgggattacaggcgcccaccagcatgcccggctaatttttgtatttttagtagagacagggtttcaccatattggccaggctggtctcaaactcctgaccttgtgatccgcccacctcggcctcccaaagtgctgggattacaggcgtgagccactgcacccggtcaatatttatctttctatgcctgacttacttcacttaacataatgtccttcaggttcatccatgttgccatgaatgacagaatttcattcttttttatggctaaatagtattccattgtatatatatatgccacattttatctgttcatctgttgatggatacttcagttgattccatatcttgactattgtgaatagtgctgtaataaacataggagtgcacatagatatctcttcgatgtactgatttccttctttttggatatatacccagtagggggattgctggatcatatggtaattatatttttaattttttgaggagcctccatactgttttccataatagctgtactaattgactttactactaacaatatataagagttctcctttctctgcatcctcagggatgcagagaaatttttaatatttttcatagtgtccattctaactgggatgaaaggatatctcattgtgatttttaatttgcatttccctgatgattagtgatgttgagcattttttcacatacctgtttgccatttgtatgtgttcttttgagagatgtctgttcagctcatttgtccggctgttgagttatttgagttccttgtgtattctggatattagtcccttcttgaatgaatagttagcacgtattttctcccattctttagttgtctcttcactctgttgattgtttcctctgctgtgcagaaagttttaaatttaatataatcccatttgtctacttttgcttttgttgcctatacttttgaggtcatgttcataggatctttgcccagaaccgtgtcctaaagtatttcacctatgtttttattttattactttatttatttatttttgagacagagtctcactctgttgcccaggctggagtgcagtagtacgatctcggctcactgcaacctccgcctcccgggttcaagtgatcctcctgccccaacctcccaagtagttgtgactacaggcgcgcaccaccacacccagctaatttttgtatttttagtagagatggggtttcgtgatgtcggtcaggctggtcttgaactcctgacttcaagtgatcctcccacctcggcctcccaaagtgctgggattagagtcatgaaccaccgccctcggcctcccctatgtttttagttgtttcatagtttaaggtcttacatattagtctttaatccattttgagttgatttttgtatatggtaagaaatagatgtctagtttcatttttctgcatttaaatatctagtttgatcagcaccattttttgatttttcaaatttaaattttattttagagatgaggtcttactctattgcctaggcttgtctcagaattcctgggcttaaacaatcctaccacttcagcctcccaaagctagcaccatttattgaaaagactgtccctccaccaaggaatgttcttggtgctgttgtcaaaaatcagttggctataaatacgtggattttttcctgggttctctatcctattccatttgtctgtgtgtctgtttttatgccagtaccatgctgttatggttactatagctttgtaatgtattttgaaggctggtaatttgatgccttcagctttgttctctttgcataggattggtttggctatatggggtcttttgtggttccatgtgaattttaggttttttttcttgagacagagtctcactcttgttgcccaggctggagtgcagtggtgcgatcttggcttactgcaacctccgccccccgggttcaagtgattctcctgcctcagcctctggagtagctgggattacaggcatctgccaccacccctagataatttttgtatttttaatagagatggagtttcaccattttggccaggctggtctcgaactcctgacctcaggtgatctacctgcctcggcctctgaaagtgctgggattacaggcgtgagctactgcgcctgtcctgcttatacattatttatggctgttgtattcttactaatttttctttccatttgttccatcaattagagagagaggtagtgaaatctcagactgtaattatggatttgtctctttatctttataatttttgcttcatatagtttgaagctactattagatgcataaatgtttaggattgttatgtcacgttgatgaattggccactttaatttaatttaaatttaatttaatttaaatttaattttttttttttttttggctggacgtgatacctcatgcctgtaatcccagcactttgggaggctgaggtgggcggatcacaaggtcaggagttcgagaccagcctggccaatatggtgaaaccctgtctctactgaaaaatacaaaaattagccgggtgtggtggtgcgcacctgtagtcccagctactcgggaggctgaggtaggagaatcgctgaaacctgggaggcggaggctgcagtgagccaagatcatgccactgtactccagcctgggcgatagagcaagactccatctcaaaaacaaaaaattatatacatatatatacacacacacatacacacatatatatacacacaagcatatatatatgtacatacatctaatatacatgtatgtgtgtatatatgtacatatacatgtatgtgtacatacatgtacacatacatgtatatgtatatatttttgagacagggtctcactctgtcacccaggctggactgcagtggagcaatcacgcctcactgcagcctctacctcctgggcacaggtgatcctcttacctcagcctcttgagtagctgggaccacagatgccactaccatgcctagctagtttttgtattttttgtagagacagaattttgccatgttgcctaggctggttttgaactcctgggctcaagtgctccacccacctcagccttccaaagttctgggattacaggttgagccactgtgcctggccccactttaacagtttgaaatgatcttctttatccccattgaaattctgtgctctgaaacctactttgcctgatattaatatagccactctagttttcttttgattggttttagcatggtatgtctatatttaaagtgcatttttttgtagacagcatataattgggtcttgctttattatttaatattattgttgctgcattttaattggaataaatgcatctattttagccttgacatgctatgctattattttgtgtgtgcgtgtgagtctctctgccccaaaaatatttctttaggagatgaaccaaatgattgttctctgaaatgaataatgcctaaactatgttttcatggcctatcttttcttccctgtcatcttgttgcagtttaattcctttatcaggagtcagttcatatgctatgtgattaagtgctgtttcttccatgaagcctttacttgtttcttattctgttttgtttttttgtttttgtttttttttttgcagacagggtctcagtgtgtcaccccatctatagagcagtggcatgatcacagctccctgcagccttgacctcctgggctcaagtgatcctcttgcctcagcctcctgagtaactgggactacaggcacattccaccatgtctggctaactttctcagtgttcccataacactttttttctatttcgttaaaaatgtttatcaaggctgggcttgtagttcatgcctgtaatcccagtactttgggaggccaaaatgagaggattgattgaggccaggagtttgagaccagcctgggcaatatactgagacccccatctctatttatataatattgaaaagcaaaaaaaaaaaaaaaaaacgtttatcaaaataaaacatggccatggtaacatggctaacaatacttagagtttatgttaaaataacccctttctcttcccatccctaccccctgtcctttttctcaaactcatattggttttgttgttgttgttgttgtttgtttttatattttgttttacaggtgggatctcactgtgttgcccaagctggtctcaaaatcctgggctcaagtgatcttcctgcctccgtcttcccagtagctgttttaactcactattttaacttgtgctgtggttacattcataatgcctgatagtatgattatatcagcagtatttacaatgttatgattatataaatattgttcaatgccagatcaataactgtgatgcagttgcatcccttcttggtactctttggctatctttggttgtattgtcacaacccctgagccacataaagatgattctgacatcaggagatcagtggatttgcttttctttaaactttatcaatttcttaaatttctgccacactttatcttgcttcatattggacaatgatccttggaagttattactacttttttgggagagcattattatttttactatctttgctgccttgtttcctggaccttataactttcttctggatatactccttcattatgtgggagtgcatcctcaggaaactttcttaaattagtgcaggagagaaaaactttgagttctcacatatttgaaaatggcattgtttcacttttatatacaattgaaagtttatcttaatacagcattatagattgcaaattattttttatcactactctaaagacattgttcctttatcttctatttttatgtattgctgatgaaaaattcagtgcttatctaattttccttactttgtaagtgattttttttcttctttatggaagctttcagaattttatctttaccagtgtcctgaaatgtcatgagattgtgtttgggatgctttttttaaaggtagtaccttaggctggcaaataggcaagccctggatacatcatttctgtttcaaccaaagtagcttttataaactggtcttctgtataagatttaactggaactaaggtttctgtggcttagacagggtgtgtgtgtgtgtgtgtgtgtgtgtgtgtgtgtgtgtgtgtctcatctccaattattttccttggcctttgagtgctgactagcttttggtcttccgcagttgacaacacttactacaaagaggcagaaaaagaaaatcttgtggaacaatccattccgtcaaatgcttgttcttccctggaagttgaggcagccatatcaagaaaaactccagcccagcctcagaggtaagactttggaatctcaaagtggtggttatgataataatgttcaaaggatagttactggacagaacatctattatgtgtctatactgtgtttatggacacctttatgttactttttttttttttttttttttgagacggagtgtttcgctcttttgcccaggctggagtgaagtggcatgatcttggctcactgcaacctctgccccaccgtgttcaagcaattctcctgcctcagcctcctgagtagctgggattataggcacctgccaccacacccggctaatttttgtatttttagtagagatagggttttgccatgttggccaggctggtctcaaactcctgacctcaggtgacccacccgcctcagcctcccaaactgctaggattacaggcgtgagctactgcgcccagctatgttacctttaaaaatcctcataatatgggtttgtgtggttggtataaattaaaaaaaatctgtataacatttatgagttgtaggtaatatgcttaattaatttatagataaggtctcagagatactaagttgcttgcttaaggcaagtttatttcagagccaagattcaaactcttatcaatctgtttccaaaggccttgtatggatataattgttacatcttcctgatgtcaaatatctttgttcttctgtattactttagctctctttttcttttttttctttgagacagggtcttgttctgtcacccaggctggagctggagtgcagtggcacatagttcactgcagactcgaactcctgggttcaagtgatcctcctgcctcagcctcccaaagtgctgagactatataggcataaaccaccgcatccagccaatagacaaatttttattttatttatttttgagacagagtcttgctcagttacccaggctggagtgcagtggcatgatcatggctcactgtagccacaacctcctgggctcaagcagtcttcccacctcaacctcctgcgtagctgggactacaggcacaagccactgtgctcagctaatatttttgtatttcttgtacagacaaggttttacgatgttgcctaggctggtcacaaactcgagctcaagcaatccacccacctatgcctcccaaagtgttaggattacaggcatgagccactgcacccaggccagagtagagtttataatcagagtttagtgtttaccctctctgtggttttcttgcttctgaaattttgcctcaaaaatttcatcttttttttttttttgagagagggtcttgctctgttgcccaggctggagtgcaatggcatgatcttggctcactgcagcctcgacctctcaggtgtaagcaatccttctgccttagcctcctgagtagtggagactacaggtgcagggcaccaggtggccagctaattttcgtattttttgtagagatagtgtctttccatgttgtccaggctggtcttgatctcctgagctcaagcgatctgcccacctatgcctcctagagtgctgagattacaggcgtgagccaccatgcccgacacatgccatccttttttttttttcagacgagtctcgctctgtcgcccaggctggagtgcagtgggcgatcttggctcactgcaacctccgcctcccgggttcaagtgattctcctgcctcagcctcctgagtagctgggactacaggcgcccgccactacgcgcggctaattttttttttttttttgtatttttagtagagacggggtttcaccgtgttagccaggatggtctcaatctcctgaccttgtaatccgcccaccgtggcctcctaaagtgctgggattacaggcgtgagccactgtgcccggccggaaagatttcttaaacaggacacacacagaaaagcactgaccataatgggggtggaagaggttgataaattcaggcacatttatctaattaaaagataaagagatgaaaagccaacccctagagtaggagaaactatttgtaacccatgaatcctacaaagggcttatatccagagtatacaaagaattacaaatcaattagtaaagaattgacaagccagtagaaaacaggcaaacgacttaaactagcacttacgaaaagggacaaccaaatggccgatacacatgtgaaaatgtactcagtttcactgatcatcagagaaaagcacattaatttcctatgacccagcaatcttattttttttagaatagttaaaatgaggagataacccatcaatagtagactgaataaatagttgcacatccctacaatgaatattatacagcaatgaaagtcagtgaattagagctgtgtgaattgtcgtggttgaatctcacatacataaagttgagtgagataagccagacagaaaagaatacttgtagtagtgtggttacattatacaaaatttttgggtgcagcacaccagcatggcacatgtatacatatgtaactaacctgcccattgtgcacatgtaccctaaaacttaaagtataataataaaaaaaaaaaaccacaaaattttttgtttttcttcgaaactaacataccatgtttacgtaatacgtgcttatttggtaaaacaataaggaaattatctaatgatcacgctttttttttttttttttcaaggcggagtctcgctctgttgcctaggctggagtgcagtggtgcgatctcggttcactgcaagctccgcctcccgggttcacgccattctcctgcctcagcctctcaagtagctgggactacaggcgcccgccgccacgcctggctaattttttttttctgtatttttagtagagacggggtttcaccatgttagccaggatggtctcgatctcctgacctggtgatccgcctgcctcggcctcccaaagtgctgggattacaggcgtgagccaccgcgcccagcctatctaatgatcactcttaaaatcaaggtagcagtggttgtcagtgttctgtattttggcctaggtggtgatttcataaggtcttccactttgtagtcatttaagtatttttgttttgtgcactttttggtatgtattagatctgtcattatgctctttgttttgtattcatcttattgatttatttatttttagacagagtcttactctgttgcccaggctggcatgcagtggcacgctcatggcttactgcagccttgacctcctgggctcatgtgattcttccgccccagcttcctaagtatctagcaccacagatgcgcaccagcacgtagggctaatttttaaaaaattttttgtagagacagggtcttgatatgttgcccatgctggtctgaactcctggcctcaagcagtcctcctgccgcagctttccaaagtgctaggatggcaagcatgagctaccaggcccagccaagtttttctttttaatcattttattgaggtcacatttatagacaccggtgtatttaagaactaaaatgttatggttgaatttcaaaaactatcaacaagagagattagatttttagagcagagataatagcactccattttattgccctttgtagtttgacatcctttcacatttctcaggaacatttggatatctgtagtatatatatttattatatattttgtcaatttctctaccatagaagatctcttaggctttctgctcagaaggatttggaacagaaagaaaagcatcatgtaaaaatgaaagccaagagatgtgccactcctgtaatcatcgatgaaattctaccctctaagaaaatgaaagtgtgagtagccacaacttcttactgccaagggcagacatattgtaccttgtataccacttgtaagtttcttttctgaatttacactttagattgaatagattaaaattaaaaatggtacatctgtaatatgtttggtgtacctcaagcttgagaaatgcctaaaactgtgaccatggtgaggtgaattgttacgtgtgtcctggagggcactcacatcttagttggcataggttttacctctttttgtttttacggctaataacaagctgcatacatgatgtttgtttatatttttattagttaagaatgtattttgctgcaagtaatagtcttcaactggagtggtttaaagaataatgaattatttgtttcacagaggtctaaaagtagtttgctgctggctttggttcagtggctgatttttagctttttttttttttttttcgtacttgttcttcaagatgctgctctgtgtttcttagattttttcttttgcttgttgtctcactggcacaagatggctggtgtatctctaggtgttatatttatgtttaagagaagaagaagagtacagtaaaggaaaaagggcagcatctatatcaggaaacttaagtctttcgcagcaacccttaaatttcatttcattcgcctagacttgtgtcacttggattccctagttgcagtagaggctgttgaggcaagtacaatacttacttgtagcttagtgcgttgctgctcctcccgaaattggggttttgttaatgagaaagagacagaatagatattgggatggcaattaactctgccatttgatcatttgatggtgagcagttagagtccctccttactcttccaaaccaccactagataactcttatcttgatagcggttggctttctcaaagtttactcattgaagccattaatatatatgatctaatgatactgttggaagaatcatgtggtcgaagcatgcttgttatcctatagaatgagaaaatttaatccatatgcagtagatttggggaggagggtacaggctatgcttcagggaattgaaaacatattttttgtccttttgaactcaagttctaacaacaaaaagaagccagaggaagaaggcagtgctcatcaagatactgctgaaaagaatgcatcttccccagagaaagccaagggtagacatactgtgccttgtatgccacctgcaaagtaagtttctttcctgaatttaaactttagaatgaatggtataaaattacagatttacatctacaacctgtttggtgtacctggaggttggcaaactcctgaagctttgaccatggtgaggtgaattgttacatgtgtcctgatgggtgctcagatttttaaatttttatttaattaattaattttaaagacagggcctcattctgttgcctaggttggtgtgcagtgatgcaatcatggctcactgcatccttgacctcctgggcttacgtgatcctcccacctcagcctcccaagtagctgggactataggcatgcactatcatgcctggctaactttttttttttttttttttgagacagaggctcactctgtttcccaggctggagtgcagtggcatgatcttggcttactgcaacctctgcctcccgagttcaaacaattctcctgcctcagcctcccgagtagcccggattacaggtgtgcaccaccacacccggctaatttttgtatttttagtagagatggggtttcaccatgttggccaggctggtctcgaattcctgactttaagttatctgcccaccttggcctcccacagtgctgggattacaggtgtgagccactgtgcccagcctacctggctaacttttacatgtttttgtagagatgggatttcactatgttgcccaggctctcaaactcctggcctcaagcagtcctcttgccttggtctcccaaagtgctgggattacagatttgagccacagtgctggctggtgctcagatcttgaacagtcagaaaaatatactgttgaagcaaatttaaaagaaatataaaaggaaaaagttagcaacagttcttaccacgtagattgaacattttttatttttccaacctccctgctggattttacccaagccagcatacatattttcacaatcagttaatacaaaaccttgggttctgctttattgacttgccatgagattatttcagattttgtttctgtgctgctacaaaattttcacatttatccttttttgatagattgttaatattctatcaaaatatatttaactattttctgttgaaaatgtagtttccagcttttcatgattataagtactcagtcaacaactttataggcagaaccatttctttgagtgatcttctcagaataaggaaggagaaattccccacagggtatgaccagttttgtcagtgttgatatttattgccaattttacttctgaaatggaagtaccaatttatagtgccatcggctttttttttttttttttttttttgagatggagtctcaccctgtcacccaggttggagtacagtggcgcaatcttggctcactgcaacctccgcctcctgggttcaagtgattctcctacctcagcctcctgagtagctgggattataggcatgcatcaccacacccggctaattttttttttttttttttttttttgtgagacggagtctcgctctgttgcccaggctggaatgcagtggcacgatttcggctcactgcaacctctgcctcccacgttcaagcaattcttctgcctcagtctcccatgtggctgggattacaggcacctgccaccacacctggctcattttttatttttagtagagatggagtttcaccatgttggccaggctggtcttgaattcctgacctcaagggatctgtctgcctcagcctcccaaagtgctgggattacaggtgtgagccaccatgcctggccccggctaatttttgtatttttagtagagatggggtttcatgatgttagccaggctggtctcgaactcctgacctcaagtgatctgcccgcctcagcctctcaaagtgctgggtataggtgtgagccaccatgcctggcctgaagtgccattggctttgaatgaatatttttattttcttattatctcatctgcattgtttattaacttataaaattgtttctttttttaaattcatatagatggcatgaaattattattttaaaaatttaattgtaaattgataatttatagttgtatatatttatacagtacaaagtgatgttatgattcatgactacaatttggaataattaaatctagctaattaacatatctgtcacctcaaatacttaccactttttgtagtgagaacatttggatttttttttttttttatcgagatggagtttctctcttgttgttcaggctggagtgcagtggtgagatctcagcttactgcaacctccgcttcccgtgttcaagtgattctcctccctcagcctcccgagtagctgggattactggcacttgccactatacccagctaatttttgtatgtttagtagagatggggttttaccacgttggccaggctggtctcaaactcctgacaggtgatccacctgcctcagcctcccaaagtgctgggattacaggcatgagccaccgcgcctggctggaatttattctcttagtgtattacgattactaatgatatcctccaccctgtgcagtagagcaaaagaaaaatctttttcctcttgtctgagatttgttgtactctttaatcgtcatctccccatttcccccaacccccagcatcaaattattttaatttttatgtatttgctgacaagattgtattactgctactattgtaaacatttttccatatttcctcttgggtgaattatctgtttcctttttattttttttcttattggtaaccttatttgcctataagtgtccttggtgatattttccttactaagaatggatactctgtgttgaacattaccatgtgtcaagcacttcagagacatcatctgattgaacagtcataaataggatgtgaacatgagtatttacactcccatttcacagtggggaaaactgaggctcagggaagttaaatagttttctcaagatcattataggcagcaaatgaaatgacagggttgggatttagtcggctttacttctgagtttcttccttctgttacatgtgttttatgtgtattaaccctaggttgtagatactttcctcattctactggtctttttttgtttttgtttttgagacagggccttgctgtgttgcctaggctggtcttgaactcttgggctcaagcaatatttttgcctcagccttccaagtagctgggattacaagggcatgccattgcactaggcttctactggtcttttagtttttcttgtggcttacaacctaatcttttttgttgttgttgctgttgttgtttttggagatggagtctcactctgttgcccaggctggagtacagtggcgtgatcttagctcactgcaacctccacctcccgggttctagcgattctcctgcctcagcctcccgagtagctaggattacaggtgcctgccactacatctggctaatttttgtatttttagtaagatggggtttcaccatgttggccaggttggtctcgaactcctgacctcaggtcatccacccgcctcggcctcccaaagtgctgggttacaggcatgagccactgcacccagtccaatctcatcgtttatgatcatatttatggatattttgtaatatattttaatctattttagttattttcttctgaaattttttcagtattttggtataaagtgtgcattttcttgtctttatttatttattttttttgagatggagtctcgctctgtggccaggctggagtgcagtggcgtgatcttggctccctgcaacctccccctcccaggttcaagcaattctcttgcctcagcctccccagtagctagaattacaggtgtgtgccatcacacctgcctaatttttgtatttgtagtagagacaggattttaccatgttggccaggatggtcttgaactcctgacctcaggtgatctgcccaccttggcctcccaaagtgctgggattatagacatgagccaccatgcctggccaaagtgtgcatttttatttattttcatggtgttatctaattaagttagcatctatttattagatgatattttttggttttgatgattatcttatcacaggttaaaaatattatataatgcctgtagattcttttgagtcactgggtgcctttctcctctcctctcttctcatttactgattttctctttaggcagaagtttctaaaaagtactgaggagcaagagctggagaagagtatgaaaatgcagcaagaggtggtggagatgcggaaaaagaatgaagaattcaagaaacttgctcctggctggaataggtgagcttggctgtggttgagtctgattcatgaggggtggttcttaacactccttggtagggggtttttttttttttttttttttttttttttttttgagacggagtctcgctctgtcgcccaggccggactgcggactgcagtggcgcaatctcggctcactgcaagctccgcttcccaggttcacgccattctcctgcctcagcctcccgagtagctgggactacaggcgcccgccaccgcgcccggctaattttttgtatttttagtagagacggggtttcaccttgttagccaggatggtctccatctcctgacctcatgatccacccgcctcggcctcccaaagtgctgggattacaggcgtgagccaccgcacccggccagtaggtgtttttgaagtctctgaagtaaataaaaaggctttctcatttagtagtcagcataaaaaagatgtgtttattccttagcactttctacatatattggtattttacatatattggtacttaaatatatcggtactttctttctttttttttttttctgagacagagttttgctcttgttgcccaggctggagtgcagtggcgtgatctccgctcaacacaacctctgcctcccgggttcaagcaattctcctgtttcagcctcctgagtagctgggattacaggggtccaccaccacgtctggctagttctttgtagttttagtagagatgggatttcatcatgttggccaggctggtctcgagctcctggcgtcaggtgatccgcccacctcagcctcccagagtgctgggattacaggcatgagccaccgtgcctggctcactggtactttcttaaaagtctgttcttggtcttagggaaaaaaaggaacttggattgagacagaagataaagtaattgggcagaccagtttgttgttttcctatttttttctaaaggcaaaggaaaagaaaacagtcaaatccaattcacctgtggaggaaaaatatgactgagagagctgaaggggtcacagttctgctttgctcgggcatagagttgttattggtggagtcataactataaagttctccttactggattgaaaaagcacccctggagtttataggattttcctcttagagatgctgagttaactgtgctttcaaagtcaatccatagcttttcttatcaaaagtattccagttattctttttctccatagctatgaccacacctaggagatgggattcttctaccctgtgctactacttttttttagtttgcatctgactgaaaggcctcaaacctaatagtactcagtgaatatgacacatatattagtgtccctgaggactacttcaagttttgggttacaggtagatagtaagcaaagttagatccatggtgacagaaatagcaaaaggactggagtaaaggggatttactggtgttccctatcttaatgttgtctgtatgttttactgtgttcatctctcagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgtaagttgatggactaaatgaacatttctgttactaatattcatttaggattttacgtgtagcatttgtggtcactgtttataatagtataattgagaaaaaaaaccttgtgtctataaagttgtgtaaaatataacagatctttttttttttttgagatggagtttcacttttgtcgcccaggctggagtgcaatggcacgatttcggctcactgtaacctccgcctcccgggttcaagtaattctcctgcctcagcctcccaagtagctgagattacaggcgcctgccaccactcccagctaatttttgtattttgtagagacagggtatccccatgttagccaggctggtctcaaactcctgacctcaggcgatccacctgcctcagcctcccaaagtgctgggattacaagtgtgagccatcatgcctggccaatataacagatcttataggaaaaatagggttggggcagaccagtcaaatctcatgcagttttgttaccagagcaccaacaaaatcagtaataatcgttaagtaaaaatgctagtactaataatctccacttgcatttgtagtcagtatcatcattttttgaaattagttatttgcattcttaaaccctgaggttatgcttctttctttgagatacaggtccttgaagggttttgcttccaattagagaccagttttatcaaaattactggtccaaggaataggaataggcttcttcatcagtctctttaggggatgtatggagagattccactgattcaggaagctgcctgacctgatgcatacccagaggcccaatcaatttttttttttaaagtggagttgagggtgagatttctttgcagtgctttttgtcttcaattctaagatagcttactctggattccttcaaaacattgacatggttggggggaaattacctatgtactattccagaacataagatttgttaagtgctagatcctttcttccatttttaattttttttaatgagaacagattagttataacccttgctcaaggactgacaaacttcagaataataatcttggttttacacaggccttttttattgatcctctgtgccgaatatgtggcttatggtagatgtgagctcttccgtgacatttcatttggggaacaacttttctctttacaggcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattagtaagtttcctaccagtatcacagttggatggaacctctcctacattccctctgcttacatcttaggcacagatttgtctttagctgaaatcctagtttttcaattaaagtatggcgtgtgactatgcagacaacaaatgtatccttcagaatttttcaaaccacccagctgtctgtcttatacccatcaaccgtcttgatcctcctcatcaataattggccaaggggaatgagttaaggtaacctgagatgtcattacacatccttaacggacatttttttgccatgtgtcaaagtgtcacattgcatttagttacctatagaaaatgaaggcatttcattcattcaaggctatgtgctttttattcagtggtccaccaaaatttttactactactaaccaggcacactgtgttaggtatatagaggtaaataaaatagacttggtgctactcaacatcaggtttctaattcaagtttcaaaactcgacatcaagtttcaaaagcctttaccataatttgtagtgacctatttatctctgtcattagagatacactaattagttctttgcattcttaaactgtcattagataaacaggtcactacaaattatggcaggggattttgaggaggagggaggtgcaagagtcaaaggaggtgggagatagggagagcatgtctgaatgttgagaagtctcgtcagagataaagaagctgaaggtacgagagagaggagataactaatggattaagtccctgagcaggcaggtattggagggatacttagcacaggtggagtgagtgttctttaaaaggaggatggaagagtgggaggaatgggtgcaaatactgggggagtttgtagatttggtggtgagcagatgagcggattctaatgtaatagtttctatctttatggaaataatttctgcaagaaggaagatgaaatctgaagggtggaggtggtattaaatagttgttgggagtatagggatagtattctggataaagcagaatgtggttgttttacctttgaggatctctaaattttttatatccttgcataggcattttttttgagacagagtctcgttctgggtgtcatcacccaggctggagtgcagtggcgcgatctcgactcactgcaacgtccacctcttgggtgcaagagattctcgtgcctcagcttcccgagtagctgggattacaggtgtgtgccaccatgcccagctactttttggattttaagtagagaccaagttttgctctgttggccaggctggtcttgaactcctggcctcaagtgatccgcccgcctcaacctcccaaagtgctgtgattacaggtgtgagccactgcgcctggccaagtacagcattttttaatattattattatgttctagtggccaaaatgattttgttagattttatagtatgaaaataatgaaatattcttctttattctaatggaaatttaaatattaagcataacttttcaaataatatatgactcagagtctgatatgtcctgctttcagaatactagtcctggcaaaaggaaagagaaattatattatgcaatttttatttaaaactttgtacagttacagctaaataatggttacatgtatctttgaaacatggcttatttctaaaatagatttggttttgatctaccactgttatgtgacaagacctaaattgaaagattcattctatattagttatgaaaattgacaaggtttcactggccaggtaaattaatattttcaatgagtggtggtgatgtcttaatattgatgctttaacatagtttttaactttctccatttgattttctgtaagatgtggtcttgatgcttttatattgatttcataaaattgggagttttcacttggtcttcttttgttatttatttatttatttattttccttcttgttttgctttttagagacagggtcttgctccgtcacccaggctggagtgcagtggcgtgatcatggctcacttcagtgtccaactcctgggctcaagcaatcctcctgccttagccttccaagtaattgggactatatataggtgcatgccaccatgcttacctaatttttatattttcttaggagacagggtctcattatgttgcccaggctggtcttgagctcctggcctcaagcagttctcctgctttggccttctaaattgctagaattacaggtttgagccattctgttcaggctttacttggtctttaggaaggccttatatctttttttttttttttttttttgagacagagtctcgctctgtcgcctaggccagagtgcagtggcgctcatttggctcacttggctcactgcatgctccgccttccaggttcatgccattctcctgcctcagcctcccgagtagctgagactacaggcgcctgccaccacgcccggttaattttttgtatttttaatagagacgggatttcaccgtgttagccaggatggtctcgatctcctgacctcgtgatccccctgcctcggcctcccaaagtgctgggattacaggcgtgagccactgtgaccggccaggaaggccttatatcttaaagctggaataagcaaaaattttttgtgttaataacaagcaaaataattggcattgtcaatagaaagtataggcctggccaggcacagtggcttaacgcctataatcccagcactttgggaggctgaggtgggtggattgcttgagcccagtagttcaagaccagcctgggcaacatagtgaaaccctgtctctacaaagaatataaaaattagctgggcatggtggtgcatgcctgtaatcccagctgcttgggaggctgaggtgggaagatcacctgagtccagggaggttggatttgtagtgagcctttatgcccctgcactctagcctgggcaacagagtgagaccctgtctcaaaaaaaagaaagtcagtctaggcccgtgcagtgataaggaacctgtcagacatggatggattttcagttcagaagatgacagtagagtttacccaaaggctaccttagtcatacccctcaataaaagaggaataggggagaagtaactgaatgttggttggtttgaccaatgtaagctgagctgactgttgtgggcccaccactctgtggttggtttatccctctctgggctacataggtgaatcaccacttacaagtaaactgggtcttgcggatctagatgaacatctgtcatctctgtttacagacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacagtaagtcccactggcagtatctgaggaagagttccacgaacctgcctactttattttcagttctgttagggtgacagttgctatttttctttccgtaaaaatttatggcatttgagtagtaggctctgcaggctacgcccctgcctatatgatttaaggactatagtgggaatatggagatgttctggagtataaactggtaaaaattgaatccaggctgggtgtggtggttcacacctgtaatcccagtaccttgggaggccgaggcaagaggatcacttgagtccaggagtttgagaccagcctgggcaacatggtgaaaccccatctctacaacaaataccaaaaaaaaattagctgggcatggtggcatgcgtctgtagtcccacctactagggggcagcctgaacccaggaggtcaatgcttcagtgagccaagatcacgccaatatactccagcttgggtgacaaagcgagactgtcttgcacatacacacatacacacacacacacacacacacacacacacacacacacacacaaaatctaatccagaggttgcagtagaagaacttacttaggatttcaattaaggaatgccctctaaggttaagttaggtagatcccacccttttgtgactccccaagggattgttacagctattattagtggagggaaatggaaacttagtgtgattcgtagcattggagtttatttcctgtatccttcttccattcctttttgtgcttcttttgaggagggggagcttcttctgtgaagtgaagcctcaattcttaagtggtagggatgttaggactgtctgatttattctttcttcttttattcttttattattttttatttatttattttttttgagatggagtttcgctcttgttgctcaggctggagtgcagtggtgcctctaagctcactgcaacctccgcctcctgggttcaagagattctcctgcctcagcctccctagtagctgggattacaggtgtgcaccaccacgcccagctaatttttgtatttttagtagagatggggtttcactgtgttggccaggctggtcttgaactcctgacctcaaattatctgctcaccttggcttcccaaagtgctgggattacgggcatgagccaccgtgcctggcccattgtttttcgtttttatttattttattctgttgtccagtcaatgggagcataatcttaatgattactattctttgtggttggcttactttgtttgtgaagttttcattttattaaaattttttttgtggttatttaaattttcaccttacagatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtggtaaggttgaggctatgtgtgctggcagaagtgtactgctcatgaccagatatccacccattcacacaaaagtttgggtagatattatgagcagggcatcatattaggaactgcaggtgataaagagacttatcggaagtggattttgcttttagttaactcaaagtctggtatgggagacaatatatgtgtgaataatagaaaatggacagaagtgttctgagagagatgacagttaaaataggaattcagaggagaaaatggtttcttccagatagaaagttcagggtgtgctttgtagagaggcacatttgacctgagccttgacgatgtactgtagtaatagttattgtgttgctattgttgtcataatagctgacaattttactgtgtgccaggactgctctaagcccttttcatatattagcccattagttttgacaacaacccctttaggtgggttattttatcacctgtttcagatgaggtaaccgaggcacacagaggttatgtagtattcctagagcactcagctagtacatggtggagcaagtaagagttcagacactctagctacagagtctgtgatcctaatacctcattatatgcctctccattacatgatagaattttgacttgcagaaatgcaaatggactggattggcagaacattccaggcagtaggaattacatgataaaaagcctgacggtgggaaacaagaagcttctactgggagctgttagtgggtcagttaagctggagaaaagtttatcaagagccactggaaactgtttcagagaagtgagttgtagtttgataataggctcacaaccacaagtttagagaaaatgtgcaatcaggaagcaaggctacagtcagagaataagcaatggagttaagcacctgcataaatgcgaaagcggcttttagttacatttcagtgcagatgaggacctcacccgccgccactggtttggattgcctggattgatgcaggtccgggataactctagaagcactctgttttcctatcttctttctttttgcttgctttagagtcaccatgcttttaggggaaactgcaccaatgtattacctttgactgagtacctagttttgtttattgtattttcttagcactaaatcagaagcaacttgaagttatattttccaggctttacaaaaatcatgattatgcttagaaatggttctcctccctgatacctacttttgattgagagctttttgcgtgacttctgttcacgatgcttttttttccctgccatgatgcatatgtactatatgccaagctctgttacaataaactgttaagaaatcttcccccacccaagtgattaatctccaagggctgtgccttctttgtctttacccattgaggaaacagtgttgtgaatacaacaagggaaaagtaggttatatgcaaacctcagagttgtagagccagaagggctcaacgtttagttttacatacaagataatggagccccagataagagaaattatttcttcagggtttctataacactcttttggcaccttgcttttggttttttgttttgttttttttttttgagttggagtttagctcttgttgcccaggctggagtgcaatggcgtgatctcggctcatggcaacctccgcctcccgggtttaagcgattctcccaccttagcctcccgagtagttgggattacaggcgcatgccaccacgcctggctaattttcgtatttatagtagagacggggtttcgccttgttagcccggctggtctcgaactcctgacctcaggtgatccacccgccttggcctcccagagtgctgggattacaggcgtgagccaccgtgcctggctggcaccttgcttttaataacatattttcctccaagcttttccccctacctaagtttttgtttttatttatgtaccactctctcaatttgtcctatatccttgtaccttacataccaatattattattttaaaaatcaactcactttgtaacctaacgtaaatttaaagggaacttttaaataaatatgtaaatggaaaaccagtaccttttgccacaaataacacagcaataatagctaatacttatataatgcttattacatgccaggtctttattctaagctttttacatttatataataatgcacttaattctcacaacaaccctatgaggtaagcactgtaggtacttaatccattttacagttaggaaacatagaggttaaataacttgcccaaaatcacaaactagtgagcggcagagctagcatacgaatcttaggtgatatgattccagggtccatgctgttatataaaaatagaggttaccttttaaaatagaaggttcttaggaagtatgtgcttatttaaaaaaaaaaaaaacaacagtctacacctcacctaagatcctttctcatagcatcagtcacacctgaactactgtttttttttttttttgagacaatctcactctgttgcccaggctagagtgcagaaatgtagtggtgtaatctcagctcactgcaacctctgcttcccaggttcaaccaattctcatgcctcagcctcctgagtagctgggaatacaggcacacaccaccatgcccagctaagttttgtatttttagtaatgactgggtttcgccatgttgcccaggctggtcttgagctcgtggtctcaagcaatccacctgccttggcctcccaaagtgctaggatagtaggcgtgagccactgcacccagctgaactacatttttgaaaacactgattaggaaattggtttgtcagttgtgtgtactctagaaatgctagggtgaagtagtaagtagggaagggtgaccagagttcattaggagttagttgagatcttagagtagttgggtaccaggttatacctgtgaaaattctgtgtaaacagatctgcaaagcactaggtaaggtgtgaccgaattgatacgatttgcggaatggaagtgtttgccaaatccagctggttctcagaatcctctggggctcttattacataaacagatttgttgggtacatcacagagggagcccagataaagcactgagtatggtgcctgacacgcagtaagcaggggtattattaatagtaattgtcattttattgagtgcttacattgtcctgagtactttatgtagattgtcttatttatgtctgattacacttctaagaggtggagtctatacttatccctatttttcagacaagggaataaacactgagaggtatctagtatgcagaaccagaatctgagcccatcatctccttaaacactgtattattgtaccctacaatgcttactgttatcatatttattttggcaaatgaggtttctgagtttgacactggctgtttgcaggtttccctactaaaatttccagtgatttgacttcaactcttggtttctagagaagcatagcataggaagagatgttagatgtgttttcttctacccgcttcacttttcagaaagggaggttttgaaaggggtgcaaaccaaaaagtatgagacaggtctcaatcaatttagaagtttattttgctaaggttaaggatgcatgcctgggagacaggtctgtacctttctccaaagatgattttgagggcttcatattttaaggggaaagggtggatagtggggaaaggggaagagattttgaaaaggtatgggtaggtaagaggcaaatggttgcattctttgttcacatgtgagagggggtagaggaatagttacttatgcattcatctagttcagtgaatctgcatttttacataagataattagggcagaggaagcaatcagatacgcatttctcaggtgagccaagggatgactttgagttctgtcctttgtcctgtacctgtgaagataagctatcaatttatattgtcagggtgaaattcaacagaactgttttagggtgaagaacttggggcccccaaggaattttcaagtgggcaaattgtgagggaggtatgtacctttttcatctttgaatgggaggcaggtttgcatgttgaagttcctagcttgacttttctccttggcttactgattttgggggtcccaagatttattttcctttcacaggggattatagcttgcctatggaaacatttaaaagaaacatttataagagagtaagtcggccaggcgcggtggctcacgcctgtaatcccaacactttgggaagccaaggtgggctgatcacctgaggtcaggagttggagaccagcctgcccaacatggtgaaaccctgtctctactaaatacaaaaaaaattagccgggcgtggtggcaggcacctgtactcctagctactcaggaggctgaggcaggagaattgcatgaacccaggaggtggaggttgcagtgagctgagattgcaccactgcactccatcctgggcaacagagcgagactctgtctcaaaaaaaaaaaaaaaaaaaaaagtctttgaacttctagtgttggacttttacagcagaatttaagagcccaccttccagagcctgatgcagcttgtctgtctgatgcttttgttccccatccacgtcccccccagtgctgaagctgtttcgtgtgtccttacagtgtttcctctgcacttccacttgtggttgataagtggcagggggacaataaatagagttgatgaaagatgggcttgggcagcagtgggcccaagtgaggcagaaatgagaaaaggactcctggggcagaggtggagtgacaaagccttgagcacgagggtgtgaaatgtgaacttggtgctgacctctattgggcagccggggcaccacggaggtggatgtggtgtcagtgagaccagtgagtaattttagcagagatactttagggatgacttggggagggcagcaggcttttttaaaatatatatacttcccaaaataacattgcttcagagtagtttcctaactgccctgggacaggcctgagatcctgtcccagggtacttggggggcacatcctgtcttagggagaggtattcacctccccattcccatccccagtcctggctgcttttcctaaatgcatcatttatccacccacattgccccattctaaccacatatcacctctttagagataccttccccttcattgagggagcatccctctaataaccattagctccatattctgctgggtttctttagagcacttgtgaaaatttggaagtatttaatttgttaaatcttcattgtctctttcctccattagaatgtgagctccctgagaacagggaccgtgtgtatctatattattcactctgtatccctagcccctagcatagtgaccaccacagcacaagcactctgatatcggataactgagtgagtaatagtagaagctgacatgcacctagacactaggaattcaaagatggtataagacacggcccttgtcctcaaagctttcatagtctggtagagcatatagatgtgtaaatgagtaaatatggtaatattaaccaacatatgttcattgaacagttactacggggtcttctagtaggtgatatgggaagacaaaagaatgcaaatgacaatattccagtcctcaaggagcttataatttaaaaaacttaaaatagcaaaaacaaaaaaaaacaaaaaaaaactttctttgtttctgtaaacccaattttcttttcattatttctaatcgagcccctagttaactttgatggaaggggggctggggtgtgagtggatagttgctgcaaagatgattttcataaatcatcttttcctctcccccaactaattaagagattgagctcactcatacatatctccttcatggcctacttattagaggtttcccttgcttctcttttaaaatgcagacatttctgttgggtgaatgcagagagagggaattatttcagaactaaatgaatcctcaattacttatttcaattactttattttattaaaaaaccccaaggcctagaaggatatctgatgtgtttaaggttatacagattggaagcagagctgggctggaacagacagacccgtggcttcttgctcactatttgtctctcttccacttgcccctggtgcattcaagcaagatgctagtgtccacatgtctatagaagagcagattttgttgttgttgctgttttatggtaaacatcatttgacaacccatttcttggagttttgtcactctgaatacaagatctgctatattggatttcactatgctaatgattctagcattctttagaaaacatataagaaatttcacagcagaatgagcattctcagtggtcaccttgagagactgtaaatcccttccaatgattgtgatactgcaaaaagcattttggaaaagccatgcatcttgaatcctgagatgagcctttgggatccctcccaggatgacaaatcttcacgtgtattttaaacattaatttgcttttaggatctagtctaaggttatttggaactaaaacttctgagtagtccaagataatagaggtgtaaactatttgttaaatgaatagtaaagattgagcaactgtcttgcatggtccagaaagtgcctttgaaagccactccaagaaagacattccaaacatgtttcgaacggttgcagcattgttgggattaaggagaaggctcccaaggtatcctcctagagtccaaggtataaattctgttactcatgtgttcattcattcttactgcattcattcaacaaacatttactgagtgctttatacttgccaaggtctatgttaggtacttgggtctgatggagtaaaatagtctccatcctcgaagcactcaggctagcagggggaaatgaacatctaaataaataagtgcaattaagttttgtatggactgtgataaaaccatatacaatgggataaaggggtcagttctgtaggtcctgggagtggagagatctattgaaaggctttataaaagaggaaaggctttataaaagtggaggcttgaaaagatgaattgggtgctttcaagcagccggggcatttcagacagagaaagcacaagcaaaggtaatgagataggaaccatttggggagcgatcagtagttcgttgtggttgcaacgtgatatgtaaggaggggtgagaggtaaggcgggagagtcaggagggtaccagattaatgctactactaaggaggccatgaaggcgatatttatgagtgagattcaagcaagtgccttgtgtttcacgaaaaggaatttgttatgctgttgtaggtaagcaataggagccattaaagaattaatttttttttctttgagacggagtcttgctctgtcgcccaggctggagtgcagtggtgcgatcttggctcactgcaagctccgcctcctgggttcacgccagtctcctgcctcagcctcccgagtagctgggactacaggcacccgccaccatgcccggctaatttttttgtatttttagtagagacggggtttcaccgtgttagccaggatagtctcgatctcctgacctcgtgatccacccacctctgcctcccaaagtgctgggattacagacatgagccactgcacctggcctaaagaattttaagtcaggaagtaatgtgatcaaatgtgttttagagtaataatgtggactacatgcagacaatgaattggaggaatgagttgtggagctgaaagactgttaggagactagcagaatggcacaggcaatagctgaagtaggtctggcaatgaaactttagggaagagcagaatagagagctgatgggggcaggatgtggacacgagtgtaacaagaaattactgaggttttgttttgttcttaatcgatctggccgtacacttcattcaaaacagcagccaagagataccattttgcagttaggattaattgccagatttgtgatagaatataaactctgtgtgaatcaaaaaatgctgtggaacaactctctaaaatgtgttagttttaaattatgtgcacaatatgatacatgtcatttattccacaacgatttgaaatgttagcagtgttttaaaatcattaaggaaaaatcttcagggtagttgaatgtgttggaattatgagatataaggctgggtacagtggttcacgtccgtaatcctcacactttgggaggccaaggcaggagattgcttgaggccaggaatttgagacccatctctacaaaaaatgattagctgggcaaagtggtgcgcgcttgtagtcccagctactcaggaggctgaggtgggaggatcacttgagcccaggaggcagaggttacagtgagccgagattgccccattgcactccagcctgggcaacagggtgagactctgtctcaaaacaaacaaacaaataaaaggattatgagatgtagaaaattaaatttctctcttaattcaccctcaaagagatatgagagttgacaatttggtgttctttcccttttatgttcttttattttctgtgcttagattaattatattttaaaaactcaaaaatatcattctaggccatgtgcagtggctcacacctgtaatcccagcactttgcgaggccaaggcaggaagattgcctgagcccaggagtttgagaccagctgggcaacatagtgagaccctgtctctacccaaaggggaaaaaaggatttaatcttctcatacagcttagtggagatcattttgtgatatctaattgagttgcttactcctttcagggtgttcctgaaaagaaggtacttccaatcaccgtccccaagtcaccagcctttgcattgaagaacagaattcgaatgcccaccaaagaagatgaggtgattccctgggagtaggggggttctttttccttctatatagtcagtcaatctaagccttatcatttattaatcttaatggagttcaaaggcaaccactcttttttggacttgtctttaagaatgggtatgaacatttgttcattttttttgttcctccaagaacaaagtaattggtaagggtatgaattttctgctcttagtgataactagttacaatttatggaaacagtaaggagcagttaagcattggaggcttgtctgctgtagcattgaaaatcagctgctctttgtaacatggatcaaaagttgcactttattttgccttagattgtcactattcagtgatggactttgaaaattcatactaagcaattacatccaccttgtcctatctccgttaacccagaggagttgcaaaggtgactgtggtgatcgtttatggaattgtaatatataaactgtcattggtcaggccagtttcttgttacatctcccattttatctataaatatccagagttagggtaattttatagcagattgcaagcataagcctttttataggttcatttgaaactaaaatacgcagtaatcttgtgttaccagcttgaacccaaacaacttgggtttggcaatcctattctgggtttggcaaccattaagtcccagtcacatgttttaatgaagtctagaggctgggtcaaagaagagactaaggtatatgcttggttgggaccgatcttctgatgttcattttattcataatgttagatcttatttagtttttacaacattcctgtggaaaactagatcttttaagagtaattgtgttagcccttggtggtagatgacttacctaagtcatcatccttcttggatagaaaaggaagctaagacttcctttaattttgttttaattaatgccacatattaatataatgtcttctgactccacattctggggaagttggagagagtgaggagtcttatttctaaactgcaattttttccctaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtaggtgtttccatttctgcaagtagtgtaatactattctttgatccctcaaagacagttttttctgtagcacttttaactataaaatcactgacttcttttgatctttctaagaaccctataaaatataaatgggacaagtaatttaaataatccttctggcacaaggaggttaagtgacttgcctctgatcacactgctggttataggcaatattaggaggaaagcctagatttccttttgaacccattattcattctttcatgctgctttgaaaggtttccttccttatttttcagattcttccagatattctggagcagctattgctttccagctagtctttatcttaaacctcatgttttcttttctgttaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccaggtaggggatggggagagcagccaaaatgttaattgcttggttggttgattgtacaggcagacccaccatactgaaatcacctgggttaacatgctacattgtttcaggggctctcactgtaaatcaggggtcagcacattatttctgtaaagggccagataagaaatattttaggttttgtaggttacatatggtctctgtcgcatagtgtgtgtgtgtgtgtgtgtgtgtgtgtgtgtgtgtatgtgtgtgtgtacgcacacattttgttgttgttgttgttgttttttgagacagagccttgctgtgttgcccaggctggagtgcagtggcacaatctcggctcactgcaagctccgcctcctgggttcacgccagtctcctgcctcagcctcctgagtagctgggactacagacgcccaccaccaagcctggctaatttttttatatttttagtagggatggggtttcaccgtgttagccaggatggtctcaatttcctgacctcgtgatctgtccgcctcggcttcccgaagtgctgggattacaggtgtgagccaccacacccagctacatgttttcaactctttttttgtttggtttgagacagagtgtcgctctgtcacccaggctggagtgcagtagtgcgatctcggctcactgcaacctccgtctcccaggttcaagtgattctcccacctcagcctcccgagtagctgggattacaggcgcgtgccaccacgcccagctaatttttgtgtttttagtagagacaaggttttgccatgttggccaggctggtctcaaactcctgatctcaagtgatctgcccaccgtggcctcccaaagtgctgggattacaagcatgagctgctgtgcccaatcaactctttaaaaatgtaaaaaccattcttagctcaagcgctgtcctaaaacaggttgcaagctggatttggcctgtaggccagagtttgctgacccctgctctaagtgatcacctgggaatgtcccctgctccaagtgatcacccggggaatgtgggaaccgacaggcttttctggagttgggagtttctttaagatcttatctattccatctattagactcattcattgtgtttattcctttctgttgatgcattggtaagaaacagtatgggagaatagattgaaatatacaatgctgttttctcagcatgatgtgctatttgctctttataaatgacaggtgatttaaaacaattaattggttatttgctgatttaattgggatctaattctacgtggctggaaaaaatttcccctgaatttctaagttttttggatttttatgtcatcattaatcttggattctttccaaaaggagctctaggctattgtttgtttgtaggaattacccctcctgaagcccgagagttgtaatggcttacatgactgaacgttggtcccctgttagtgtggttctctaagaaaccttaggactgttgccttggaaatagtgaattttcccctctcaatgaccaagacacagaatgtctgtgtagggcattttctgcaaagaacaacaacaaaaacaattgttttaaaaagcttttcagaaatataaaagtagggtgaatagtataatgaattttcatgaacccatcacctggttctatagtgatcaaaacatgaaaagtcttgtttcatcccaacttctacccacttatcttacactggatacttctacctgtgtaagattactttgaaacaaattctatgtaacatcccttttcatccaaaaatacttcagtgtatatatttaaaatataaagacttataaccacaataatattctcacacttaaaaagattaaaaataatcaaatatctgcacatttctcataattttttaaacagttgaattgttaaaatcaatatccatatatagtctacatagtgcctttgtttgctaaatctccgaatcttctttcaatctataggctcctctctttgcattttatttgttgaataaactggattgtttgtactgtagattttccacaatctggattttgctgattgcgttcccacacagttgtctaacatgttcctctgttgcttgtatttcctataaatgagtagtaagatctggaggcttgattcaattctggttagatttttttttttttttggaggtgggaagaatactttataggtgatactgtatagttcctaatgaatcatgtgtgaaggcagaaaatgtctagttgtttatttttatgatataaagataggtcttaaaagtacctttaaaattttttgttttttttaattgacaaataatagttgtacatattcttggggtacatagtgatgtttcaatatgtataatgtgtaatgatctgatcagggtaattagcatatccataatctcaaacatttatcatttctttgtgtttggaatctttttttttttaatttaaaagtaaactttagcacaccaacatggcacatgtatacatatgtaacaaacctgcacattgtgcacatgtaccctaaaacttaaagtataataataagaaaaataaatgtgaacataaactaaaaagaaaaaaaaaagtaaactttaatgtcgaaaatgcaaacttgggaatcttaaaagtatcttaaaaatgctttctagttctcagtgagttcaaatgttgtcagactgatctgttcattgtaaagtttgtgtgaaagatttttactagggtttatattaaatctgctatttttattgatgaagcagttcagacattagaacttaagttattgaggtagtggtcatagaaaggtgagacattgctcatctgactgactttctctctaatagctggaagaagaactgagacagcagaaagaagcagcttgtttcaaggctcgtccaaacaccgtcatctctcaggagccctttgttcccaagaaagagaagaaatcagttgctggtagtattatatgtactctgatgggactcgggcagaattgtcagacttcccagtgggatgctggaattcagtgtgtcagtacaatgctgtgtcaactagaagcatttgactttagcagatggtagcttttcttcccctagacccagttttttgcctttattgaacccagcagctatgttgagttgcaggatgtgttagggccagattcatttaacatgaaccttggcagaagcagctggcatttcaacaacaatgataggttttccccatccacagagaaacaagtaaatgagggagggagagccagtatggctttctggaattcaccctgaagcaaactttagatataaaacatttgattccttaaacactgggcagtgtgctagaatactgggattccaccgggtgtggtggctcatgcctgtagtcccagcactttgggaggcccggacaggaggatcacttgagcccagggatttgagaccagcatgggcaacatagcaagaccccatctctttttcaaaaaaatctttccaaaaagggaaaaaaagaatattgggatctttcttctatgtctgcctcaaaatcaatcactatatagttttgtgcaagctactttatgtctttgcctttttcccaattacaccagacgatttccaggggccctttgaactcttaaaattctaaaactttttgtatttagttggctctacctttctcccaatggggcttgtttagagcacagtcttcctgttagtgtgcatgtctgtgccacttgctcattccagggggcgtaggtttatgcaagtcctgcttgtgcaccaatattttttctgtttctgtacttagagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtaactgggagcatgagcactgacgaacacaaacatgcctctgttttattttacctgtaccttaccttgtaccagacaggatctaaggtagcccgcaaggctgtaccaaagacaatgagtgaaagggggaattgcacaaactgagggtggtgatgaagttgagttgtgaatgaagctaacgatgtgtacattgtgatctaagtaggagctgtaattttggccctttttaggaaccaacctgtcagttacaaaactcgcagtgttcatgagacataagacagttgttcaaaaaatacatttatccctttgatagtgaatttttagacagaatttcttccggaagttttcataaggaggacaacatgtggtataaccatgatgcctttcctaggactgttttttatttatttgtttattttatttatgtaacttattatttcctctggggttaagaagcaccactgagttttgtaattagacaagaatacatagcgaaggacatgggaattaaatggcaactgtatttttgttttaatactgagcccaaactccttggagttacagtgttcgtcgctccaggtaatcctctactaacataattatttagatgttggttatccaaaaagaaacctgaactccacattaaggaccaatctgctaggagggcagcaagttgtgttaactgtgttaatgaagaagcagacagttttagatggaacttcgtatgataaataaaaaaagaaagggtcatggggagatgttggtaaaaggttacttagttacagttagatgggaggagtaaatttcaagagatctatcatataacaaggtgactgtagttaatgatatattgtattcttgaaaactgtaaagaaagtggatgttatgtgctcacactacaataagtggatgttatgtgctcacactacaatgttaattagcatcttgctaattaacaaatgcattatctcacatagtaaccattccataatgtatgtctactttaaaacatcagcggtacacaataaaaatatacagtgttatctgtcaattaaaaagaaagaaggccaggaatggtggctcacacctgtaatcccagcactatgggaggcccaggtgggtggatcacttgaggtcaggagttggagaccagcctggccaaaatggcgaaactctgtctctactaaaaatacaaaaattagccgggcatggtggcacgcacctgtaatcccagctactcgggaggctgaggcaggagaattgcttgaacctgggaggcccaggttgcagtgagccgattgtgccactgcagtccagcctgggggtgacagagcgagactgtctcaaaaaaaaaaaaaaaaaaaaaaaagaagtgtaagttgttgaggttttgtctaaaagtgctatactacagctggatgtggcagctcacacctgtaatcctcacactttgggaggccaaggtgggaggattgcgtgagcccaggagttcaagaaaagcgtgggcaacatagcaaagtcccatctctattttaaataaataaataaaatgctagactagcagttgaaacagctattggcagctattggcataggtgattatgcccataggaaggttccacggacacactatttaggagaccagcctcttggtaaaatctagactaccatttgctgagtgaatgagaaaatagtataatccccactctatatacactcatacaatcagccttttttcccggcctcaactttgatttttctttagcatttggtacctgcctcttgtgtttgtccccattatagaactgcttcttgcagcaattctcaacataactgatggcaacattgtaaagcacaattcagtcaatgctggttaactctctactaatctggcttgatttaggattgattttagactaccctaaaggatggatgggaccatgccttctttagccacccttcctggtatggttgttgtgttttgtttttgctttttccccaggattcaggcttttggtgaatatttatagtcagtaaacttaagactgtactctgggaaattcttagcttgtaacttctctgctatacttgagtacagccctattataccctagtaaatcacacaggacataggtttggcattctttagtgaaagctgagggacttgaggagactgtggcctaaaggaaagctgggggacccaatagagacctgaatagaaacccttttgggctccaaagcacatacacttttccatcataccgtgttgccccccaggccccactccccacacctgaaactagtgactgggacctgtaaaactctacaaacattttctcaaaaagaaaaaaataaaagcaattataagcgtagttctctgacatccctctcactggtaacttttccttactttgcaggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctccctgattgtgttatttgatgtttttaaatctgttaagcccctttggaggtcacatcttattgggaaatgggtagtttgagaggtgggtccaggaactttttttttttgagatggagtctcgctctgtcgcccaggctggagtgcagtggtgcgatctcttctcactgtaagctctgcctcctgggttcacgccattctcctgcctcagcctcccgagtagctgggattacaggcgcccgccatcattcccggctaattattttttttgtattttaagtagagacagggtttcaccgtgttagccaggatggtctcgatctcctgaccttgtgatccacccgcctcggcctcccaaagtgctgggattacaggcgtgagccaccatgcccggcccaggacagtactttgtaatttttttctgtcttatgtcagaatatctccatattctgttaactctctctcagtaaccacttaatcatgtatgttatgccttcacacagactgtaccttcttccctaaagactcagctcaagttaaattttttttttgagatggagtctcgctctgtcacctaggctggagagcagtggcacaatctctgctcactgcagcctcccgcctcctgggttcaaacgattctgcctcagcctcccaagtagctgggattacaggtgtgtgccaccatgcctggctaatttttctatttttagtagagatggggtttcaccatgttagccaggctgatctccaactcctgacctcaagtgatccacccaccttggcctcccaaagtgctgggattacaggtgttagccaccgcgcccggcctaagttaaatcttttttagaaatctttccttgacctctgacctcctcagtaaagatggtcacttccttctttgtgactcccaaatgtttctctttttttgagacggagtttcactctgtcgcccaggctggagtgcagtggcgtgatcttggctcactgcaagctccgccactcaggttcacgccattctcctgcctcagcctcccgagtagctgggactacaggtgcccgtgaccacacccagctaattttttgtgtttttagtagagatggggtttcactgtgttagccaggatggtctcgatctcctgacttcgtgatccgtccgcctcggcctcctaaagtgctgggattacaggcatgagccaccgcgcctggctgtgactcgtaaatgtttcttgtatacatctcgagtagagcagttatactatatctgagttacttgaacttgttcacaaattaatagagatacagatatgtaagttccttgaagacaagaattgccatagccatctcttgtttattgtggctggcacagaattggcttaggtccatgttaaacaatatattttcttttagaattcacatcatttttgagtatcaactctatcattcattgcgtgtgctaggagatacaaaagcatctggattctgcccaggctagtcctaggtaccatatatgacctgaaacttattttatattcatttttttattcagtgagcatatatgaatctcttatgtacaagtcattgtagtcccagcattaattgacaaagcaagatggtgtttctcacagtatgatttgcagatcctggtcctcctgaacccccataaactgatgcgtgaagagtggagaatgaaggggtgtcctggaaccaattctccacggatactgagggatgactgtgtataccttagcactgttctagtctctgggaatacgtcaatgaacaaaaaaaaagaccttgccttcatggagctaacattttagtaggagagagagacagtaagcaaataatttaagctcttgtgtaaggtgacagacgtgctgactgctatgtgaatagatgggttgggagtcgggggcatgtgaaattgtaattgggaaggcgaggaggttctcggctgttgtgcaggtgagagctgacagtgacttgggttagggtggtag

SEQ ID NO: 12683 - DNA, 152524 bp, Human
tcagaaatactctgtttgcatatccacttccattcctcagttctaggactcctccagactgaattattgccttccccaagctttcgttcaactcataccttctctttacagcttgctttgcccacagtaatttattttcctttaaattctcaagcatttgaccctcactacctcatactgttaattaactttgtgttcgtatctcacccccctagaagaatgcaaaatctctgaggattagcgctgtactttagctttttatttttttgcttggtaggggacaacgaacataatgctgaacacatatttgttacctaaaaaaggcacatgttccatgatgtcaatgtaatcttgtttaggtgagtatattcaacttttttcttttatcctttttggctgctgtttgtgagtttgatcattcttgttataaaattaccacatgtaaccttttgagaagcattagaagaattaaaagatggcaaaagcaggcctataggaaatagtggtaatggatacgtccaaggttactactatgggccactgtgctctgcattgcaagatttgtttgaacatactcaagaaattgaagttcagacaggttaatttatccaaggtcccacaaaaagtaaatggctgtgctgagtttcaaggacccatgtctgcctggatccaaagggcaagtcagtttcagtgctggatgactgagaattacaaaatttcttgaaaaagcactaggcacaatagttggcgttcaacaaacgctcacacacacatctgccctggaattgggtctacttaaacagaagggggaaaaaaagcttgctgaaataattatacttcttcgtaactaccaagctcatgtttgactgactatagtaatcctatgccctccttcacattgacgctagaaaaaatgcctggcagtatttcaaatcatgatgcctatttttctctcgatcaagtaacaactcaaattatactttaaaaagaaaaaaagcaaattataaagttgcattcagctgacaagagactaaaggaatctgtgaaacagaatttatttgatgcctaggtttctccctcacccgacgaagaccaaatgctgctgatccgtaagtaacttcgcaaggtaaactgaggggcctggcagcatctgggcctcccttaaaggtcgaaatcaagtgcgctcgccctccttctgtccgccttttccctttaaggtcctcgaggctgcttcgctgcagaaagtaactccgcgtcgccgccgcggaaagtggggcaactttgcctatcagcagaaaccttttgatccatctgaggcgacaaaccagaccaaacgcccgcccaagctgttccgagcctccggggggagagcgagcccaagctcctctgcaccgcttcctcatccgctcgctgcacctggacgcggtcggcgcgcgacccccggccgtgacgtcaccgcacctggcagcagccgtggggaccgggagagagcccgaacgcgacggggcggggtggggcggggagaacgagggcgttctcgcgagatttgcctcctcccggtcccagctccccgcaccttctcggcctctgtctgggtccccaccttagtctacggtgtcgccttttctaactgcgagtgctaaggaagaggcgaggggcgggctccgaggctaggcgggcgctcggggttggagccgagggtctgggcaaaccggtgggtccctccccactgcgggagcggccagggtgggaaaaccgcggtcgggcgggcggggtagggccctcccgccgccgtggctcctggggaggccaggggtgaggagctgtcgccgcctttgcctctgcctcgagggccgcgctgaagagactggtaggagagcgccgcgggcggatggaggcgactcttcgccccgcctgagctcaggaggggctagcgcggagcgcgggtcccgcctccagccgcgggagcggccgcgcgagccaccacaggaggaggaggaggaggagcggacgtcggcttctccccgcgggagcccccagcatgggtaagagactcgggcgcttcccgccgcccgtccggaccttccagacccggggaggctgtgccctttctcggccttctggggaggcgactgcggtcagcccctgagcggcagcaccccaccctctccattctccccaccgccccttcttgccctgccttccaccttgctcttctcacggagaaactggtgggagagctcgcgggtgctttccctcgctctcccttctccgcctcttttcctgttcaccagaaaggtgcgggagggggggcgggggcgcctggccacctctgctaaccccttgcccagctaaaatcagacctgaccttccttcccttcctcatccccttgcttccctccccctcctcgtgggatgggggagggcgatcgaaaaacttgataaagtagcactttcaacttctttattttctgcgaggctttgaatacgtttaaggagagagataaatttgttcaaaaactttttttttttcctgctgaaactcgcaaggggtgcctcaaggacaggaaagcttgagtatttgttttactcgggttctacctaggcaagtgtgttggcacctaagcattcagtgtgctcccgaggactgggtttggacttcagtgttggatcctttgaggagcagtttcctgtttggagttagacttccttgccggaggagagaaaaatacaaggccttatatgttatttactatgtgctttatagttttgtttgaagttagagaaggcagaatgtgtggcagtccgggttgaaaaggagttttgttaagtggtgtaacaatttcttttgataacaaagttcggtgtgggctaggcattaaactaactccctcaatcctttaaaaattaaaagcaacttaagaatagcttacaaaaaacaaaacaccctgtgtctctataaggcagaacgtgttctgtaagagtaaacccaagtttgatttttgtagagcaaatcaggaggaccctatcactttttgcagttgagagttggtactgcttcatatcaacaaacgatcaccgaaatgaataattcatgtaattaacaaatgatttagaagcaggacgaatacagactactgctgatgtggcaccctctgtccacactttgctttgtgggggatgttttgagcatattgtttatagacactcgcctagctatcctctgttttcttagacttttctaattttatgttcccttctccacctccctcctttcaggtaactttcatactcaaaagtgctcttgagctcaaaaacagtgaaataaaacatttgctatttggaattttcaaatgaattattttataattgattagttgagcttgcagggcaattgtgggcatattcttttaagtatgaaattataaaatcactttaactgctttggattaagataatactaaagttaaatacacagttcttttctgtcttaaatgggatgcagaataaaattaaactactttggatgacctggggatgcagtcttgttttgcatatagggcttttgagctaaattctaaataatatttgttcgcattttgaaattatttaaatactttttttttttgctttgcttttggatgtgcttgtaactgattagtgtcccccatcatctttccttttctaatttttttttagaagtgtggaaatcatattcaggtttgtgattctgcataggggaaaaatcagtaggccgttacttagtgtgtgaggtcgtctctggagaaaagtaaatgtgtaccaatacttggacattggaatacctattttgattgtccagaggctttttctttgtgatttatttgttgtgttctgtttaggtgagttttcatatagacttggatatcaatgttggtatactctcgactacttagaatgtgttttgaaggtatgttactgagggcatttgtggttaagtttttgtaaagtgtttgtgaaacatttccatatcaatatatatattctttaagtttattggtcatgtaataataaaattcccaagttcacttaaagggagtttgctctttaatataaatctcatttatttggttttaccagccatccttttttcttatgattttagatgcagcctaaaatatttacatgatattttatctaatttgtcacaaaatgaaaaaatctgaaattttttttgtgtgtaagataatttggatgcctattaaatggtggttcttaagtttaggtggtacagctagagagttaaaagcatgggctctggacagagactacttgaggtcaaattctcttctacctactggctgtgtgactgagcacattacttctctgtgcttcagtttctcaatctataaatggaataaaatatcaacctcataggttgttaggaggattgaatgagttactacttgtaaagtgcttagaacactgccagtgctggcggtggtgattttcattttcaaatgatttccctaattcttgtaccaacttgggaaaaaaaaaatctcaatttttgacctttgttagaagtaggatattttctttaaataaaggaccagagggatgagatgattttgcactaaggcagaaattgaattttatgtgatataaccttacagaaaccacatagatacttttttcaatgttggatgtactgtgcgaaagtccattattggtaagagctttagttgcttaggaaaaactcttaagtgggatgactactagtagacttatttgaagtttatgtttttagtgtctacatttgttaaatgtgataaaatgcctattgagaagtttgaggtattctgtgtgaaagaatttgggaagagctctagggagacagataggcagtgcttatttttcttattccaaaaatacagatcggcattttggagcagaattaggcagaaagcaaatggcacaaagtgtcagagcatttctagagcacaaaaaaggaatatttgtgaatttttatttttggaagagtaagcagacttctaagggcagaatttctctttaataattttagataaggcggtgaactttttagtttattttataggctctcgtatataaaacatatcagtcatgtggtggtgtttttttgtttgtttgtttgtttttttgatggagttttgctctgttgcccaagctggagtgctgtggtgcgatctcggctcaccgcaacctccgcctcctgggttcaagggattctcttgtctcatcctcctcagtagctgggattacaggtgtgtgccaccatgcccagctaatttttgcatttttagtagagacagggtttcaccatgttggtcaggctggtctcgaactcctgacctcatgtgatctgcccgctttggcctcccaaagtgctgggattacaggcgtgagccactgcacctggcctcgtggtggttttaatagacaaatttgtggttggtttagatgatatatgcacttctataatagagtgatttctttatgttactttgttgtactgtttggagaaaatattttaaaaatttttatttatatgttatttatttacttatttttagagacaaggtcttgctctgttacccaggttggagttcagtggcatgatcatagctcactgcagcctcaaactcttgcctctgcttcccaagtagccagggctacaggtgcacactaccacctctggcctagtttaaaatttttttgtagatacaggctctccctgtcttgcccaggctagtctcaaactcttggcctcaagcagttcacctgctttggcctcccaaagtgctgggattacagctgcaccactgtacctggcctggataaaatcttgattcatacagataagtagttgcaaatggaaattgcatgctaatggttcacctttctgtatcaggatttacttcaattaaactacagagcatgaaaaaacaatattaggaaatttttgtttcaaagttgaatcactggcaaaagtaataattcttttccttatttaagtactcatcagatattttttgaggtttcaaaatttgagtagtttaaattttgtaaaatcacattaaggctgaaaattcacatttataatattttatagtttcctgtagaaatgagccggaagtttgctttgttttttttgtcttttttttttttttttgagatggagtcttgctctgtcgcccaggctggagtgcagtggcgcgatctcggctcactgcaacctccgcctcccgggttcaagcaagtctcctgcctcagcttcccgagtagctgggactacaggcacgtgccaccatgcctggctaattttttgtatttttagtggagatggggtttcaccgtgttagccaggatggtctcgatctcctgaccttgtaatctgcccccctcagccttccaaagtactgggattataggcgtgagccaccttgcccagcgtgtatctttctaattgagggatttgcaaactaaaatgacatcatattaactaaaatctaatttttaagacatttaaaataaatagaaaactcaaagtgcttcatttttatttattcataattcagatctgtcagagaatcctgtcagagaatatcttcccctgttattaaatatattttgaacgataaaaatgcttactttaatatatataaaaaattgtaattgtgtcaagggcttgcagataggtagagaaagaagtataatgattattcatttgggtgagaattgggtggagctgcagacctgtttcttaggtaaactgatgaagcaagttgtgaaagatctgaaagttttcagattttatgttcagaaaagaaagagcaaataaaaactagtaagatgtgattgaaatttaggtaaattgggtaattattatgatggagctgttactgcttagttgtagcatttgatatctgactgctattcagatttaacacaagcaggatttggggaccaaattatctcagcagtcaggcagtcagtctttctagatgggggaggcgacagaacagtagtttaagaaatctggatggaggtctatatgtgcctacagtcagcttgtcagcatcagggatatgtttggcaaagtgcagcgtgtacatgtatgtggaacaggcctttgggagtggtatggtggctggtagcaggcactaggtagagattcagactggcatcttgggggaaaagggaggaaatggggtctggcagtaggccttgaaaacctagccacagggaaacaaaatgagacagggtccagatttcttattggagaaatacaaggtgggtatttgcaggaacaaaagtgagcttagttattggaattacttaggatgaaccaagaggtaataacaagacactgagcccctaagcttatgtattttctgtcctgggactacattagtagtctacattagtagctgaatctgtaagtgtggtatgagtagtccagaattactggggtgaatgggatcttctctctaagtgctgcaggatattccctgggtatagattgccaccccttctgtttatttggtcccagggatttgatgtgcctgttttttttttttttttttgctcctgtctctttttcacctaggttccttttcctttcatacccaatgtgaagcagattacaaaacctcagcatatccttctgtttcagaaacaagtacacaatccttcagggtgttaagcagttataactgcaaatataataaatgaccaagtaaggcagaagaaacttgaaagtattagtaattatcagtctcttggtttcactgaagtggtggttggctagttattagaaagaccttttttgttgttgctttttaaatttttttttggtaatgtgtacctgtctttggcaatactccctcatactcctcccagcttttgtttattttggcttatgttaggtagatctttagacagtagctcacagtagagacatttattatgtctcttaaacagataaaattttattgggacttcactaacctgagaccatgctgtactcatttttgaatcataaccttggttttaaccacaaatgaagtaggcattttccttctgggctcctaaatgttttctttggactaaacttgatattacctcttttttttttttttgttatgttttggtttttgtttctgaaggtctcagcttcctagatgttctacactcttcctgaccattttcactgaaccctatttgatttactgaaagcatatttactaattgtttgcacttaaaggtgcttttatcctagaataaacaatgcttttaaaacaattcactattctaaattgatactggcttaagatgttgttccagtgtcaggtattgttatcgattttttctttcctagaacctgtcctttccagtggctccagtagacttgtattttataatctttcaaatattatgtagcttgttaaacttcccatcatgatcttgttcagtttctcaactcatttgcaaaagagatgactagcatgggagcctggattccagtatctgttttagtgccttattagtgcctcttagcttaggttctttttgatgattcagcgtccagataattccaagggagtgactgtaatcattaggggtttctagtagaatgcaatcatgagccccttaggaatgttttggtcaataataaaccacacatagggtggtggtcccctaagattataatgaagctagaaaattcctcttccctagtgagttgtagccatcccacactatagtagtgcaacgcgttactcactgtgtttgtgatgatgctggtgtcaacaaacccgcactaccagttgtataaaagtatagcatgtacatacatttatatgtagtacatatattgataataaatggctgtgttactggcttatgtatttactatgttttttaattgttattttacagagtacatcttctacttattaaaagaagttaactgtaaaacatcctcaggcaggtccttcagggggtattccagaaaaaggcattgttatcgtaggtgatgacagccctatgcacgtttttcaccagtgggatgaaatatggagatggaagacagtgatattgatgatcctgatctttgcaggcctgggctaatgtgtgtttgtgtcttataagaaaaaggattaaaaaagaaagaatttttaaatggaaaaaagcttatagaatatgaatataaggaaagaaaatatttttgtacaactatacaatgtgttggtgttgtaaactaaatgttattacaaaaaagttaaaaaatttataaagtaaaaagttatagtaagctaaggttaattttgaaagaaaattagaaagaaagaaataaaaaaatgtagttagctttagtgtatggtgtttataaaatctatagtagtgtatactaatgtcctaggccttcacatttgctcaccactcactgactcacccagtgccatttccagtcctgtaatctctattcatggtaggtacaccctatgtaggtgtaccatttttattacttatactgtatttttactataccttttttatgtttaaatatacagatacttaaccattgtgttacagttgcctacagtattgagtacaatagcatgctgtacagttttgtagcctaggagcaataggctataccctatagcttaggcatgtagtgggctgtaccatctaggtttaagtacactctatgatgttcacacatggaccaaattgcctaatgacacatttcctaagatgcatccccattgttaagtgatgcataactgcacttttaagtgtggtgatagttacagttaacaccaatattaagaaaaagggcctgtcacaaggtcacatcatcaagcaaagaagctgctggtgagagtttaatcaatcagtattttccttaatgtgaggaatgtgattaatgtcatgttaaatgcttgggggtttaggataaataaaagttttggtgccttgagtagtttacaagtgttaaggattgggcatattattagaatcacatttttgttttaaacttctcacaacccctgggttctgacataaatgcttctgcctctccctccctccagtttttgatgaatgtcatgaatgtgttgggatggcttatgtgataggaataagacaacataataacaatgaaagttagtatgtgaatccattagaaaaataaacgagagagagagtatagggtcaatgtcagaaatgttaaaatgtagtaggagaagcatatggaatattagaatatagattcctgcactgaaggaaatgggatttattcatctctcattagtttgaccagtgatgatatactgagtactggcagtagttaaggtattttttcctccacttctggcaaagagtctttagaatgaagtaagccttctcttgagctgatcctttcagatgtgtacttttacctgaaatattaaaactgtcttatccttcttactgtcctatcagtgttccaataatgaagagtctggaaatttacctaacatctagactgactttaaaaatgtcattcctggagcatttatcacgattattgtaataataaagggccacagtgttttggattgtaaatgtagaagctcatatactgtatttgtaaaattgagactacatagtcttggttagagtgtttttgggggacatttaaagttggtcttttaaatgtatatactattctctagggattttctcattctttgtgttagaaacaacttttggtttatttagaagtacgttctcctgagatccaagttttgcatttaactttaattaaaaattcctgttgtgctgtagcaggttgcagtctgatgagtattttgcctgactgttttggtgtatgtgtgggcatttgtgcacagccatttaagaggaagaattcatttttacttacctactaatttggccattcttaacaaacatattttaggaagcagatcaaaacaatttttttaatgatgaaaataaatttgttaaattttcagaatgcgtgtcaaatggaaataaaaggctgtgtttcaaatctcaagttagcccttttttctcacaaaattattctaaattcctatatggattatatattacaaaatgcagttgaacttatgcttacaacttcatagtttaaaacttaaataaaaacttcttggccaggcgcggtggctcacgcctgtaatcccagcactttgggaggccgaggcggacagatcacaaggtcaggagatcgagaccatcctggctaacacggagaaaccccgtctctactaaaaatacaaaaaattagccgggcatggtggcgggcgcctgtagtcccagctgctcgggaggctgaggcaggagaatggcatgaacccgggaggtggagcttgcagtgagctgagatcgcgccactgcactccagcctgggtgacagagcgagactctgtctcaaaacaaacaaacaaacaaacaaacaaaacaaaacttctttgttattctcttagtgtgtaaatgaccttacttgatctgagctcattgatgctggagaccatatcacttattttattgtatttacaaaatttaacacttgtattgactagcagaaaattaggagcctgctatgtatccactaagtctgattcagtaatactttaatttggagtaattgggtagagagggccaacctaacaatacaaaatttaaatatattgaaatatatccacctaaaacagactaataggatgttgcctaatgaaattactgtttcaagataatggatgagatccttttttttttttttttttttaagaaataaactctttaattctttctgtgtggttcattgaagctcttaagtccctttaatagagaatcaataatcagtgatgttaagcatcttgtcaggtgaatctgctgattacctactccgtgtgtataaataaagggaaagtttggcagagagagacatttctgtatgagtctccaatttaacatgttaaacacatttaggcataaaggcttaatttttagcttaaagagtttgttcaaaataacttaatgtttgaactgtaaaattataaaatctttaagataggtgttgtgaagcaagtatacatatactttgagacatactgagttgttacgtatgtgtaattttaaattttctagtagctacatttaaaaaggaacatgtgaaattaattttaataatattttgaatgtatgttggtttaaagaaagtacattatttcataatgtattcagtataaaaagttattaatgagatagcttacattttttcttatatatgaaagaaatcttgacatctgatgtatattttacatttatataacatttcagtttggactagccacatttcaagtgctcaatattttttgattataagaatttactgaggcaggaggattgcttgagactagtagtttgagaccggcatgggcaacaaagcaagactccatctctccaaaaaaaaaaaaaaaagagatagccaggtgtggtggcatacccctgtagtcccagctacttgggaggctgaggtgagagcattacttgagcctggaaggtcgaggctacagcgagccatgattgtgccattgcactccagcctgtgcaactgagtgagtctttcttaaaaaaaaaattaataatttaggtttttgttttttgtacgtgtttattttgggtggatgcttagaaccatggagaaactcaagtgattacttctgaatttttaatgattcttactgctgctgttcttacaagttcttgtagttgtctatataacttaattatgttttaaaaatctttaggttggtcctcaggtagtgagttatctcgattgcttagtcagttacagattgaacttttttctactcttccctgcttttcattactgcactcaactagtttttttttttttttttttttttgagaagtctcgctcttgtcccccaggctggagtgcaatggcatgatctcggctcactgcaacctccacctcctgggttcaagcgattctcttgcctcagcctcctgagtagctgggattacaggcacctgctaccacgcctgactaatttttgtattattatttttttagtagagatggggtttcaccatgttggccaggctggtttcgaactcctgacctcaggtgatctgcccgcctcggcctcccaaagtgctgggattacaggcatgagccaccgtgcccggctgcactcgactagttttttaaaaaataaaggtctgtttggaaactgagggaagttcttacatagcaacttcccattttttggtaattttaaaattcattttcagttgatacttagttactagcatttagggaattcttactatgctaggctgaatgtacggagcattcggttccccacaagaatatgaggtaaaacattagtcttcccattcttcaggttcaggaaatgaagttagagggattgttacttgtccaagtcagaggtaagatgtggaggagacagaatcaaactttcattgttctcattttaaaactcgtcctcttaattatatcttaaaacattttgagaaggaagattgttgagttaaacagagcaagtaatatgaccttcagactctcctagtgtggtttaaaaaataaagaaatttaaatatttatcttctaaaaactgtggattggtattcgtttgagtaactattttctctaaagagactttttttttttttttttttttttaaaggaacagggtcttgctctgtcgcctaggctggagtatagtggtactatcatagttcacagcaaccttgacctcctggggtcaagtaatccttccaccttagtctcctgagtagctgggactaaggcatgtgccatcgcacctggctaatttaaaaaaataaacaaaaactgtagacatagggtcttgccatattgcccaggctggtcttaaactcttgggcttcaagcagtcctcttacctgggcctcccaaagtgctgggtttacaggcatgagccactatgcctggcctcttaagagacttttaacaaattttaactgttacacattggtcttttacttacatacccaaaagttttcctagagttgttttttggtgagttctataaaactttatgatggctattcatatggtattttttttgatctgcttgaaacatgcttaaaaataatttctagtgttttcttgaagttaatagtgggaagatgaagaatgataatatttaattgaattttccaacttgtttgctctttagatttttgtatgttttttgtttttaagatttattattttaggacaagtgattaatcacatgtacgtggtaatttctttgtttttagaactgtctcaggtaatcagtctttgagataaaaatcttttttgttttttaaactttgattaagtttttttggtggatatctgtcacttattctaatttagtaacattaggaagaatataatactgtgtaaaaatttccttatatcaaatttccttctctttttctctttggatatgtgctaagagtgtattgtactatgcaaacctttgtatgctatttgaagtacaaagaggaagggtgggttttgtgtgcagtttgttcactatcttaagaatgactagatttacttatctctgttgaaaaacatgtaagaaatgctgcttatcattccatatttaacaagcttgagaaaataaatgacggaatttctaatatataattaaaaggactttaggatgatattgtgctttttattagtagtattttgactaatggatctggtacctaactttagaggacttaaataatgaaatgttattagttaatgacattaagcaatgctaatcagttttgcgtttctctatttatggtaaagaataaatatttcgttctgggaataatttatggtaaagcctttttgtttgtggtaagaaatacttagccctgggaataaaaagtaaatacatatatttctttcttcctgatatgtgtgtgtgtatgtgtgtgtgtgtgtgtgtgtgtgtaatatatataaaatcaggaaataagtggaaccattaaagtattttcatcatattcctactactttgagagtaaagcttgtaattttttatcttatactgaaatatatttttgttaatttttgtgtaatttttaatattttgtcatctgctataataaaggttaacactcaatagtatactgtgatcagtgatataatatagagaaggttaatttgacagactcagttagatgccattgtgatatttatctgtattgtgttgaccagaattaaaagtaaacattctgtagtcaatgcccatacaacttatgcctatttggaatttgtgtaaattgtttatttttttgaagtgattttttattgtcaaaataatgcatatttattaaagcagactagtagaaaatcttttataatattgccaccaatatttttgcatgtaataatttaaaaaaattatggattttaagatttttaagcttgatcttcagatatcctttttgtttaaatactgattttttttaaaaaagttattaacaactagtaaacccattaaaagaatacctcaccagcacccccaaacagaaccaagttaagcaaaacttttttctttttaggtaaggattaagttcttagagtttgctgtacttcattttaagtaatgtactttactttcttttacctgttttcagtcgagatttcctttttttggttcttataaatgcttttaattcattgtgttgtttgttgcaagtatttactgtctgtttccagtttagttactttgaaactttgaccgttttactttaagtttagaaatttctcctctctacacagttttgttactaatttctatcataatcccttcaagctgctatgacaaaataccttagactaggtaatttatgaacaacagaaatttattgctcacaggctggaaagtccagcatctaggcactggcaaatttggtgtctagtgaggaaagttcaaagatggtgcctttttggtacatggaaggctgggtttggtggctcacacctgtaatcttttttttttttttttttttttttgagacagggtcttgctctgtttcccaggctggagtgcaaatgtgtgattgtagctcactgcaacctcaaactcctgggttcaagtgatcctcccccgttaggctcccaagtagctaggactataggtgctgccccacacacctgttgttattttttgtagagatagcatcttgctatgttgcccaggctggccttgaactcctggcctcaggttatcctcccgcctgggattacaggtgtgagctactgtgcctggcctctgtgtgtacattcttgtttatgctttttccttattgttttaataaatgtaaggtctgtagagatactctgtcttttattcctgatataagtaatctgggccttctgtttttccccttggtcattctttctagagatttattgattttattgatgttttcaaataacagtttttggttgcattattttttttccatttttctgttttctttgagtgttttatatgattccattttatgtcctcttttaacattcaattatacttaatttttatttttagtgcttgccctagagtttgcagtatacatttataactaatgttaaattcagctttaaataacactgcaacacttcatgtgtagtgctggtaccatagagtattccttattcctcttgtcccttaagacattgattaatttcatctattcatatgctataatcatgcaatacattgttactattatgacttttaagcagttatcttttagatcaattaagaataaaaaatgtattttgttttatcttcatttattccttctatgcttcttcttcatattgatttgagtttctgacctgtataattttcattttctctgaagaacttcctttaacatgtcttttgtgttgggtctgttggcaatgaattcttgtttttgtttgaaaaagtctttatttctctttcccttttaaggataattttactagatacagatttctaggttggtgtttttttttttttccaatgctttaaatattttattccatcctttcttgccttcatgttttctgatgagaagcctgctgtaattcttatccttgttcctcaataggtagggtgatattttgtgatggtttctttaaagattttctctgcctttgattttcttccattaaatgtgatacatctaggtgtagttttttttgtttgtatcctaattttgttctcttagttttccggatgtgtggtttggtgtaccttattatttttggaaaattcttagccattattatttcatatattctgctctgtttccccatcttctggaattccaattacgtgtgtttatacctcttgaagtttttcacagttcttggatgttctgtcctgggatttttttgttttttataattctttttctctttgcatttcagtttggaaaatttcttttgacctctcttcaagcttactgattctttccttggctatgtatagtctactgatgaatgcatcagtgttgtcgattatttgttacagtgtttttgatttccagcttttccttctgtttcttttctagagattctatgtgcttaccatatccatttttttcttacatgttgtctgctttttatgttatcacccttagcatattaatcatagttattttaaatttcctgtcagataactaaaaaaaatgtgttgtatctgagtcgggttcagatgcttgctttgtctctttagacttgctttttcttgccttcttagcatgacttgaaattttttgaaggctggatatgtcatattaggtaataggaactgcggtagttaaatcgttagtgtgaggatttatatttatctgcctaggagttggattgtgtttaatatttgctctagctgtaggtgccagggggttcacattcctgtagtgtctttgtttttgtcttccttgctttctttgggtttccctaagaactctttctcagatagaatctgtatcttgcagctttttcagctgtaaatactggagcctcattgatatggtggtagcatgtgggaaaggggaaatatactattataatcttaattattaaatctctgttttttagtggatcgatgtcctggagctgtggagtggacttaaatcagggaaattcccattcctaggtggtatacagcccctgacagtctttcccttggagtgtaggcctttgttacagagaatactcaggttgtatttcgcagtggttacttttcttttcctccttgccagaactataaggggatccttcttggctctttactgtgagaatctggcagtaccataaaacccacaatagtgtggggactcccccataggacagcattctcctaggagtttcccactttcatgctattccacagtcagcctccagcaagtcatcaaaattaccatttaagtgtttgtactggattgaatttttatcctcaaaaaaggtatgtctgagtcttagcccttcatacgtgtaaatgttacattatttagaaatagttggccgggcatggtggctcacgcctgttgtaatctgagtactttgggaggccaaattggaggatcacttgagccaaggagttcgagacaagtctgggcagtataatgagaccatgtctctacaaaaaaatttcaaaaaattagccatgcatggtggtgcacccctatagtcccagctactcaggagattgaggtgggaggatcacttgaacctgggaggtggaggctgcagtgagccgaaattactccattgcactccagcctgggtgacagagtaaggctttgcgtcaaaaagagagagagaaatagtcttttcaggtgtgattaaggatttcgagatgaagaaattcttaataaattgaatgattggtgtccttggaaaagagtaaggagagggtgagatttgagatggagacgtaacagtggaacagtcacgtcaagatggaggtagaggttggagttacgtaagcaaaggaacactaaaaattgctggcagccaccagaagccagataggggcatggagtgattcttcagagtctccagaaagaactaaccctgctgataccttgattttgccctctcgcctcccgaaagaggagaataaatttctttcaagctacccactttgtgatggtttgttacaactgctgtaggagactactagtgttcctgctaatttatggctccagcagcttctactctaggtaataaatagatctcgtccgtgactctctggctttacctgcctcctgtctgtatctttaggtggtagtttgctctgtgtcctcaattttctaatgggtccaaggaaattaaatgattttcagttggtttagcctttttcttgtaagggtgggagtgatgactttaaagctttttacttgttggagctgaaactgccagttgagtattttaaaaatttgtttgttctttctccccacaatttttggcgtttttatgctttttctgttattttagtgatcactacatgcattctcaacttataaaaacctgatgttaataactttactctcttataccatacaaggatcttggaacaattttaactcccaactttgttactggttctgttattttaatttttctgtatttttaatttcctatatgatgttactgtttttattcatttggtgtttttatacctgtatacttaccacttcttttgtttttcctttcttttctacattgctgatacttcatatttaatctttttcctttcctttgctgttctcagagaacatccatcagagttttctttttgtgtagcaaagtcccacttctggcttgtcagaagtgtccttattttttcttcttttttaaaggatattttctcgggtgtagagagtttaagatttgtaggtattttctttccacacatttaagatactaatctgctgccttctggctcccatcgttgttgctaagtcacccattagtctgaatgttgcttctttgataacctttgttttacgattttctttcctctttgtctttcactttttgcagtttaatattacaaacttaattatgaataagtttaaaagagcagggaatttaaccctatttaccatatggcattttctctaagggaaataaaatagattttctttgagtcaatgaacttcttaattatcacagatgtatgcagttatgtggtgctataaacatttttgctgtaatattgaacaaaccactttaatatttactgcttaaaaatcttgtcaaagtaattcctgcacgtgatatacaaatataaaaaatactaaatgacttacaaacactatttccttgcctcattgttctctgcttctattctcattctccatagggaaaccactgtctaaatctatctgttttaatgttttggctttcatctttctaaataattagtttctgttgttgattttggtttatttttaacttgaaaatatttagcttgcttatttataatctcatgttttctctttatctgaacatagtaagggtttatacttttatttctttttctagcaactaatagtgtatttgtggacttagcactttgtatgataatgatattcatccctttactctttcctttacgaacctccctctctcaattctttttcggaattattatcctttataatatcaaggctgttaacatttctattttgttctacaaccataatttagtccttttgttttgctgtacgataatttgattgtcaaagttaaaataattactttcacattattatgaccatgtcgtgttttttttttactgtgaagccaagtagtacatatgattatatttttcctttcccctttttgctttcccctttttcctttcctttccttttccttttcttttttcctttccttcccttccttttttcccttcctttcccttttcctgttcccgttccctttttcctttcctttcctttcctttcctttcccttcccttccctccccttccccttccccttccccttctccttccctgtcgccttccctttttcctttcctttctgtccttcctgtcttgatctgttgcccaggctggagtgcagtggtgcgatctctgctcattgcagcctccaccttctggactcaagccattctctcactcaagccatcctctcacttcagcttccccagtagttgggactgtaggtgcgttatcattactcctgactacatttttttggtatttttgtagagatgggggttgccatgttgcccaggctggtcttgaactcctgggctcaagagatccacccacctcaacctcccaaagtgttgggattacaggtgtgagctgcaactgcacccggacaattatattttgagcattttacagttctttgcctttccaaaagtttctaatcatctttagttttttgtccttaactgactttcttgtctctgagttccagatttgtaaggatagcatacagttttacagtttgtgccccatgctgcttttctctcagatacctcctagaactttttgtctcccgtttagtatagactgtttgttccttagatttgttgcgcagctgcaaatttagtacttattttattctgaggttggtgccactatttcttggatttcatgtcttcctctgttttggttcatattttaattttgcgcagctgcaaatttagtacttattttattctgaggttggtgccacaatttcttggatttcatgtcttcctctgttttggttcatattttaattttgctggataacattatgtaatttcatatgtgagagttaattttctttattgttgcatgtgtgaaaatgttatatcctatgcttgcctgctgatttggcagagtatgcaattaattttccttcaatacttcagtgacttttaatttttctttttctagaatccagtattgccaatgagaagtgttccaagatgattctcaatcttttgtagatgaaatttttatttcctgtcagagagctttctaggatcgtttattgttattatgaaattgcaccgaatatgaatacgttttaaaatttgttcatttcattggattctcacagacctgtttccatttgaagattgttttaggattattttcttgtattatttcatggttaattccccgtttttttctccttgaatttctgttaattggatgttggattgattgggccttttccttattttcatctttttctttgtgcctttgttttacctgttttggaacattttcttggatttatctctgcctcttcaaaaaacagtaagatactttggaagacataaactttaaaaactttttaattttctcacttcttattttatagcattctgttcttttagaaactttacatctcttgaggatatacatttgtgtgtgtattttaactttttaattttgaaataatcatgaagttgtagaaatgttagatgtatagtacaaatcatttttttcctgactgatatctttcatccaagtattttagtgtgtatttttaacaaaccaggaccatatcacaatacaaccataacatttaagaaattaacattgatttgtaatctgtatggactcatggcttattttattcgatggggtatattcttttaatttcattattttgatgctcaaaatgtcctgatttggccagtaagaacccttttgatatcacttctgtgggtcagtttgataccatttcattttttttgataacttccttactttctggcacaacaaaatgttccaggctaatcttatacttttcctgcttagccttggaattggccattttcctaaagagtcctgattccttttagtagtaggtggtatttatgaagtcgtggcatttggttttctcattaccattgggatgttgctggtttcaggtccattagttggacagagctagggtgtatgtgcatgtgtgtgtgtgtgtgtgttgaatatatgtgtatctgtgtatacatacatgtatacatatatctgtttatttctccatgttacgtattgaaaactgttaagttcatgctgatactgcttattacaaatcagtatcacaggattgaaagtagctttttccatatatgcttgtaactcctttctctgacatggagaaacttggcttccattatccttcaaatatttacagtttgattagtcttcctgcatgtaaccattctcccatctctgttgttactccccacccttacttaccctttctcctggtagttttccagtttatgatgggtctttcatgatcaactattgtctgcgcattttaagagtaaataataaatgaataaaaagctaactgggaactctgtttatgtgggtaggagttaagagttttgttgttgttgttgttgttgtttttgagacagagtcttgctctgtcgcagtggcacgacctcggctcactgcaactttcgcctcccgggttcaagccattcttctgcctcagcctcctgagtagctgggactacaggcatatgccaccacgcccggctaatttttgtatttttagtagagactgggtttcaccatattggccaggctggtctcgaactcctgacctcaggtgatccacccacctcagcctcccaaagtgctgggattacaggcgtgagccactgcccctgcaggagttaagaattttattttggaattagcaagtcaggaactgcccattgctttggggacctctacatttctcagtattcattgctctgagaaaccagcattcatccataatagctgtactagttttcctaagctattttttatttttttgtagattaacccttcagttttttgccttggaaggaaaatgccatactatttagcattttatctcgttgaattactgtggttgatatagagattgagtaatttccctgttttagccctgcatgcatttcatgtgagcctacgttttctgaatttctggtctttttgaggtctacagagcagtttggtatttcatttatagctcccttaggttctctaggcttcctcttcttggctttatcagctgtgcatcccctttcagacatttgttaaaatttcttgccgggtcccttatcatgttgggatgttttcagctgtaaatagaaatcctgtctaaaatttacttaaacgttaagaaactacttcatgtaacgaatctgaaggtattatagttaaaggtggttaatctagcagtttgatgaatccagcaaagatccaggttattttcatcttttttctcctccacgttaattaagtatccgctgtttttctggtctcaagtggttatagcaattgtaggtatcaaattctcattaaagaacatccagagtctgcaggaggccattccttccttggtttttttttttttttgagacggagtcctgccctgtcacccaggctggtgtgcagtggcacaatcttggctcaccgcaacctccgcctcccggattcacgccatttctcctgcctcagcctcctgagtagctgggactacaggcgcctgccaccacgcctggctaattttttatatttttagtagagatggggtttcaccatgttagccaggatggtcttgatctcctgaccttgtgatccgcctgcctccgcctcccaaagtgctgggattatgggcgtgagccactgagcctggcctgtgttttgtttttaaagtcaaataaaaccttcccagaagaaagaattcattcatctcagctgggcatggtggctcacgcctgtgatcctagcactttgggagggtgaggtgggaggatcgcttgagcccaggagtttgagagcaggctgagtaatatagccagaccccatctctatttaaaaaataaaaataaaaagaattccttcatctcatgcttatttgaaaaccattcactgtgtatgtttaattgtatgtgattaaggttgctatacatagactatctgtagacctttgcctctttggcagttagatatcctggcacctgctcaactgtagttggcatttaaacaaggtttttcagctgacctgattgtacttagtgtctgagaagtacatacctagactagtgaatatgtaactccctggggctgagagaatcttcgcctgtaaagtacagggtctcaaaatactgaacagaattaaggttctatgagaaaggaaggaggggaatgggcaatgtgggaatggcacttggcttaacaaacaacagtgtctggtcatactcactttcctttttttttttggtggtggtggttgtgattgttgttgtggttgttggtgtgtgtgtgtgtgtgtattttctttttagtcagtcttgtaggaggaagaaaagatgaatggggatatggctagtctgctatcttgagcaggaaagctgttattgctttttaaaaattgaaccttgtaaaatattaaaaatatgcttatgtgatcctataatctaaaatcctgttattaaaagaggtaaaataaatacatattaatcttcattttagagtttgttttctgtttttacatacaatagtaacacaaacttagtagtttagaactatatatatttattagctaatagtttctgtggtttaagagtctgggcatggccagctggatcctcttcaaggttgcactgaagatggtggccagggttgggttcacatttggggctctactggggaagggtctgcttccaagctcatgtgttagtttgtatcattcatttacttttgggttgttggagtaagggcctcagtttcctgatgtcagtcagagacctccttaagttgcttgcttgtggccctctctataggttggcttacagcatagcagcttgtgtcttcaaagcgagcaagggaaaaagtctcctattaagatgggcattacagccttaagtaattacatacaattcattgtctttttcattatcttttttttttttatttgagtctgttgcccaggctaggctcaccaatgccttgacctcctgggtcaagcagtgctccaaagtagctgggactacaggtgtacactgccatgtctggctggtttttgcgtttttgtagagacggggttttgttgtgttgccctggctggcctcgaactcctgagtttttttttttttttttttgagacggagtctcgctctgttgccagcctggagtgcagtagcgcgttcttggctcactgcaacctctgcctcctgggttcaagctattctcctacctcagcctcccgagtagctgggattactggcgcccaccaccatgccgggctaatttttgtatttttagtagagatggggtttcaccaggttggccggggtggtctccatctcttgacctcgtgatctgcctgccttggcctcccaaagtgctgagattacagatgtgagctattgcacctggcctgaactcctgagtttaagtgatctgtctgcctcggcctcccaaagtgctgggattataggagtgagacattacgccctgccatcatattctgttggttagaagtcagtcacaggtcacattggcagtcaaagagagagaattacataaggacatgaatacgaggaagtggggatcatggagaccacctcagagtctgtctgctacaaaggatatgcatgtgattgttaagagtgtctgatggcatgaattatgcattatttttcttttgaggctcccacttaatagctgtattgtactctatattaagatattcaagaaatttgctgatgtagccaaatatttaaagtaattgaaatcagccttgctgatgtctttgtggtattaaatattgttgctaaacagattccttagttttaaatttattaatatagtttacagtattttgtgaattagattttagacatttcgttttttcccccttttttagttgactatattgtggagtatgactatgatgctgtacatgatgatgaattaactattcgagttggagaaatcatcaggaatgtgaaaaagctacaggaggaagggtggctggaaggagaactaaatgggagaagaggaatgttccctgacaatttcgttaaggtaagtattttcagttaaatttctagctcttgcttcataggatttaatctttaaatgttaagaaatagatatacttttaaaattaaaatgttttagataaatgttttctttgtaacatttaagaaaatagagtccaggtacctctataatggatatcattgttgctctgtgtcctgctggatagtaatcctctatgtatgtgtttgtgtatatatgcttgtatatggttgtgtgtatctacctgattactgattgttttaaaataaataatagttttcatttgggtggcatttagtaatttataaagcaggcttgctgtatatattctcatttgagcctacagtatacttgtgaaatagttatgacagatagtagccccattttaaatatcttgatatttagattgagaggttaagtgattttgtccactgttggttagctaagacaagagactttgaactgaagtctgggacagttgcctcgctggtcttctcattatattttgttgcttttccaacaacaaaatgcatttggtcatactttttgtgtttcagcattatagcagttatctgccaaactgtcttcttcaactactaccaaacattccttttttagtaagtattctagtcgcttctgccagaaaacaatctttagggctcttatcaattacaaacttataaaattctcagtagtttagagaagaagaaaaaaagtaaagcatatctgtgtatttacacatcagttataattgtcttgttttctgtgtattagttttcttacatccagcttcattccctggcctcattagattatgagctcttctaggaaggttagagtatgtatctcatttgcttgtccagcttggacagtagttgttagcagaatacctgcacagaatggatacatagttaatatttatttcttgaataaacttgtgtttattttagttgtggtttcacctccaagtatgaaaacatacagttgtctcagtatccaggaaacaccgtggataccaaaatatgcagatgctcagatctgttatataaaatggcatagtatttgcatataacctatgcacattctcccatatactttaaatagtctctaggttaacttataatacctagtaaagtgtaaatgttatgtaaataattgttatgcagtatcacaattggtgagtctgcagttgtggagcctgcggatgtggagggccgactgtattttattctgctacaggggtaccttggagatactgcaggttcagttccagaccaccacaatagagcaaatgtcatagtagagcagatacctcaataaagtgagtcacatgaatgttttgatttctcagtgatgtaaaagttatgtttacattatactgtattgagagtgcaatcgcattatattaaaaaaagcaatgtggatacattaattttaaaatattggtaaaaattgctaacgatcatctgagccttcagtgagtcaccatctttttgctggtggaggattttgccttgatgttgatgactgttgacttagtggttgctgaaggctggggtggctgtggcagtttcttttttttttttttttttttttttttaatttatttttttattgataattcttgggtgtttctcacagagggggatttggcagggtcatgggacaatagtggagggaaggtcagcagataaacaagtgaacaaaggtctcgttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggcaaggtcacagatcaacaggatcccaagacagaggaatttttcttagtgcagaacaaaatgaaaagtctcccatgtctacctctttctacacagacacggcaaccatccgatttctcaatctcttccccgcctttcccgcccttctattccacaaagccgccattgtcatcctggcccgttctcaatgagccgttgggcacacctcccagacggggtggtggctgggcagaggcgcccctcacctcccggacggggcggctggccgggcggggggggctgacccccccacctccctcctggacggcacggctgtccgggcgggggggctgaccccccacctccctcccggatggggcggctggccgggcggggggctgaccccccccacctccctcccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgggcagagaggctcctcacttcctagatgtgatggcggctgggaagaggcgctcctcacttcctagatgggatggcggccgggcagagacgctcctcactttccagactgggcagccaggcagaggagctcctcacatcccagacgatgggcggccaggcagagacactcctcacttcccagacggggtggcggccgggcagaggctgcaatctcggcactttgggaggccaaggcaggcggctgggaggtgtaggttgtagtgagccgagatcacgccactgcactccagcctgggcaccattgagcactgagtgaacgagactccgtctgcaatcccggcacctcgggaggccgaggttggcggatcactcgcggttaggggctggagaccggcccggccaacacagcgaaaccccgtctccaccaaaaccagtcaggcgtggcggcgcgtgcctgcaatcgcaggcattcggcagagtgaggcaggagaatcaggcagggaggttgcagtgagccgagatggcagcagtacagtccagcttcggctccgcatgagagggagaccgtggggagagggagacggagggagagggagagggagagggagagggagagggagagggagagggagagggagagagcggctgtggcagtttctaagatgagacaacaatgaagtttgctgcatcaatttgcttatttagtgaaagatttccctgtagcatgtgagctgtttgatagcattttactcatagtagatctttcaaaattgtagtcagtcgtttcaaaccctccttctgctttgtcaactaagtttatgtaatattttgaatcctgcattgtcatttcaacaatactcaccgtgtcttcaccaggagtagattccagctcaagaagccactttctttgctcctccataggaagcaactcctcatctgtccatgttttatcacaaggttgcaataattcagtcacatctttatgcttcacttctaattctagttctctattttcaccacatctaccgttaacttcccccacttagtcttgaacccttcaaagtcatcctttagtgttgtgatctgtttcttccagactcccattaatgttgatatttttagctcctctcatgaatcacagatgttattaatggcttctagaatggtgactctagaaacctttccgggaggttttcaatttactttgcccagattgagcagaagaatcactatctatggcagtgatagccttacgaaatgtgggctggaatttagtggggcgatcttggctcactgcaacctctgcctcccaggttcaagcgattctcctcgcctccctagttcaagcgattctccttgcctccccttggattacaggctcccaccaccacgcccagctaattgtttgtattttcagtagagatgggctttcactatgttggccagactggtctcaaactcctgacctcgtgatctgcccgccttggcctcagaaaatgcagagattacaggtgtgagccaccgtgcctggccaaaatgtatttcttaaataagaatacttgcaagttgaaatactccttgatcaatgggctgcaaaatggatattatgttagcaggcatgaaaacaacattcatcttcttgtacatttccaacagagctcttgggtgatcagatgcatcatcaatatgcattagtattttcaaaagaatctttctgcagtaggtctcaacagtgggcttaaattactcaataaaccatgctgtaaatagatgtgctgtcatctaggctttggttttccatttatagagcataggcagaatagttttagcataattcttaaggaccctaggattctcagaatggtgaatatgcaatgacttccacttaaattaccagctgcattagcccctagcaagagagtgagcctgtcctttgaagccttgaagctaggctttgacttctttctacttatgaaagtcctaggtggtacctttttccaatagaaggtttcatctccattgaaaatctgtttagcatagccatcttcatcagtgatcttagctagatcttctggttaacttgttgcagcttctctgtcagcactagctgcttcatcttgcactattatgttatagaaatggcttctttccttgaacctcatgagccaacctctgctagcttcaaacttttcttctgcaacttcctgacctctctgtattcagtgagttgaagagaattagggccttgctctagatgaggctttagcttagggaaaagttgtggctggtttgatcttctaatgactcaaactttctttctttcttttttttttgtttttttttttttttttgggacggagtctcgctctgttgcccagggtggagtgcaatggcacgattttggctcactgcaacctctgcctcccaggttcaagtgattctcctgcccagtctcctgagtagctgggattacaggggcgtgccaccacgcccagctaatttttgtatttgtagtagagataaggtttcaccatgttgaccaagctggtcttgaactcctgacctcaggtgatcttcttgcctcagcctcccaaagtgctgggattacaggtgtgagcctggcctcacactttcttcatatcagcaataagactgttttactttcttatcattggtgtgttcactggagtagcacttttaatttccttcaagacctttgtctttgtatttgcaacttggctgttggtgtaagggcctagcttttggcctatctcaactttcagcattacttcctcactaaacttggtcatttctagcttttgatttaagtcagagatgtgtgattcttcctttcacttgaatactagaggctgttgtagggttattaattagtctgatttcagtatcattgtgtctcagggaatagggagccctgaggagtgggaaagggtaggaaatgaccagttggtggaacagttagaagacacacaatatttattaaatttgctgtctgacaagggcacagtttgagatacctcaaaacaattaaaatggtaacattaaagatcactaatcacagatcaccataacagatataatgaagaagtttgaaatattgcaagaatgacaaaaatgtaatacagagacataaagggagcccatgccgttggaaaaatggcattgatgggcttgcttgacacagtgttgcacagaccttcaatttgtaaaaaaaaaaaaaaattcagttatttgtgatgtgcaatgaagcgaagtgcagtaaaacgaggtaggcctgtaactgttttcagaggtgaagtaactacactttatattttatctcttgaaacaacagagagaggctatagtagggaattgaatatttagagcaaggtcacttcattttttgttttatgaatttacttctttttttgatctataatagattgtcatgcagataccatggaaactgaagtcagaataactggatttaaatgcagtcaagttccagctttgccctttgctggcagtgtggtattagacaaatcacataatttccctgttttctccactttaaagtggtattttggcggactacagtaagatgggctctaatacatttttttttgtaaagaaaaatggctttttagagaaaatttattgcagttatagaacaccgatttcaaaaataagttaaaagttaaatacaaagcatttatatagttctcttgagtgtatgctaatgtatatttctactattaggaatgatttatcatggaactccattttgaaataaatttttctttcctgtttcagtataactaatactagaagttaaatttaatgaactgcctgctagcagagtatatagtttatgagtatggtaggtaatagagaaaagtttaatctgggattaaaaattaaccacaggttactagattatagtcagagacagcagtatgaatttatgtttagttaaaacatgtacaggtagatacaggaatggttttgtatatatatgtgtctgtgtttatatatgtgggttagtgtgcatacacaaatatatgtattcctcagctcttattgctgagagggcctagaagcagtgatacctcagtagccgtgagtacatccagtgcccagatcttgatttccaaataccattctctaataaaaggaagggctccttggagaaatgactgattctggtgtttggggtaatgaagatacaagataagcctggagcgtgttgtggtggcagaaaattaagtggttaaaaaaacaaaaggtgggcctgtgtcaaagggacttagaacccaacctgaaggagctcccaatatctagagctggaacagtttgagcagcacaataatctagtatttgatttttatgtaaaatacagcataagtatacatgagtccatattgatataaataaatggttgaataaataaacgggagaaaggataaattgaaacaaaaattccaagtgataattctaaatacttatttccttttccgcacaccccctctttcccttccaaaagctttcctcaggtgtggaatagactaaaggatagatggggccgggcgcggtggctcatgcctgtaattccagcactttgggaggccgaggtgggcagattacgaggtcaagagatcgagaccatcctggccaacatggtgaaaccccatctctactaaaaatacaaaaattagctgggcatggtggcgtgcgcctgtagtcccagctactcaggaagctgaggtgggagaattgcttgaacccgggaggtagaggttgcaatgagctgagatcgcgccactgcaccccagcctggtgacagagtgagactctgtgtctcaaaaaaaaaaaaaaaaaaaaaaaaaaaggaatagatggacagggaaaaatagtagcttagtagcttttaatggagaaacttcgcaaatactgcctttaccaagtggtccaggttaatgtcaccagtgataggttatgttgataccatgtattcccttcacctttgtggtattcttccccaaagtccatgatcctggctggggaaaacctcagacaaactaaattgagagacattctacaaaatacctgaccagtactcctcaaaaatgtcaaggtcatgaaaaacaaggaaatactgagaaactgacattgaccagaagaggcaaaggagacataataaccaaatacattttggtttcctggattggattctggaacagaaaaaggacattagtggaaaaattgattaaatccatatacagttagtagtttaataataatgtaccagtgttaatttctcagttttgaagtggaatgtggttatacacactattaacattaggcaaaactgaattaagagtgtgggaactttctacttcctttgtaactcttctgtaaatctttttattccaaagcaaaattttatttaaaaaaaattacccttaggtaatcaacagcaatggataatacacaaattaataaggtagttggctttatcacttcagatgtgtatgttaaaattcaggggaaagctgtaatttaaaattcactgtccatttgaaaataagcttcctattgggacattaaggtgcacgttcatcctggctaacacggtgaaacctcaactctactaaaatacaaaaaattggccgggggtggctcacacttgtaatcccagcactttgggaggccgaggtgggcggatcacgaggtcaggagattgggaccatcctggctaacacggagaaaccccgtctctactaaaaatacaaaaaattagctgggcgtagtggcgggcggctgtagtcccagctacttgggaggctgaggcaggagaatggtgtgaagccgggaggcggagcttgcagtgagccgagatcgcgccactgcactccagcctgggcaacagagcgagactccgtctgaaaaaaaaaatatatataaaataaaatacaaaaaattcgccgggagtggtgacatgcgcctgtagtcccagccacccaggaggctgaggcaggagaatcgcttgaacgtgggaggcggaggttgcagtgagccgagatcgcaccactgcactccagcctgggttgcagaacgagactctgtctcaaaaaaaacaaacataaaaaggtgcatgttattttgtaaatctgtgaatatggagtgtggatggtggaactaggcttcttgtaaaaaactcacgtccctgttactaattcagatagctatactgaagaacaatgatagtcaaattgggctggaagatgaatagaaatgctgaattgtttttgtggcttattatgaaaaactttagacaccataagtttgttttgtgacaaacttatgcccatttcattgtccctttgcagtgtgtttgtcttccagttttaaaagtattttacaaaggatattgaacacaaggatctatgaacttaatgtacagaatattatcattttgccatcttgcttaagtgttactttttaataaagagaacattacagatgagattgagttctcatcacctccttctcatttctcttcctttgcaggaccacctgtgttcttaagttgtatgtatcctttagtccatagttttacacctatttgcctgtgcataaacaaatagtattttgtgtgatttagacacttacataattgtttcacattgcaccttttctttatatttaatgtgagatttcaacatggatacataatgtagttgcatctgttacaaatgggttttataacactagttagcttataggtaattagtagagagaaatgatgtcaggacaatgagaaagtgtgttagtttattttctaggtaagaagagctgtaataaagattgtaggattatgacttcagcaagaaaatggaagcagcttggagttcttttgaatctgaataccttttttttttttttttcttcttttaaagtaaccatctgtatctctaagggtatcttcctcaaagtttacagttctggcattgagggctcttaaatcctggtgctcactttcactgtctcagcatccataagccaaccaacattcccacttaattgttttttgttttacatttttaatagctactgaagaattcttcagtcatgactgcttgggcagtctaagttattgcctatctatgtaggttctagttattatttgttttcgtttatagtgttgaggtcccaaactgcataggtttttgcataaattgagtggtctgcaaactctattttttatatagtcactggtatttttagtgtttgattttgaagttttcacataataagtggtattttagtgtttttttttctcccagaatgcatggtgtttaagactgcacatacagtattataggagagacacctttactactactttctaatctctgcatagtattccattgtccggctaagtattacatattttttggatatttaggactttttttcaatttttagctattaagaaatttttagctattagaacttcagtaaacatcttttttggggtatgtgtacagctgaagatttgctgactcctagggtgtgcacatgttcaactatactagatgttgtctgatttctctctcaagtaattataccaatttaaaaacgtctgataccatcagactttaaaaaaaatttttttttggggggggggctagccttacagatgtacagtagtatctaccatgttgtgtttcattttcatgattactagtgaagctaggcatcttttcacatttcagttccttgtgtacagcttgttcaggatatttcttctatttttcctttgagttcttgttcatattctagttaatttctagtagttcttaatgtattttaaccaatagacttttgtcttccttctgcttatgtattcctcgtaaatgctttttgtgacttgtctaagtataaacaactttactattagctgtaaaattttcatttttagtatgtcatcaatctttttttgtgtttagtatgattaaatgtttttcacttggaaagatatgaatagtctacttcattgatcttttttaagtcatttcatttttattttgtagctacaaatcataaactatacctcattaatttgttatgtttaagaagtaagctaaaactgaggagaaaccaggctaacttagcagatattactacattcttaacttcaatgttttagactaaagtagagaataaagatttatttgtgggtataactttgattcagtatcaatgtcttggctagttcatatttggcacttggttgttggagttgctactttgtaattgagataaaacaaaataaacacattccagtaaacaaatgcttagttgactgtgacatattttggggtgtggtgagaagaatctttcccacaatttattttattgggggaaataacagtgtaaaacaggataaattgtaatgccttacatgactgaatggcagacatgtgataagatgataggtgttacagaatctttgaaaaaatgtctttcagaaaggggattaaaagtaaaactaggctgggcgcagtggctcacacctgtaatcccacccttttgggaggccaaggcaggtggatcacctgaggtcaggagttggtgaccagcctggccaacacggtgaaacccagtctctactaaaagtacaaaaattagccaggagtggtggcacgcacctgcaatcccagctactcgggaggctgaggcaggagaattgcttgaacccaggaggcggaggttgcagtgagccaagatcactccactgcactccagcctgggtgacagagtgagagtccgtcttaaaaaaaaaaaaaaaagtaacactgaattggttcttaaggtagaaagttataggagtactgagtgcattgtaggtctggcaaaggtattagataatttatgataaaaagataattaggcagactactttggctgaatgaaagttttcatatgggggagtaatgggatttaagactaaaagcatgggttaaagtagggggtacagtatattttgaagattgcttaaagatatttaaaactatttaataaattaatctgaatgagaaggaaaggttttccagaagatagagttggggctataaagtataatagagatcagagtgctacattgagagtggaaatgaaggggatagataataggctaataacactttatatctgtatgaatactttgcatattcacatacgttatctcactttattctcatgtctttgaaaattaggcatagggaatgtgtcattcttacccaaagtcttgctggtaatatgggctaaaaacttgatcatagttaactctatgacaggccaatgccagggctctttttagatgaaaaaatgcatctatggtatgtgctagttattagagaaatgtgatcattctgtaacgtcctgtgcttttgaggctgttggggcaagtgatataaatcctagtcattgaaattttccagtagcatcagcatagttgaaagatcttagcattataaaattaaaagtgcttttgatcactttcagatttgaccctggaaaaggaaaaaaaaaatcaaactgtttctcaaattgcaatttgatggaagtaaatttttttttttaaactaaactcaagaaatttcagaagaaagacacttgacgtaaaggaaattcaaagactaaagatggaatgcaaaatatgtgggaaaaaaagtaaaaatacaggtaattagaaaatgaagcttggcttgaaatgcataggtttctagataactttgtaaaatgcatttaatcattgtgttctgcctctatccctggaaattttgctgaaaaccaagattttattatacagtttaaggaaattaggaagttcattttgtaagtcaggatagtttacattgtggtaccaacatcaaaatctcagtggtggcgtagcacaaggaaagactacatcctttcatgcaaagtttggtccagctagccaagtcactgtgctgcttttcatgtggcggcacaaccttctgggctgctttagtcttgtggcaagtcattgtcaatttgtgcttttgtaatttttgaggacagagcaacagagcatagaaaatcacgttccagttttaaatgcttccctctggaagtggtccatattactttttcatttcattggcccatagcaatgatgtggtcatgtgtactatcaaaggggcagaaaaatatgatcttgctttatatgcaaaagaacagtagaactagagcattagtaatgcctatcacacccagtgtgtgtgttgactggtactcatgaaggtcttttcatgatgtgcaatggatgctttgtttacttgattttatagcttctggattgagagaagatcctgaattggttagaattgggcagtaatactggaacagaaagttagagatgacaccagataaaataaattttcccatttatatacttcccatttttttttcagtgtgagtgacaaatgatgttttagtttgcttatgaaaagttagaaaacaggacagtggaggctgagatttttagtttcagagtaattgagatgtaaataggaaagtcatggacaatcaactgttattctttattaaagttagatcatagcatatgattttatatttagtgcagcacttcagtgtatatcaattctatagttttttatttctgccaatatgagttagttgctggtagttgtcccctccaaatctcatgttgaaatgtgattcctaatatgggaggtggggcctggtgggaggtgattgacccatgggggctgatctggcatgaatgatttagcgccatgcccttggtaataaatgaattctcacccagttcacttgggatctggttatttaaaagagtttggaacctccctcctctttctcttgttcctgctctcactatgtgatgcgcctgctcccctttcttcttctgccatgattggaagcttcctcaggccctcaccaggaagagatgctggagccatgcttgtatagcttgcagaactgtgagccaattaaacttctttttttttttttttggaggcggtttcttactctgtcacccaggcgggagtgcagtggtgcggtgcgatcacagctcactgcagcctcgactttctgggctcaagcgatcctctcacctcagcctgacaaatagctgcgactacaggtgtgtgccaccatgcctggctaatgttttttctattttttgtggaggtggggtttgccatgttgcccaggctggtcttgaacttctgggctcaggtgatatgcctgccttgacctcccaaagtgctgagattgcaggcctaagccaccgcgcctggccctaaacctctttttaaaataaattacccagcctcagatacttctttataacagcacaggaacagactaataatagttgccaagtcttcatgatatttctttatcatcttttagatcttttgatggatatagacaatctggtatatagtttaggtatttagactttggagcctggcagacttgtgtttccctgggtaagttatttagtatttatgagatttttaccaccacctctatctgctgaaaaaagggatattaatagtatttatcttatagtgttatgagtatccaatgagatgatgtattaagcgtttaatctagtagacttcgcttactaaatttaatgtgttgtgatcagcattttacataaataagatggataggagtgaagttgaatagaaaatgtcagtttatccccctaggtagaatggttaaatattgttttgtaaaacttttgtgtcaggtgttgttgggggaggttctgagtgtgtgtctttaagtgtgtttatatgtgtatatatactggggttgttacaaaggttttccccctttattctgaggaaaatgggagacttcaaagagaacagtgaaaatgatcagatatgaatttaaaaaatcagaatactgagttatgatttacagaataaaatacacccattttaaagtgtatttctgtgagttttgacaaatatacctatgcagctatacctatatacctatgcagctagcataacattaagatattagaacattcattatctgcaaaagttagtgttctactgcatttgtgccttgcaggctagtggcaaccactgatatgctttttgtcattctagattagttttgcttttataataatttagtataattaataatgattggcttttttgtgtctgctctcctttgctaagaagcattccattttatgtataccacagtgtttatcctctttttacctgttggtggatatttagattgttttcaatttctgaatatcaggggtaaagctgtcataaacaatgatatatgcctctttgtgtgaacatatattttcatttcttttgagtaatacttgggagtgggattgctggggtatataagaaactgcaaaactgtattctgaagtgattgtcccatttcacatttcacatttccatcagcaatgtatgaatgttctagttgtacatctttttaaaaatcaaccacatgtccctttttgcaatagttgtgacaggcttttcagttttatttagatagtgggtctcttcagtattcctgaaaagagtatgaattccccaggtagcctctgttgtggtattttttagaaagagacacggtagtactgtggcatatccctccctacactccgcctcttggtgttccaattcagttgttttattcttatctatttgccactcatttatttattcagatatttactgaggttccttgcgctaggactttttataggtggcaagaacacaactgtgaataacacagataacttcactcttttttaatgagttcatattctaatggtggggcagacaaatatgcaaaagaataaatgaataagataaagttaatttttgatagccataagcactttgaacaaaaatgcttggggaggtggaaaatgacattgataagttgggtggtctagaataacatctctgacaagatttggccagtaaaacacaggagaatgcagagtagataaggaatgaattccctttgagaaggatccctgaaattagacaaagtaggctgcatgtgatggtttgggtttctagctactctactagagctacttcaggaagaagatagtttggcattgtgacaggagtacggcctttggaatcaggatgtgtagacctctgtttgacttcttttgatgaccgtgcccttgccactatatccacacaagtacctgttgtgtgttctttctgaagatgcttcaccctagagcatgagtttcttcctgtgtcaaagcagggaacttacctgttaggattgtttggtagcaattagattttgtgtgtctattccttgtatgtagatatatagtggaatttattatctcatcctgttattttcttgctcaagaactgcccattcatatctgaaaggagaaattggagaagaaaatcacctaaattataaaattagtcaacaaatttttttgaatacctataatatggcaggcactgttaagtattaacaataaaatagggaaaaaggcagaacttttcaaattgcccttttaaaagaagttagtagttttcaaggaaggagaaaaataaagaggaaaacagttaaaatgagaaaatgtggaactagcagttagcttgattagtctatttgcttaaactagatagtaaaaaagattttagtgtgttaggatttgagtataagttctaacttcttagggcaaaacaaattttgttaggtcttttttgtggaactaaagtgttgtgtttagaaaaatgacctgtggaaatgattttttttttttgttgagtcctttggaatggaaaaaaggtagttcattttaggtgaggggctaaattgactatggaaagttatttcagttactgagactggggataaagcagacatctctggggcctcgttattaaaagctgaagatttgtgttcaagtcctggtagaagtatcagtggtaaaaatatttataacagtcaatattggttgaggaccttggatctaaatataagctttattttcctaaagaggaaatctatgctgaaaaaagtgaaatgaattgtgccaaagtccagtgcctcacttggtctctgttgacagttgtcgggaggggctccccactgtgtttccatcgatacctgccttggctggagaggcagatgtacttcattagtgctgtccatatggcctccgctgacagcagggggaaggaaggtgtggtttgttttcacctagtgtggagggaagtcccggctgtatactgggccttttctggtaaccatgcctctggtgggtggtggttgggggcgaaagtggggtctatggtggtgattggggcgccttattatagcctgatgaggatggaagtctaggttccctacttggtcattgctaccatgggcaggactggtgctacagttttttttttttttttttttttgtccctgtggtgtttgactgtggcacagtggttattgtctaagagctctctgtcttgccagtctgcctgtttcctggtcatttggctagggctaacactagtgggcttttcttgagttttgttttcttcttctctgcttgcattggcatttctatgttgcagacttctccagtacctagcctgggatataggcaaaaagaatattagtgaactcactgccatgttgttcctcagattctgaggaacttgctcagttcctgtccctggctggtctgccttcttttcaaaatttaattatttatttattttttacatatgtaaggtccagagctttaaaatatatttagcaggaagaatagggaaacacctactccatctttctgtaagggaaaatctagatggtgatgcttgtaatgcacatccataacagttgcttatcttgctcataagtaaggtttttactcagtctaaatactcataattataaaagttcttttctattagaagtggcatagtaggccaggcgtggtggctcacacctgtaatcccagcattttgggaggtcgaggcgggcagatcacctcaggtcaggagtttgagaccagctttgccaacatggtgaaaccccgtctctactaaatatacaaaaattagctgggcgtggtggcgggcgcctgtaattccagctactcgggaggctgaggcaggagaagtgcttgaacccgggaggtggaggttgcagtgagccgaaatcgcaccagtgcactccagcctgtgttgcagagtgagactccgtctcaaaaaagaaatggcacagtaatagctgtttttaagctgttgttattaagctagtgtttggaaaagtttaaatattagttgccattaaaaaagaagaatagatttgcattcagcaaaaagctaataaacgtagttgataccctttaagttatgacttgcttctgaaggttaagataacacatgagatttaagataactctcacgcctgtaatcccagcactttgggaggctgaggcgggcaggtcacctgagttctggagttcaagaccagcctgaccaacatggagaaatcccgtctctactaaaaatacaaaattagctgggcttggtggtgcatgcctgtaatcccagctacttgggaggctgaggcaggagaattgcttgaacctgggaggcggaggttgcagtgagccgagatcatgccattgcactctagcctgggcaacaagagcgaaactctgcctcaaaaaaaaaaaagaaagaaagataacctaacagagcaagtgactaattggagacattgaataattattggtggactctgttcactgatgagtttcatataaaagggtgcagagtccgatcacctgaggaggctggggaggagcaggtgaggaggaatacttagaaggtgcatttggtagtgaattttgcaagcgccagagcacagagagtcatggaaaaagcagagaaatatcagcggaatgatatcaaaagagaaggttaacaaagtatttttattcgctgtacttaaaagagtgttagcaggacagtatttgttgataaggggattcaatctgtgaacagtgaagcagtttgtttttgtgagctttgtagtgatcctggaggtggtactacttactttacaacctgttactgttataatgtttttattttgctgctttaaaaaataagtggatatgttaacagaaggtgtctcaggtgctggtaagtgaactgctgttacttacatttttaaatttaaaatgaaattttgatcccttgtgaagagtttcttgaccttgatataaagtgttctagactttttgatatagtcaggaagaagaaaacaaaaattacccagtaagtttttcaggaagctgacaaatgaataaaaatcactcagatgttttttcttggtttcaacctaaatttctagcaatttttttctcttcgtttagaatacaggtttttaaaaaattagtttgaaaaattatcttttatttaaaaatgtttattttcagtttatttgcagatttccatagtaaatataatgtaaattatatttacattaaatctttaaatataattaaaatcttttttaaagctacttgaaaaattagcaatatgaagaataagagatgtatgtatatagctactttggaaagtctcattgatttagaaaaaaattctttttttagaaggatgctgatttagtttttgactgttgttattccagttttcataagaagaaatatttaagtaaaggaaatgacaatttggtgttatatggtgtttagttttaaaaatcttttgctttatgaaactgttagatcttttggatggatgtcagtgatgttttccagtatttatagaaatgtattgacgactttaatagaacaattcaagagctagctttataatagttcatatagagaacattttgatgtttgatttactttcattaattggagacagattaagggagaaaaccttgcagatattggaatattaaatggaagacaagtttactggctaattgggaattgtaatgaaaatggtagatgttaattagcttgactgtagtaatcatttcactatctacacatatgtcaaaagatgttgtataccttaagtatatgcaatttttatttagagaaaagaacagatctccatttccacttgtgttgaatatgttgcttaagcaagaaataaatcttcattgaaaataagtaaaaataaaaataaaaaacggttgaaagaatgccaaagttgtgtatagttattgatgatacatcatagtatgttttctgttactgttaaagcattaactattttacacatatattaagagtaattcattctgtgacttgagttattttagataatactattctgaatttcacatagactatattcagtgagttggagaaatactttatacaggtaatactagaaaatatatataaggatttacatttgataaagtgtactcgcatagcatatgtgtctttttccaaatgccctataacaatgtgacataacactgttatttgtaggtacaccaaatcttttattttattttaaatcacagacatagtatatgttgaaacaaaagtcaaagcaatatagaagtatccattgtgaaaagtacctttctttataaccctccctcagctttcttccatgtttagaaatttggtagatagctttaaagactgtttcctataaaacaaatcttttaaatggaattatttgtaccatttcccccttttacatactattcttcatactgtaaatagaaattcaagaaattcaagacattattatatataaaccatgttaatgtttgccttggacttaatctggaaagttacattctcattttttccctttaggagttaatacattttgtttcggctaaggtatttcagattggtcactactgtagaaataaggtaaaccaggtatcaggaaagttgagtgccagagctgggcttctgggatatctcctgctctagctccttggacccagcacgacttgcctgctgtgtcactctcatctgtggcctcaaggagtctagcatccttgagaaagaatttcccatgtaagcctcatgttttttccgttagaagaaattgtaaacacattagccctcattttcttgcagttcttattcttaaaccccttcatctaggcctgaaggtggaaatgacattttttagatgaacaaaactattaggaaaaatgtgaccattataaaatattgggttattttcagttcatttcaatcattgtggtatgtctgaaagaatgagtaaagagaaaagttcttaagtgtttttttttccactgtacttcacttggctctcatttacattcctggatagaaaaaaggaaaggagtaggatgccattgacagtgaatttatataacttcccccaccccatttctacttttgccttctctgaatacaggaggaatagtttaaataggaagttcctttgtccaaaatgtggagagcaattgtgtaacaaaaagcatagtagaggagagaagtttagaaactttcaaagtaggtctgctatatctgtcatttttgttttccttgccgattttgatctattgacacttagacgatacgtactgatttcatattaaggacattttttcttgttggtcatttttctttgaacttaagtgctttagtgaatatccaatttaatttaatcataataaaaaggaaaatcaaatgactttaagtagtttttcctggatattccttatatattattacttatattaaaaaaaacaaaaatacttcaggagtatggtaggccattttgttaggttaaaatctaaatcaatcatttctagactattttttaaaatgtaagcctaaaattagtcagagctaaaatagttggcagtatataccagataaacatttaattcttattttccttattctttagtaataccactttttcatattgtctgattatgcttctgtgaagtaggagatactaattttatatacttctggaaatcctgaatgttaaattaaaataattaagtatattccttagattttaattagcttaagcagaattattactgtgtttaggaatttggtgactaggtaacctgcctgtttcatttgagaaatgaaatgaagttcttgacttctcacctggtttttattattctttgcgacctttgagtctatggaatacaagtaaattgctttctattttcaaatcatgataatggccacagccatgattagatagccagattattatatggacatattacaacatgaaggagtggtttgtgaattttgttgattatctttttagttgtttgttttggttaatacaatcaaaattatgtatctttgattaccttaatagatgaagagtagatataccctttaacttcccccaccatttgcatatgtatttcagtttttatcctcttgttgtactacctactctttatctataagcaaaaccaatcagtatagcacattcttatctatatggagattatccatattgtattttttcttggcaagttttgtattgacattacctattgtgcaagtggcttccctcatttgaagtatgaaactcgagtttttcagagtttgctttgactatacatgattgctttccaagtgaggactcttttttactacatctcctgaagttattttccaagtcaggaaaggaagtgatgttggtaggaaataaatactgcaatgttaatatgtatgctatttcctggctcttttggtaaaagtgaatgaagggcagaggaaggaataaacactggaagccttactaataccttaggtactaggtaaagtttgctatattagataaaatttgctattgaaattgatagccaaagagtagtctggtagaggcactatgtttccagaaactagggaaaagagtagattggtgagagtgtatgtgtgtgtttctagtagtaagggattgtagctcggaggagttccagagaagaaggtggtggacctcacagcaaactttaccttatttgtaattttgcctagagccttgaggtctaagcaaaattgtacttgtggtaacatctcagttggcagtatgtatttggaaggctgtaaacctgagttttttctattcattgtagactataagattttttaagttgctttcccccttttatttgtatcttttgtcttcagaagatttattatatctaatattcttagatatgattatgtcccagagaaaattgaaggttcctaaaatggttctagatcttgagcaatgaattcatatatcatgttaacattgttttacagcaaatgaacacaatggaaccaggatttgtatacagtttgtctgtctcctgaacctgtcctctatcacatttggtcagattggagttactttcaagaggaacaggatttgaatagtaagtcaagtgcttggtctcctgtactagaagcaacagtagctctcagaagtgtgaattttattttttcaatgtaggtagcttatgaggcagacaggagaatccaaaatgagcaagtactctttggcatgttgaggttgtaactactagtcttttatgtagattttgtttttattagtatgaaaaatacttagtgcagtctgaaaactgtgaggttgatgggtgttattaatagcaaatcaaagtaattttcttatgtgcattaccaataaaaacagggaaatatttgtgtatctttcatgttttgtacttagtaatttttcaaaattctctacccacttaactgtttttccaaaataaaagactccccccccctgattgaaaaatattcattgttcttttaaaaaaagaaaagtttttttgaacagttacatgaagaggtcatgttcatcagaaatcctacgtgtggtaggcataaatgcctggagaagtctgtgaaggtgtgctcctacactcaatgaagaagtatacctgttgttgctgctcttggtctgtctcccttcccacctcccatggatcaactgaaagtataatgttgagacaggtatacaaagaactaggctgtaaatttcttatatccaagagaccaaagtgattccaataggagcaaagaggcattacaaggagatcaagaatttggtgaaagaaaggaaagggagaattatactgtggagagtaaaagggagtgtgaaaacaaggtacacttctctttcagtcctttcctgaaggaggtaagtttcatataaagtagattcttatttcctgtggacacagtgcaccataatgaatgaattgatatgctagcttgaagaggctgcccagtagaagaaaaagatagcatctggtatgtggtgatttggtatgggacatggaagtaactatgttgtcagctgtgccaggaagctgcttggagtacgttgagtgatacctgcagattagttgtttgtccccaaccagagaaagtactagatactgcttgtgccagtggccctgccctggatttcattatttttgaaagtgacaaggtttagttttctacccagagttacatgggagttcagagtcaagaaaattgggttcactagtaaaaatcaagtcgtcgtctttacctacatttgttttttggttcatacctgtaaatatatatttgtgtcatattgttggctaagaagcttctgggtagcatgtatttttaatagaaacatgttttatatatgtggtgttgtaaaattggtttgttttattcaatagtgtgattcagatatcatttctaatacagatatatcattctttaatgactacagtattttatcagatgcatgtactgtagtttatttaaatagttcacaactaatggctgtttgagcttctaatttactacttcttttgggggatgagacagagtctctttctgtcacccatgctggagcgcagtgctgtgatcttggctcactgcaacctccgcctcctgggttcaagtgattctcatacctcatcctcccaaggagctggggttacaggagtgtgccactacgcctggctaatttttgtatttttagtagagaggtggttttgtcatgttcgccaggcttgtcttgaactcctgacctcaagtgatctgccagcctcagcctcccaaagtgctgggattataggcatgaaccactgcatccagccagttcatttattatatatggaacttatatatttggttgggtttatttctggattagagtgttatacaactgtctcatgctttgctgtttttaccagttgtaaatagtagtttattaagtattttagtgcctacttggtgctactgttttaggcagtggaaatacaataaaacataatcccttctgtcctggaacataacattttagtgatgtacctactgattttttagtcacaaaaagggtcacaagtttagaggtaagtctcttgatggcagaggcaaaggatgtctcacctatctttttttgtgccggaatagggaatctaggagagatcacagagatttttttggatcttttgcccatttaaaaaatcaggctgtttgcttttttattgttgacttttaatatttctttgtatatctcaaatgacagtcttaggcatcttttgcaaatattttctcccattatgtggcttatcttctcactctcttgatacgtttgctttcttagtgcatggcaacatctgagcagttgcccaagtcaggaacttgggcatcatctttgactctttcttcttaggttgtatctactgaattatctagattctgcctcttgaatattttctgactctttcagcgtttctcccctttgtcacgattataacttagggcacattctgctctcacctggtatatttaactctagtactgccccccccccccccaacttattgcactatggcagcatctcatcttctgttaggtcctcacatgaattcattttgttcagtgtcgttttgttgtaatgttgatgaaaaaaaattggttcctagctggggccactgtctgtggagtttgcatattctcatgtttgcacgggttttctctgggtactccagtttcctcccacatccccaagatgcgtacttgaggttcattggtgtatctacatcattcccagtctgagtgtgccttgcgatggaatggtgtcctgtccagggatggttcctacctggcaccctgaactggtggggataggctctggccactggaaaccctgaactggaataggtgcataaatagttatcttactggtttttattaattttactaaatgtatgtatagctcacatttatttcagtgtttattattagaagtgttttgatctttatttataagtttggtgatgtttttgtgacccagaggtatgccacaggaatttaactcttgtttatgtcaactagcctatgctaaaatcggtttccttgtacattgttttgcttaaagtcacaatttccaagaagttatcaaagactttaagtgggaatttactgtatttcagattgcctacccagactcagagagctttatatcagccgtctgctcgccttgctattcttgaattttaccacccttatcatctttcccttccttccatgctccaggcaaatttagtgttgtcttcattcctcagaagctctgtgcttcccattgccttccggcctgctcatatgctatgctttcctgttaagacactcttcctattgccttctctgtaccttgctaactctcatttattctttctgtctcagtagagatgtcactttctctgagaagtcatcccgatttgccttaacaccactgaatttatgttagctacacttcctgtgttaggcatttggtgttttctatttatagcatttatcatgaacattttttaaaatgacctttattgaagtataatttatgtacaataaatggcatccatttaaaatgtaaaattcagtaagtttttaaacaattgtatacaaccgtgaaacctctggcacaatgaagatgcagaggctctatgtgtttatcaagaactcttgtgccactttactgtccatctctctttctgtgatcctaccccgacaaaaccatttatctgctttttaatctatacattagtttgtattttctaagatttttaatgtaccatatatattttgtgtctggcttctttcaatcagaattagaaattgatggatttttttgtgtatcaataacttcttcatttttattgctgagtagtattccattgtttattcatttacttgatggatgtttggattgttttgagtttttggatatttattacactgaattttaactgcctggttattttctgtattcttttgtaaaatgtacagtactgtgagaacaaaagacagtctctcttgttaacatttgtatgcctagctgctgcctggtactagcaggtgctcaataagtgtttatgaaaatgctaaagagcagaaaggtgatactatgtcaagtagtacaaatataaatttactttagtgtctgttgaaccaggattttcattaaggaatagtattcattcagtgtcttatttaggttgacacttgtggacatatattgccagaacttatttacaaggtaatagcttttttacctttttaacatataactgaacgttattttaaaatttatgggttttggctgggcaaaactagtaccagcaccctgggaggccaagaagggaggatcacttgagcccaggagttgaagaccagcctggacaacatagcaagatgctatctctacccaaaaaaaaaatgtgttttttgatatcatactaagataatcagcttttaagagtaaaaaatttctttaagaattctcattttcaattgctatgccagagattccgaaactttcttggtttacacaacaccattattgtctcagtccttatttcatgatgctcctacaccaaaagaaagacctaagagttgttcttactgttggattcgagtaacttaataaatgtttatattttaacaatttaaccatttaaaaaataatacacagaaactgaaagaaaaaacatttattcttaatcagaattattactaatgaaatgtgtacaccttttgggcactgcactgttgcgggaaaccgaggactggagagacgatatgaggggaaacaggaggattgtttatttaaggtatgtactggctcagctttttggatatgaatccactgagccagtgcataccttaaataaacaatcctcctgttctccatattggtctctctggtcctcagtttcctgcaacagcacaactctcaaattttggaaatgataggttaccagtactcttcttttcctgttccacattgatttttaaaaaactatagctagtaataattatagtacataatagttattttgcactgtattaaaaaactagcacattatcagttctcaagtatttgaagtatgttttataagaatccttttcggccgggcgtggtggctcacgcttgtaatcccagcactttgggaggtcgaggcaggcggatcacctgaggtcaggggtttgtgaccagcctggccaacatggtgaaactccgtctctactaaaaatacaaaaattagccaggtgtggtggtgcatgcctgtagtcccagctgctcaggaggctgaggcaggagaattgcttgaacccaggaggcggaggttgcagtgaccagagatcgcgctcagtgcactccagcctgggcaacagagtgagactccttctcaaaaaaaaaaaagaatccttttcacaagatacttttaaaacaatctgtaatacttttataatcataagaatttataaacttgaaatagaaatattctattgtaaaggttaagaaaagtatacttggttggccaccgaggctcactaccataatcccagtacttcgggaggcagggtggaaggattgctcgagcccagaaggtggaggctgcagtgagccatgatcatgccactgcactccaacctgggtaacagagggagaccttgtctgaagaaaaaaaaaaaaagtatatatatatatgtatacacacacacacacacacacacacacacacacaatacttgccatatcaagttaaaattgttaattttaatatgaaatgtgtgagataggtatccagtttcattccctattaaatatggaacgtttttcttgcacaatgtattttaagattccatctttcctcatttttttctgttttaaatgaagtttgtctgtttatggatttcctattttgtttcatttatcagtactgtctttatgccagtagcacattgtctaattctatcgttatagttttcctttgtattttcgttaacaaaaactccctccgctttcttttccttgaagtattttcactgttcttagccttttgttctgtataaatttagaaacagcttattaaattgctactccaaattttttgtgtatttgaattgcattgatatattacatcaattttaagggagaactgatatatttttatgatactgagttttcagttactaaatatggcataactttgtttttgtcttcatgtcttccagtaaaattttatacttttccatgatggttcacatgtcttattttatagccatgacttagatcaggggctatcaaactaccagcccacaggacaagtctgaataccacctgtttttgtaagacccatgagctaagaatgctgagaattttataaatggttggaaaaaatcaaaaggataatatgacatataaaattatttgaaattagaattttagtgtctataaataaagttttattggaacatagttatattcattcatttaaatatctgactgcatttataccacacataggagtgttgatggttgcaacagaaagtgtatggtctgcaaattgtaaaatatttactatctggcactttatagaaagtttgtttacccctgactttgaattattgtttgtctttgtatctcagtgtttctttgtagttggggtgagtggtcggggtggggtttgagcctctctttcctttatcttcatctccagttctgataaaacttaaactcatgagtcactgttaccaaaatgtgttttattcttcagatatgtttgagcagagcaaaggttggaaactattgatattatgatttatatagtaattactgtagctattttttggtattttacatttgaggatttaatataaaaaatataacttaacttgcctctttatttattttcccttttgtaggaaattaaaagagagacggaattcaaggatgacagtttgcccatcaaacgggaaaggcatgggaatgtagcaagtcttgtacaacgaataagcacctatggacttccagctggaggaattcagccacatccacaaaccaaaaacattaagaagagtatgtaaataattcctttcctgcataattacatcaaaatagaaggatattttataactgtgtctaaattaagaaaaattagttcagtcttttgtagacaactacagtaacttcctgcaaagtctcatgttactagttattgccctgtgtagtcaatcttaatttttagtcatgtgcaatcaataacaaatcaatatcattataaattaaagcatgaggctctgttttcttatttatctttcagactctgctgaatgattaccattttaccttaactatattttaataccatttatttagtgggattctgaaatatctgctgattcttagcatagatacaagaattttgatagtgctttttcttcagttgttaaacatctgaacataaacatttccaaggtggttggccttgcaaattaccttgtaaggatttggtactgtgtaaatatgttaggggaacaacttggcaaagaaggagagcattacatttgaaatcagataagggtttgagtctgtcttatgacctcagaaagatcatttaaactgttgagttttatttgctgctagtgagaaagtggttaagaaaaaaagcaaaacaaaacaaaaaacaccaggtaatattgctgttctcaaagagcttacattcttggaaaagaaattgttatttaaggccaagtgcagtggctcactcctgtaatcccagcactttgggaggcctaggtaggtggatcacctgaggtcaggagttcgagaccagcctgaccaacatagtaaaaccccatctctactaaatatacaaattagccgggcgtggaggaacttgcctgtaattccagctacttgggagactgaggcaggagaatcacttgaactcgggaggtgagccgagatctgccattgcactccagtctctgctccaaaaaacaaaagaaactgttatttaaaaagtgtaaaatattaaacgtgtacaaagaattacggtgttatgggagcacatagcaaatgttttaacacagtaaaaccagaagacccttcagagattgaatacttttttttttttttgagatagactctcactctgttgtcctggctgcagtggtgcagtcacagctcactgcggccttgacctcccaggctcaagcagttttcccatttcaggctactgagtagctgtgactacaggtgtgtgccaccacgtctgctaatttttgtatttttctttgaagagatggggttttgccatgttgcctgagctgttcttgaactcccgggctcaagtgatttgcccccattggcttcccaaagtgctggaattacagacgtgagccaccatgctagcctagagattgcatacttattactatggtcaatttgatttaacccatctatgcctagtgtcccattattggaatgctaagaatgtaggagttattactatcctgctgttcaaggtcattgccaaggtctgattgcaaaaattcaaaaaactgcaacctctggcataaatgggttaatagttaatgaatatttaatcacatttactttaatgtctttgaaattatggtgtataaatccctgtagtacaaaatattctacaataaagaaattttgtttacatacatttcccaaattgtaattgtaaggctattaataatttttatagagtccccttatgtctcagtctattactttcataagctgttgtctgtcaagtttggggaaacctctacttttggattacatcatcctttgattattttcataaaataaaaacaggttgtcataaaaatgaaacagattttatgacacttggaccaattctagggttctatttgttctttgtttctcaaggaaatacaatatccagggaatatttgcatattatatatactgctttctagcattattgcctgaaggtggatggtttcagcagttctgatgatgatgaattctgaaactgcttggagactgggggacaaataacagttttatatcatacagctgaacctctatatagaatgtctgtgctgagggagaatttttaggcccacgggaggttttttcatgacctctgtccatagtaaaatccatttacaactttctttcactctagggagctataaagggataagtttcttcttaagtagaagttagacaaagaggttgaaggttctgaatattttttcactttctcttctaataggaaaggatacagtaaattttgcctttcgtaagaacactggatgtaaattcttttctcttgtaagaaggaaaaatcattatgcagttggtgccaggaagcttaggcctttttttcctaaggatcttccataacttgtttttaaagtacatgtgctgcaaggactatattggttatttagtgtcagctaacatttaaaacaggatgcaaattgtttttgcttttctgttttcctgtcatttatgtattattttatgtttattaaacttgatttttttttttttgttactgtttggatcatatctctaattcccaaaatagatcacttatttaaaagtggctcattgtattgttacatagtagcaggatacaactaaccagtactattaatattaatttaaaaaaacccaaaaccattgtattaacataaggttaatagtgtaaacactgcagtgtatatgttcagtttaaatccctgtgtgccaagacaaaatgaatctgtgtatgtgttgaattttgtctaagcaactacaaaggagaggttcaaataagtataatgatgttgagtatccaaaaactggattggactagtgagctattcttctctagtctccagtatattggcttttttgggatagtaatgaagccgtgaaaacttttgctatgatccattgctaagcatggtagctcatttggtaaaacaaagaagtattaattttttttagagcaaacatggaatagtgtttctcaggaaaaagttgattactgtaagttgctaaagtcagagaagagaacaaatgtgcatttctcaaagcaaaaacaggttgcaagtcacattacttctgacacccttgtaaaatcagccacaaagataatggtaaaatattgtgtttagagagtaaataaattgacgtgtttcagcatcagaatattagcagtcagcgtggaatattggtagatgtttcactttacatttggaagaaactgataccagatgaaatctcttggcacacgtgaggcaatacatagtgtttgctaattgtattttccttagtagtggaaactcacgctacagcagaagtgatttttcatgtagttaattattttgagtgtaaaagatacattgagattgatactgatagatcactagtgtttatactgcaagggatgatgttgcacatgaaaagctagttgaaacaatgccagtctacacattacttcactcccataaaacctttgggtagcaaatagtatgctttcttattttgagtcagtgctgaagaaaatagtaacattctgaatgctgtcagattatgtccactgactatgcatctttgcagcataccttttgaaaaaatgagtgtgttggttcatggtggctctttgacattgaagtattctgactggtaaggagaaaaagactcactcaaatgactagatcatcttggggttagaacaccctaccctcttgaacagggtaggctgttctaactttctattttatttggaaaattttaaaatatctggaaaagttgaaggaataattgtgcagtgaacatagtatacccttcacctacatatgctgttaacattttctcacattggctttatcttaatatacatatacttttttaatggaatcagttgaaagtatgctacagacataatacattacctctgatcacattatctttttcttcatgatagtgataatgaagattttctaaaatattgagtgtcttaagtagaacatctcagcaaagtaggcagtatcttgaacagtttgagcctttcacttaatggcctaagcattacgatttttttattgctaaggatgagaattttttttttttttggatacagagtctcaggctggagttcattggcacaatctcagctcactgcagcctcagcctccccagtagctggaattacaggaacacgccactgcacctggctaattttttctatttttagtagtgatggggtttcaccatgttggcaaggctggtctcaaactcctggcctcaagtgatctgcccgcctcagcctcccaaaatgctgggattacagacccaagccactgctccgggcaagaaaattttttaaaaagatacgactgtatgaatggctgattgatacatatgtcatgtattcatgtaatgaatatttcattacatgaaaatgatgtattcattcatcattcatgtaaaatggccgaatcagtgtttctcataacatttgattatttgcttattgaagaaataaattgatttttattttattttatttatttattttttgagacagagtttcgctcttcttacccaggacggagtacagtgccatgatctcggctcactgcacccttcgccttccaggttcaaccgattctcctgccccaacgtcccaagtagctgggattacaggcgtgcaccaccatgcctggctaccttttgtatttttagtagagacagggtttcaccatgtttgttggtcaggctggtctcgaactcctgacctcaggtgatccacctgcctcggcctcccaaagtgctgggattacaggcataagccactgcgcctggtggagaaagaactttattttaaaaattgactaattaaataaattttaatgctttaataaaacctgaagatatttttttccagagccaactggaaccaaaaattgggtcaaaaatccttttgctgttctgaagttttagcattcaacctcccacttcttattggggtatgctcttattgtagcatttgatggaaacattaaaaacagtcttcagtgagaaatggtttcataatttaagagctttgtttgatctgaatatttacatctatttttcagacatgaaatacctaactattcttgatgactcacatttagaaattagagattttctgttttattagaaaaagaacaagggcagtaaccttactgagtctgaaatttcacacaatttggttttgtttttttaaaaatactaaacttgtaaagttttctgaaatttttgaactcttgtgtgtcaaatgcctttgtatctgtgagtagtatgatcatgagaaacaatattggtctaggcaattaattaaatctgccacataaagctgggtatggaggatgattcagaattcacagtctagcaggggcgaacatcaagttactataaaatagagatgatagtcataattttcttgtaggctataagaggcattaacatgttaagtaattgtaagtgcttgataaatgtttacagttattctggtgttttatactgtaaactcagaactgtatgagagacatatgtgtagtgataatttagatgaaaaggtaattttgtactggggttgtcaagcagagtatattgaagctcttctttaggtaggacatacaagcacatggagattgggagaatagcattcaaggaagaaatgcagcctttggcagacccacagaaataagcaagtatatggtatttttgaggagtaaaaatccagtgtgactagactgtatgagctatgtcaaagtactgtgtaatctgtaaaggagacagcatactatagtggaaagatagaaggcttagaagtgggcataatattccagaaatggatataattttagttttgcctcattttagctatgtagtctttgatggattatttaactttttatttcctttttttctcattggtaaatgagatagtgagtgttaatgctttgttgtgtgggagatgtgaagaatttagaatagtgctggtacatgaaagaaatgcagtatgtccccgcctttgctgtacctcctttattctcttccttgttagtagctttacttatataatgatttttagaagacaatttttgtacaattaatttttttgtagaactggaaagtattaaaggttacttatgataagaaaatactaatagctgagtgtggtggctcacacctgtaatcccagcactttaggaggctgaggtgggtggatcacttgagcccaggagttcaggaccagcctgagcaacatggcaaaccccatctctacaaaaaaaaaaaatacaaaaattagcccagtatggtggtgagcgcctgtggtcccagctacttgagaggctgaggtgggaggattgcttgagcctgggaggcagagattgcagtgaacagagttcttactactgcctgggtgacagagtgaggccctgtctcaaaaaaaaaaaaaaaaaaagaaaaaagaaaaaatactagttacagtgttttttttaaaatggacttaatttcatgtatccttttattgacacctctcttcttttttgtgcttagcatgggttctgatacattatagaaattaacatttattgactttgtgcagtttgaaatgtgaaaaatctcaaagtgcccccttaattgtgctggcagttaaattaatggatggattcaatataggcagtcacctcaatttatgagtgaaccctatttaaatatgaaataatgtggaattatttttttctttttaaaataaatgactcataatttgtggtaataatagctatttagatgtttttatctaatgtgactccttcctttgattaaatctttttttttcattttttgcaaatgattctgttaatacaaactacttgggaaaaattatgtttagtgtgagaggaagaaataaagctcttgggtaaaatataactaggctgctcagacttcattgacttgcctgggttggggctaatgagtagtccatttcaccttaagtccaattttaagagatattaaaattcatgaaaaagaaaccacattttaaaaaaggtctgaaattatcagaaagaaaggattttattcttataagagcaccttgaacaaaatagacatttcttttcaataatatggattgtttgcctcttgtctatgaagtgctaactgcaaataacacattaatgaacacagtttctcaaggtcactggaacaacttgcaaaggtatttagggacactatatttcaagagatgagaagttttcctatagcacgcaaaaaactatttaaattacttaaaaatttaccgtgaggtctggtgaaaggtgaaatgtgaaaaattttactgtgaactctaggttagttaaaaaattatggttactgttcactttctttttccttttttttattttttgagacggagtcttgctctgttgcccaggctggagtgcagtggcacgatctcagctcactgcaagctctgcttcccaggttcatgccatcctcctgcctcagcctcctgagtagctgagactacaggcacccaccaccacgcccggctaatttttttgtatttttagtagagatggggtttcaccatgttagccaggatggtcttgatctcctgacctcatgatccgcctgcctcggcctcccaaagtgctgggattacaggcatgagcctccacgtccagtctgtttgctttctttggcttcttttattataaaaactacaataaaaaatcagatacaaattattaattgctttaggaaggggaaaaaaccttacacagatgtaactttcttatttggagactcaattattttatctacttgatggttatctctgttttgtacctttccatgctattggttgcatgtagtgtgcttcttttgttgttttgggggtgaagttagattactttttgtcttgataaacaatttcgtagattcacagaatgtcagagctgaggtaactgtagtggttttctagttccgcattgtaattttatggcccaggaaattgattcctagagaatttcagtgaaataactaggtaatgacaactgtacaagaacataagtcttctgacttccagtacagctgatatttctattgtagcatgacatctttctttacaaagagtttatttggagatcatgatttgatgcagtgaaattcttcctgtccagattacttcttaggattctcctttgttgtcctctctccttagagtccttgtatcaccaaatcctactttgttagtaaaactgttttccttgctctagaatatctgccacatctgtcccaccttcttgtatcttactcatatttcattgtgtaactcttatttcttctttgaagccttccatatctgctccagttcaaacctgtcctttctaatttttgaaatatttgtagtttatattaaatattttactctcattatgtattcaagttttatcactaatttttttctagtatgcatgttttcttctcaagttctgttaagtgtgcatttaaattattaagaaaaatcttgttaggattgttggtgataggctactgatggagtgtagacactcttgtgataatattggttgacaatgatgccatatagttagacctagatatttgtttattaattcattcaaaaatatgtagcagatactgctgtagtttgaattatggttctttccaaaattcatgttgaaatttaatttccattgtggtgatattaataggtaggatctttttgagaaatgaataagtcatgagggctgtgctctcatgaatgggttagtgccttatgaaagggcaggagggtattagcttaggcccttttttgccattctgacatgtgatgacatagcaagagggccctcaccagatataaaatctgctggcactttgatcttggatttctcagactccagaaaagtgagaagtaaatttatactatcttcattacctagtctcaggtattttgttatagcagcacaaataaaccatatcagatacctagaataagcctggccctatgctaggtgctgggtggattgcagaagcgaatagggggtggtaagtacagggtgctagagtagcacaaaagaagattatttaatttagaaagctatttgtggctgggcatggtagctcacgcctgtaatcctagcactttgggaggtccaggcaggtggatcacctgaggtcaggagtttgagaccagcctgactaacatggtgaaaccctgcctctgctaaaaatacaaaaattagctgggcgtggtggcgctcacctgtaatcccagctactcaggaggctgaggcaggagaatcgcttgaactcgggaggtggaggttgcagcgagctgagattgcgccaccgcactccagcctgggcaacagagcaagactgtctcaaaaaaaaaaaaaaaaaaaaaaaagaaaaagaaaaaagaaaaaaaagaaaaagaaagctatttgggagtgtcttctaagctgagaagtgaagatgagttgaaggtgggcttcgtggatgaaagtaaatttccttgacaaaagaaacaatacatttaagtgtgagatggaatagggtattccattttcaaggaattaaagatcagggtgactgaattattgggtacaagattgagaaccacctagggatcttgttaaagtgcacactctgattcaaaattcagtctgctagggctaccataacaaaataccacagacttagtagcttaaacatcagatttatcttctcacagttttggacgattagaagtccaagatcaagatactgtcagggttggtttctggtgatgcccctcttctggcttgtagaggaccactgtctccttgttttctcacttggtctttcctttgtattggagggttggggagggcaatggtgggctgatgtctcttcctcttttgtaaggatactagtcctatctcattagggtgttacccttaggacctcatttaaccctatttaccacccccacaaaggcactattgccagacacattgggtgttagggtttcaatatatgaatttcgagggaactttttattcagttcctagtaagtagatgtggggtggagcttgagatactacatatctcacaagctcccaggttacactgttgctgctggtctaagaaacacactttgagtatcaagaagtagtcaactattcctgatcatctacccatagctgcttaatgattcacttttgaagatgggagtgagtctgagttctcagttcttagagcttgaaaaaggttgagaacacaagcgcgaatggttataaatgatcacttctgaataaatgaagcttgtttgaaaagctaaagtaaaattatcttcaaataaatgagtttcatttttagctgtctgaaaatagttattaaagaagataaaataaatttgaaatttgtacatcttactgcttctttctatagtcgtaaaagtactaattttaagtagtattcccagacttgattaggaagtagtctgaaaatcactagcctagaggacttgtctatgatgaatttgttgtgccagaagtgtcttttattgtcggtttttttagtctcaaaaatggtaatgggtatttggatattttgcttttgtgtaaatggtgggataagatgtataaagagattttattgcctgaagccttaatatttgtagtttggggcttggggtaaaaagctaaccagggctgattgtgattagctgtttagaatgctcatacgttctgtttttatttatttatataagtcctgtgactaaacatggcatgtaaatatactgtttttaaaaatgatcattcttaatctaatttcttattatgttactttctttagagaccaagaagcgtcagtgtaaagttctttttgagtacattccacaaaatgaggatgaactggagctgaaagtgggagatattattgatattaatgaagaggtaaggaaaaaatgtgttacaggtaaaacagtaatggtaattgatgctatggattttagaaaaattaattgtaagaatattagtcttttgtgagaactgttgtcactttttaaaaaaaatggtatagagtttctttactcatccttgctgtatttatatatgtatttgtatttcctgcctttaggaataaaaatgcccccttaaagctaaaaattaatgaaatctaagtagttaagaacgtaaacaagccttttctttgattctgaatttaccataggcaaaaagcagtgaaatagaaggaattttgccttagaaggaatacaaagcaaaatctttttaaacgctttgccttgtttgaattatcacattcaaatattaataaaaatactttcctatattttgatatcttagaatgggattttaaaatattttaaaaatagatcatggacaggaggcaggactagactgcagctcccactgggatagacagagcagcatgtggaggctcacattgtgaacttttgctccagaacgactgcaggaatatgttaggaaagccgagagaacccacagaccctctgaaggaagcaaactgctccagtaggacctgggagacaccccaaatgctcagtcacagcaagatccacccaaggagagtctgagatcagaaatgcctagccccgcccgcacctaatggtcctttcctacccaccctagtaactgatgacaaagggcatatactcttgggagctctaaggccccgcctatcacctgttcctccccatactacatagctgatgctctcttgaaagtgccatctcccagcaggagaccaaccagcacaaaaatagtgcattaaacagccagagctaaggaccttcacagagttcatttcaataccccgcccgctggtcccaaccaccacttccaccagagcaggtgctggtatccacggctaagagacccacggatggttcacatcacgggactctgtgcagacaacccccagtaccagcccggagcctggtagacttgctctgtggcagaagagagataatctctacagttcaactctcaggaagccacatccctaggaaaagagggagagtactacgtaaaggagcaccccatgggacaaaaagaaactgaacagccttgagccctacacttccctctgacagagcctacccaaatgagaaggaatcagaaaaccaactctggtaatatgacaaaacaaggttctttaccattccccaaaaatcacactagctcaccagcaaggtatccaaaccaagaagaaatccctgatttacctgaaaaagaattcagaaggtaagttatttagctaatcagggaggcatcagagaaagatgaagcccagtttaaggaaatcaaaaaaatgatacaagaagtgaagggagaaatattcaatgaaatagataccataaataaaaaataatcaaaacttcaggaaacaatggatgcacttacagaaatgcaaaatgctgtgggaagtttcagcaatagaattgaacaagcagaagaaataacttcagagcttaaagacaaggtttttgaattaacccaatccaacaaagacaaagaataagaaaatatgaaccaagcccccaagaagtctgggattatgttaaacgaccaaacgtaagaatagttggccttcttgaggaagaagagaaatctaaaagtttaaaaaaaaaattgggggaataatcagaaaaacttacccagccttgctacagacctagacatccaaatataagaagtttaagaacacttgggaaatttatcacaaaaagattattgcctgggcacattgtcatcacgttataattggctttcctgaggaagaagagaaatctaaaagtttaaaaaacatatttgggggaataatcagaaaaacttccccggccttgccagagacctagacatccaaatataggaagttcaaaggacacctgggaaatttatcacaaaaagattatcacctgggcacattgtcatcaggttatctaaagttaagatgaaggaaagaatcttaagagctgtgaggcagaagtaccaggtaacctataaaggacagtctatcaaattaacagcagatttctcagcagaaaccatacaagctagaagggattttctatcttgagcctcctcaacaaaacaattatcagccaagaattttgtatccagcaaaacttagcttcataaatgaaggaaacatacagtctttttcagacaaacaaatgctgagagaattcactactacgaagccagtactgcaagaactgctaaaaggagctctaaatcttgaagcaaatcctagaaacacatcaaaacagaacctctttgaagcataaatctcacaggacctataaaacaaaaatagaagttaaaaaacaaagacaaaaaacaaaaaaactcaggtatataggcaacaaataccatgatgaatggaatggtgtctcacatgtcaatactaatgttgagtgtaaatggcctaaatgctccatttgacatatacagaattgcagaatggacaggaattcaccaaccctctgctgccttcaagagactcacttaacacataaggaatcataaacttaaagatgtagaaaaagacatttcatgcaaatggacagcaggagtagctatgcttatatcagacaaaacaaactttaaatcaacagcagtttaaaaagacaaagagggacattacataatgttaaaaggccttgtccaacaagaaagtatcacaattctatatatatatatgcacctaacactggagctctttagtttataagacaattagtaataggcctaagaaatgagatagtaagacaataatagtgggggacttcaatactccactgacagcattagacaggtcatcaagacaaagtcaacaaagaaacagtgaatttaaactataccctggaacaaatggagttaacaaatacttatacaacattctacacaaccaccacagaatatacattctattcaacagtgcatgttctttctccaagatagaccatatgataggccacaaagtgaacctcagtaaatttaagaaaattgaaattatatcaagcactctctcacaccacagcgaaataaaactggaaatcaactccaaaaggagccttgaaaaccatgcaaatacatggaaattaaataacttactcctgaatgatcactgggtcagaaatgaaatcaagatggaaattaaaaaattcttcttactgaacgacgatagtgacacacctttcaaaacctctgggatagcaaaggcagtgctaagaggaaagttaataacctaacttttaacttaaaagtcaacttaagagttaaaagttgatgcctacatcaaagactgtgaaagagcacagaccatttaagggcacctcaagaaacgagaaaaagaagaacaaaccaaacccaaactcggcagaagaaaggaaataaccaagatcagagcagaactaagtgaaattggaacaaacagaaaatacaaaagataaatgaaacaaaaaactggttctttgaaaagataaataagattgatagaccattaacaaggttaaccaagaaaagaagagagaaaatccaaataagctcagttagaaacaaagcaggagatattacagttgacaccacagaaatacaaaaggtcattcaaggctactgtgaacttttttctgcacataaactagaaaacctagaggagatggctgaattcctgtaaagatacaatcctccttgattaaatcaggaagaattacatatgctgaacagaacaataacaggcagcgaggttgaagtggtaattaaaaaattaccaacaacaacaaaaaagatccaggaccagacgaattcacaccagaattctaccagacattcaaataattggtaccaatcctgttgacactgtttcacaagatagagagagggaaccctccctaaatcattctgtgaagctagtatcatcctaataccaagaccaggaaaggacataacaaaaaaagaaaactacagaccaatattcctgatgaatatagatgctaaaatcctaaacaaagtactagctaactgaatccaacaacatatcaaaaagataatacaccacgatcaagtgggtttcatatcagggatgcagggatagtttaacatacgcaagtcagtaaatatgatatgtcacataaacagaattaaaaacaaaaatcacatgatcatctcaatagatgcagaaaaaacattagacaaaatccagcatcactttatgattaaaactctcagcaaaattggcatataagggacatacatcagtgtaataaaagccgtctatgcaaaaccacagccaacataatactgaatggggaaaaattgaaagcattccctctgagaactggaacaagacaaggatgcctgctctcaccactcctcttcaacatagtactggaagtcctagccagagcaattagacaagagaaagaaataaagggcatccaacttggtaaagaggaagtcacactgtcactgtttgctgatgatatgatcgtttaccttgaaatccctaaagactccttcagaaagctcctagaactgagaaaagaattcagcaaagtttccgggtacacaattaatgtacacaaatcagtagctcttttatataccaacagcagtcatgtggagaatcaaatcaagaactcaacgccttttacaatagctgcaaaaaaaaaaaaaaaaaaaataagatgcttaggaatatacctaaccaaggagtcaaaagacctcaacaagaaaaactacaaaaacctgctgaaagaaatagacgacaaaaacaaatggaaacacatctcatggtcacggatgggtagaatcagtattgtgaaaatgaccatactgctaaaagcaatctacagattcaacagaattcctatacataccaccatcattcttcacagaattagaaaaaacaattctaaaattcatatggaaccaaaaagagcctgcatagccaaagcaggactaagcaaaaagaacaaatctggagacctcacattacctgatttcaaattatactataaggccacagtcaccaaaacagcatggtactggtataaaaataggcatattgaccaatggaacagaatagagaacccagaaataaacccaaatacttacagctaactgatcttcgacaaagcaaacaaaaacaaaaagtggggaaaggacatccttttcaacaaatggcactggaataattggctagccacatgcaggagaatgaaactggatcctcatctctcaccttatacaaaaatcaaatcaagatggatcaaggacttaaatctaagacctgaaactgtaacagttcttgaagataacattggaaaaacccttctagacattgactttggcaaggattttgtgaccaagaacccaaaagcaaatgcactaaaaacagataaatagctatgacctaattaaactaaagagcttttgtatggcaaaagaaacagtcagcagagtaaacagaccacagagtgggagaaaatcttcacaatctatacatctgacaaaggactactatccagaatctacaatgaactccaacaaattagcaagaaaaaaacaatcccatcaaaaagtgggctaaagacctaatagacagttctcaaaagaagatatgcaatggccaacaaacatgaagacatgttcaacatcaccaattatcagggaaatgcaaatcaaaaccacaatgtgataccaccttactcctgcaagaatgaccattaaaaaaaaaatagatgtttgtgtgaatgtggtgaacagggaacagttctatacttctggtgggaatgtaaactagtacagccactatggaaaacagtgtggagattcatttgagaactaaaagtagaactatcacttgatccagcaatcccactacaatcccagaggaaaagaactcattatatgaaaaagatagttgcacacacatgtttatagcagcacagttcacaattgcaaaaatgtggaaccaaccttaatgcccatcagtcaatgagtggataaagaaaccgtggtatgtatatatgtgctggaatactactcagccataaaaaggaatgatttcatggcattcgcagctacctggatgagattggagactattattttaagtgaagtaactcaggaatgaaaaaccaaacatcatatgttctcacttgtaagtgggagctaagctatgaggatgcaaaggcataagaatgacacaatggactttggggcctcgggggaagagggtgggaaggggatgagggataaaagactacaaattgggtgcagtgtatactcctcaggtgatgggtgcaccagaatctcacaaatcaccactaaagaacttacttatgtaacctaacaccaccggttccccaataacctatggaaataaaaaaaagaaaaaaaaatttaaaataattttttacatctctgcttttatcatttgaaggagtattaaagtttaatttcacagttgaaggtcatgttttcaacatgtatgttttgataccatgtattatagcacagattgattttgtgtcaaaacaccctgtaatgtaatttatcactagtgtttttatgtttatacaaacttagattgtgtttatacaaaggctgttctattttattttcacttggttgcagtaataatagttaacatttcttgagcttatgttatggttgaagcattgtgctgagagtttcacatttattatatccttgaaagttttaaaaaacctaagaagataggtatttttatccccattgtacataggaagagactaaatcaaggaagataagtggtggctgttttagttactgttgttgcataccaagccatcccaaacttggtggcaaagaataacggttgtattatgcctgtgagtcaagaattcagatggggtatagcccaaatggcttgtgtggggcccttagctggaaagattcaatggtggggtgtcctggaataataggaaggttttttcactcacatatctggtgcctagaaaccttgaagactgtaactgccaattggagagccattatgttagcctttccatttgggttgactctcttacagtgtaggcatctcaaggtcgtcggacttactatatggcagttcacggctcttaagtgcaagcatttcagcacatattagctttattgccctttacaaactagcatctgttggttacaagtgagtcgtaagccatcaagatttaaggggtagggaacagagaccaccacttcttggtgggaggagtgtcaaggtcacaattgtaggatgagagatcttcttacagccatctaagtctgaatttcagtccttgcagtctgttttttttaaattttttaatttttttatttcaataggtgtttggggaacaggtggtgtttggttagatgaatacattctttagtggtgattcctgagattttggtgcacccatcacctgagcagtgcacactgtacctaatgtgtagtcttttatcccttgccacccccattctttccccccaagtccccaaagtccaatgtatcattcttaagcctttgcttcctcatagcttagctcccacatatgagtgagaacatacgatgattggttttccattcttgagttacttcacttagaataatagcctccagttccatccatgttgctgcaaatgccattattttgttcctttttatggctgagtagtattccatgatgtgtgtgtatatatacacaccacatatttttaaattcacttgttgattgatgggcatttgggcgggttctatatttttgcaattgcagattgtcatgcagtctatttttgtgtatttttttaccactgtactactctgcctcctaaacctaactcctcagttgttgccagttggggttccaggtataggtaatagacagctgatgtttctctccgtttgttgtatttattctagtttggtctacatctagtttggatcacttccagttctttggtgcttctttaagtctgataaaaattctggtcacttcatgctttactgccttccctttctcccccaaacagcttgtattctagcacccatttttattttagctataccttccatgaataaatcatttatttttaagttactatagttttacttttattcagcctttaatatcacattgtttttgtcatttccttttgggggggagcattttttttttattctttcaagccctttctgtttgctcctaacagcattttgttcatatgttagttatagtacctcttaaattgtattgtagccatctgcttattgattttttctttaagtgttttattgaagaacagggatttctcatatgcaagtttgaatctttccctagtagttaacactgtgactaacacatattggctgttagatgactaacttagtaaaaggttgcctaccttttatgagatggaaaacaattaaaaatattttaaacaagaaataaatctttttctagctatattgtgtgtagtgctgctaagtaaaatttgacagtgaatagtttactcttttttaaattttgtttttttttttttgagctggagtctcactatgttgcccaggatggagagcagtggcgccatctcagctcactgcaacctccgcttcccaggttcaactgattctcctgcctcagcttcccagctagatgggactacaggtgtgcaccaccacacctagtgaattttttttttttttttttttttttgtatttttagtagaggtgggatttcactatgttggccaggctggtctcaaactcctgacctcaggtgatctgcctgccttggccttccaaagcgctgggattataggcaagagccagtgaacctggcctaaaaaattgtttttaacctgtgagcactccttaatatccatatcagaaactatacatttttaaagttattaaatattaaaaatttcatagaaattgagtaatcttattggtaagtgtaaatgtttttctgaagtgtttgattcatgaggatatatctgtttggaggaaggtgtttagtggagcttgacatctgggtttttaaaagtaggaaattattatacttaagctaagaatcactgctcaagtaataggtttagcaattttctgtgccatttaggaagttatgtttattttcttttttctttttttgagacagggtctcctctgtcacctgggctggagtccagtgccacaattgggctcagcctccccagtagctgggactacaggcgcgaaccaccatgcccagctaactttcgtattttttttagagatgggatttcaccacgttgcccaggctgatctcaaactcctggtcaagcagtctgcctaccttgggctctcaaagtgctgggattacagacctgagccaccgtgcctggccaggaagttatattcttagaatcatcaaatttttttcaaataaaaaatttccaaatactttaaataatatacaaatcaagccttagtagtgtttacaagagtgacattccagaagctatgtacttcttgctgttaatacagtatatatggttatctgatactttcatgaaaagtacttcatagattgcgattgattacaaattgtcattgtaaatgtgcgaagtactgttgatgtatgattaatcccatatatgagtaatacactaaaatttaatccacttaaaatatattttcttcattgtgttttaaattttaaagggtttatttcatagtgctaattttgtgcctgtttgcttttgcagcttaattttcccatagggtgacgattttcacttaacagaagttgtttttgcttttgaattgtgaactttttcaggtagaagaaggctggtggagtggaaccctgaataacaagttgggactgtttccctcaaattttgtgaaagaattagaggtaacagatgatggtgaaactcatgaagcccaggacgattcaggtagactattttttaaaatttttaattgatttaaataaactttatatagcatctagtgttttattttgtattttttgaaactctgttctttcttttgaactttgagtcagcttcaattagtctactttaaaaaagcaaattatgatggggacctaactgaattaaatatctagtccaataatttaatatttttctttctctgatttctgctttaaccttaggtaaatctttagtaccctgagtttaaaatgattcatcttaggttatctgatttcttcctagtaaagatatatttatatgcatttttggtctgctgagtttgcaaatggcctgtttaatacttcagaaattttagaaataagaaacaaccttacttttgttattttctgtattcacataatagattttgtttattctgggcagccaaatgtcatttagttattttgtgatgttagttatttagagactcacccacaaattcttcttaatttgctcaccatttaagagtatgattgacaaaattttaccccaaagctagatttaaattttgttacttttaagaattgctgttggaattaggagagttttttttgttttccaaaagaggtcttgaatttacaagtggaaatgtagggataagaatatgtttttctcgatggaaatgtatatgtagtgagaattttcggggatttgcattagctaatattatttggcaattttatgattagttggatttataggtattaggagtagatcataaccttaaggttgccagtatcattggtttttgtttttagaaccggcttaatgcaaatatatgaaaactaaatattaaaaataatgagatgaagttgtaagattgctcagactgcttatgtactgaatacttgtcattgtgtcccaatgctacacttatatgttttaatctatctttacatacaagatcatactaaggtgttagtcttccgtgatggcagaaaactgtgccttggttgtctttgcttaactgtagtttttttgtttgcaaaacaggaataattttttttttaacgtgaaagggctgtttcgtgcattgacagtttctaagcataatgtttgcagcgtcataggttgttgtgagctattagttttttttttcttgctttcttttatcagtactttcagtgtcttacatatggaagagtaaaaattttgaaattaagtaggaaaacataaagttggtatagcaaatgggtttataaacctcagtgcactcagtggtaaaagaatgcaatttttttttccttttcttttttttttttttttaattatactttaagttctgggatacatgtactgaacgtgcaggtttgttacataggtatacatgtgccatggtggtttgcacctatcaacccgtcatctacattaggtatttctcctaatgctatccttccccttgcgcccccctcacccccctccccctgataggccccggtgtgtgatgttcccctccctgtgcccatatgttcttactgttcacctcccatttatgaatgagaacatgtagtgtttgcttttctgttcatgagaatgatggtttccagcttcattcatgaccctccaaaggacatgaactcattctttttttttttaattttgttttttgagacaaagtttaactcttgttgcccagactaggagcgattctcctgcctcagcctcccaagcagttgggattacaggcatgtgccaccacgcccagctaattttttgtatttttagtagagatggggtttctccatgttggtcaagctggtcttgaacccccgacctcaggtgatccacacgcctcggcctcccaaagtgctgagattacaggcgggagccactgtgcccagctgaactcattcttttttatggctgcatagtattccatggtgtatatgtgccacattttctttatccaatctaacatcgattggcatttgggtgggttccaagtctttgctgttgttaaatagtgctgcattaaacatatgtgtgtgtgtgtctttatagtagaattatttataatcctttgggtgtatacccagtaataggattgctgggtcaaatggtatttctagttctagatccttgaggaattgccacattgtcttccacaatggttgaactaatttacactcccgtgaacagtgtacaggtgttcccatttctccacatcctctccagcatctgttgtttcctgactttttaatgatcgccattctaactggcatgagatggtagctcatcgtgattttgatttgcatttctctgatggccagtgatggtgagctttttttcataggtttgttggccgcataaatgtcgtcttttgaaaagtgtctgttcatagcctttgcccaccttttgatggagttttttttttttttcttgtaaatatgtttaagttctttgtagattctggatattagctctttgtcagatggatagattgcaaaaattttctcccattctgtaggttgcctgttcactctgatgatagtttcttttgctgtgccgaagctctttagtttaattagatcccatttgtcaattttggcttttgttgccattgcttttggtgttttagtcatgaagtctttgcccatgcctatgtcctgaatggtattgactaggttttcttcctagggtttttatggttttaggtcttacgtttaaatctgtaatccatcttgagttaatttttgtataaggtataaggaaggggtccagtttcagttttctgtatacagctagccagtttttccaacaacatttattaaatagggaatcctttccccattgctggtttttgtcaggtttgtcaaagatcaggtggttgtagatgtgtggtgttatttctgaggcctctgttctgttccattggtctatatatcttttttggtaccagaccatgctgttttggttactgtagccttgtagtatagtttgaagtcaggtagcatgatgcctccagctttgttctttttgcttaggattgtcttggcaatgtgggctcttttttggttccatatgaaacataaagtagtttttttctaattctgtgaagaaagtcagtggtagcttgatgggaatagcatcaaatctataaattactttgggcagtatggccattttcatgatattgattattcctatccattagcatggaatgtttttccatttgtttgggtcctctcttatttccttgagcagtggtttgtagttctccttgaagaggtccttcacatcccttgtaagttggattcctaggtattttattccttttgtagccattgtgaatgggagtttgctcatgatttggccctctgtttgtcttttattggtgtataggaatgcttgtgatttttgctcattgattttgtatcctgagactttgctgaagttgcttatcagcttaaggagattttgggctgagatgatggtgttttctaaatatacaatcatgtcatctgcaaacagagataattttacttcctctcttcctagctgaatgccctttctttctcttgcctgattgccctggccagaacttccaataccatgttgaataggagtgatgagagaggacatccttgtcttgtgccggttttcacagggaatgcttccaacttttgcccattcagtatgataatggctatgactttgtcataaatagctcttattatattgagatatgttccatcaatacctagtttgttgagttttttagcatgaagcagtgttgaattttatcgaaggccttttctgcatctattgagataattatgcagtttttgtcattgattctgtttatgtgatggattatgtttattgatttgcatatgttgaaccagccttgcatcccagggatgaagctgacttgattgtggtggataagctttttaatgtgctgctggatttggtttgccagtattttattgaggattttcgcattgatgttcatcagggatattggcctgaaattttcttttttttgttgtgtccgtgccaagttttggtatcaggatgatgctggcatcataaaatgagttacggaggagtcctttttttgttgttgtttggaatagtttcagaaggaatggtaccagctcctctttgtacctctggtagagttcggctatgaatccatctagagctgagcttttttttggttggtaggctattaattactgcctcaatttcaaaacttgttattggtctattcagggatttggcttcttcctgttttagtcttgggaaggtttatgtgtccaggaatttatccatttcttctatattttctagtttatttgcgtagaggtgtttatagtattctctgatggtagtttgtgtttctgtgggatcagtggtgatctcccctttatcattttttatccatgtctatttgattcttctctcttttctttattagtctggctaacggtctctctgtttcgtgcaattttttttttttttttttaacaggcagggtttcactttgttgccgagcctggtgtgcagtagcatgatcatagctcactacagcttaacctcctgagctcaagtgatccttctgcctcagcctgccaagtagctgggactgtaggtatgcatcatgatgcacagctaattaaaaacatttttttttaagagatggggcctcactatgttgaccagacaggttttggactcttggcttcaagcagttgaagcctcccaaagtgctgggattacagatgtgagccaccacatctggccaagaaaattaattttagagaaaaaagtcagataatattttaaaatttaatagatgattctattaaacataattgataaaagatttctagaaatcattaagattattactaaagttaatgtgctctgtttctcattccaccattttagactttattaagctccttgacacttttgtcttcatccataattatggtttgtttgtacatgaatgattcatgcagctttttcccacctaattcttgtatggagcctgcagaagagtcaggcttttgctgtggtagaaaagagcatgaagcaatagagcaagttcataaaaatctagatatagagctagaaagtcctagtacaaccccttcattttatagtagagaaacctaagtcatgatttacatattattttatatatttatttttgttagaaccaggacttctaagaatttgggcttttggatcccattcctctatacatttccatactattatattactcatctctgggtccatccttctaactccagtacagtgatttattttgaaacttttttttaacttggagaaaaattataaaaataaaacaaagacctctcttagatcctttaccctgatttacgaatttttaacatttcaccccatttgctaacttatcattcaccttctatctagatatctgtattttatctttattctttagtatttcaatgtgtatttcccaagaataaagttagtctcttatgtaactacagtacagttatcaaaatcaagacatttaatattgataatattgtttattctgtaatctccatacaccttttttttattattccagcatgttctttatagctgtttttttcctcccagtcctgaaaaggattatacatggaatttatttccagtgtttcttaaatctgtaatagtcttctagcctttttctgttttttgttttcttgacattgacatttttgaagagtttaggctgattattttgtggaatggccccatttgtttgtttgtttgtctttttcccccgattcctcatgattagattcagattatattttattggcaggactatggagtgacgatgtcttatgtaatatttggaggcacatggtgtccatgtctttttttattggggatgttaaatttgattaaaatttaatcataaatttagttacagctgtgctgccactgtacttttactgtttttcttcttacaataagtgtttcatggagagatactttgagactatgtaaatatgctattcctcatcagactttcactcaacagttttagcatcatggataaattttactcaaatagttgttactatgatggttaccaaaaatggtgattttctaataccatcatcccttctatgtgtattacttaatattttactctaaagacaaacttttgtctttctccggtttatgtatttatcagtgtgggctcatcagagggttctgttttattcatcaggtatcagtctattaccagtattatttattttgataactgtatgatttggctagtgagagttccttcaaggtaacttctgtgactttttaaaaaagtcaactttattggaggtacaatttacatacagtaattgtgtccctttaaaatatacaatctgatgagtttgacagatgtataaatccatgaaaacatgtacagaacatttccatcacccccaaaatattgctcatgctttttgcagtccatttctttttctgcccttagtcctaggcaatcatagatctggtttgtcattatggattagtttgcagtattatgtcattttgacatgtctccattattttctgtgaacttccttactctgtgatataagatattccaagctcattttgaaccttccctaccctagtcttggaatcagctacctatcaaggcaaactttttttttttttaagagaggaatagtgtttgggcatcaagatctgggtagaggtgtggtcattgctactggggtaatgcttctgagcctgcttagtggattaagctgggaaatgcttacatgcacatacaatcccatacctctacccatatgtcttgatcattcatctatttatccatctttactagtacctctaattccaatttaataccagaaggtatattttcatctctaatgattttatttctaagcccattgaccatagaaatgtgtgaaatgagtaattgagtttgctttacatttatttatttatttatgtatttattgagacggagtctcgctctgtcacacaggctggagtgcagtggcgcgatcttggctcactgcaacctccgcctcccgggttcacgtcattctcctgcgtcaacctcccaagtaggcgcccaccaccacacccagctaatttttttgtatttttagtagttacagggtttcaccgtgttagccaagatggtctcaatgacctcgtgatccgcccacctcggcctcttaaagtactgggattacaggcgtgagccactgcacccggctgagtttgctttacttttaaggaaatttaatttttcttccaagttttagttatctaaacatcgcaagctacaattgtgttgccttgttcgtttgctttttagtataaaagccatctaatattaggcttgaaaggatgaatgcttagaaagcaatattataattcgtggtttatcaataaactatgagtatagaaaaaccaacatgaatttagtgtctaaaagattgatgtaaaagacacctcttggaattttagaaagtgacaggaaaaaatgttactttacatagtcataaaataccagtaattgttctacaaagtagacagtatatatcagatctaatgatgagagctaggaataatgagattgtgaggaaaaattgctggtataataccagacttttgggtcagagttttcagttaattatagtaataatttttaagttataaagtgaagacataaattagtttgatggctctttgccttccaccaacaagtcttgcataagcaaaagcttggatgtgttgaagatttggcttcacctgaacccactgctgtggtagaagagggtattgttgctggagatgtaatggatgttaatactgccactgctttatgggaggttccgaagaccaccctcatccacagtagcctagcagtgaaatttgtgaagctggccaagccttagacaagtggcaagctcatgtttgtgtgcttgcatccaactgtgatgagcctttgtatgtcaagttggtggaggcccttggtgctgaacaccaaatcaacctaatgaaggttgatgacaacaagcaactgtaggggaatgggtaggcctctgtaaaattgacagagagagaaaaccctataaagaaattggttgtggttgggtagtagttaaggactatggcaaagaatcttacgcccagtatgtcatcgaagagtccttcaaatgcaagaaatgaacaaataaaactttgtatcacatttaaaaatttagtttgaggaatagtttgaactctgctataatttttagaataaacgtgaccaaaggaagaagtggaagctattttaacaagtgaacatttcttaacccttgttctgattttcagttctgattttctgagcgtatgtaatccctatgtagtccagaggtgcaagtatcacatctctagggggaagacaaatgtgaagtaagtatgctaatagtataaaatgacttgcgttactttaggtaggtatagaaaatgttggaggaagatatttctaaatgtaatactttgtttgccactacattttgcttaatatgcaaattttcatctcagaaatgtcacaggaaacattagaaaatataatctgcaactttctaattcttgaagaggcagggaaaaagaaggatggcttttaaagcttctgtccaaaattgacatgtcatttccactaacattgtatttggtggttatggtcatgcatgcgtaagtgcagcagggtggggatatgtaattttcttacaaggaggggcaccaaacatttgtgtacagtattatgctctaccatatattcgttgtggattacctttaaagaatccctttctttaaagctcattagcctttcaaaggagttaatttactcttacattagtttttagctctctgtaagtgctacatactatacgtgctacaaagtaatgaaaaaagcgtgagctccctggctgtttaatgtgacttgggatgcccagttgcctctcatttttaagtgttcttccactatttcttttctctttaacttagcaataaacttgtaaaaattctaaatttttctaaggctctttaatgaattaaacaaaaatattaacaaaaatagttctagttgtttaatttagtttcaattgttttaatagtttcagttttctttaatggagatgctgattgtattgaaagatagaaaaatcattgaggtaggaatcagtggagaaggaatcataccaactagatgtactttcactattttatgttacatttatttgagagtactcgataacaattctgaagtcagaactgatgtttaagggtgtgtaaaaaccattagagaacatacataagtaccaaaaacacgtggcttaaatttaatggggcattcatctcttagcaaactgtctcctgagttacttttgatgcacattagtatttcttagggttcacaggtattggatcatttgatacctacttttaacattaaaatttggtgtaaattaaagcatatgagtgaaatgatctttgtgatgccatataaaactgagcctttaaaatatttacaacttaaagtttgtatgggaccaccagcacaagagatctaatttatatttgaatttagttcattacttttataattataaaatactttgcacattttcttatgctattcagcttgatttggattttagtaactgcgcagaattttatctgttagaaatacccttccttctttgtttaacccttttacaataactgttcattctaaatgtggagctttgtgattatggggtggaaagtcagtggttgaagtacactataatttttttttctttccccaactctaaattttaggcaagtttctgcatattgttgtgaatgccaggaagtgagcattatataaggagtaactacttaaaattttcctgtgtcctaacaaagtgtaacagcctctgtccataattggtgttttgacaatcttttcagtcagtaaaataattatgttcctcgtagctgttagaaaaattatagtagaatgtacattatataagtgttttcttttttgctttcattattggaatgtcatatccactatatttgattatatcatatagtttctcctcacagtcttttaaatttaatagtgttctcctcctcctccctttccctttttcctccatcctctcttatgtagtaatgggattatgttcttggtttgaccagttaaactctattacttgctaagtagataattctgactcttaataatatatggacaatgttgagtcttcacagataatttatttttagatcctcagttttcattgaagaactgtaggataaaagttttaagaatgccaccattatgttttctgtaggaatgtggtgaattaatcatctattctgttactgagtggtttctatataaaagtccaagataaatttcttttagtattcagtctcagggaaagcattgctttgctaggaaagtgttatgtttcggttttgtaatgtctcctttttaattttgtcaaatatacttaacccttcttatttagagggtctttttgttaacatgcagattccacttatttgctaaataggaatgtgttttcaaattttccccttattttatgaaaccagtgactgtatatacttgtcttttccacccttttctaaaagtcttccacattaaacctctttaagaatctccatttagatgtctaataggcatcttaaacctaagatgcccaaaattgatcctctgcctttttttcctgctccatgtaatcttccccatctgagttaaggagaaattcatccttcttttactcaggccaaaattcttagatttctcttgtactcttctttttaacctcgcaccctaccatgattcattaacagattttgtcaaaaaatgtttagaatctattttctttttaccaccttcactgccgctatcctggtataagttatcttttgctgtataattaccatagcctatatgccattacctacttactgaatagtctggtagccagtagtgatcaccctccagtagctttgcatttcacttagactaaaagccaaaatcttttaaaatggctacaaatccctctatgatctggcatccccatatccctccctccacctttcttacctcatctcttatttaactttcccctttgttcacattggtcaccttaggtttcttaaggatgttaggaacattcctctctcacagcctttgtgcttgttgtatacctttgtctggaatcctcttcttcaagatgtcctgatggctacttgtctgattcaggattctctcagaaatcaccttatcagtgaggcccttactgacagctctgtgtaaaacagcagaaagtccccattatccactttttaattctcttctcttttttttttaacgtttcaaagaagaatttgttgctattgcttattaagcttattgtctgtctacctgctcattagaatatatatatatatatatatatacacatacacatatatatatatgtatgtatgtatttgtttactcattgtctagaatggtctctgatatgttgatgctcagtgaaacagtgaatagttttttgtggtatatgtagaacttttcaaacacttttgtcaagtgaaatcctcttgagtttttgttgttgttgttgttttggtttttgctttaagttctgggatacatatgcagaacatgcaggtttgttacataggtataagtgtgccatggtggttcctgcacctatcgacccatcctctcaattctcccttcccccgctcctcacccctcaacaggtcctggtgtgtgtttccctacctgtgtccatgtattctcattgttcaactcccactaatgagtgagaacatgcagtgtttggttttctgttcctgtgttagtttgctgaggatgatggcttccagcgtcatccatgtccctgcagaggatatgatctcattcctttttatggctgcatagtattccatagtgtatatgtaccacattttctttatccagtctatcattgatgggcatttaggttggttccatgactgcgatattgtaaatagtgctgtaaatattgtaaacatatgcatgcatgtgtctttatagtagaataaatcctcttagcttttaagaagattaatgtcactcccattttaagggtcaagaagtggaaactcctgagattatttaactactgagtggtaaaatcattagagttttgtttttctgatttcccagtttttttttttttaactttactatgctgtttaacatatggggtatggaaatttggtggtttttcactattgtagtccatttgtttgctgctatcttcatctaattttcttttaggtatgcttatagaactatcttttcatgtacgttcagctctttgagggttgtgagtagtaatatgtgcgtatactagcatttctcatgaaggcagggtattccaaaatctgaaatttaaaagtcaaagccggcaaagggaaattctagatataaatacaattgtttagttaattcagcattcatatatttattcattcaatatattgagtgccttttgttaatgtattgtacaaagtcctgggaatacagtgatcagcaacataggcatgatttaccccccttgtttgaagcttttttttccattgggaaagaaaagatgatttaaaaaagtgattgtaatttagcaggagaaatatttgttacaggaaagggtgcaataaatgtatataagtgggctaatccagacttggcaagctgtgaaggaatgtgccctagaagaagtcatagattgagatcccaaaatggctaggaaatttctaagcaagtttgtggcagagggtgaggaaaagcatagcactgcaagatcctgaaagagatttaattcagaggcattatagagtatataattagatgtgaatgttgagcctggagaaattattgggtcagacataagaaaacattacaaaaatgttaatcaaatcacagagaagccatagagcaaaatcatgagattgtttttcagataaattggtggcagtatggagagtgaattgcaatgtggggagtagattggagaagagactgagctgctaacgccagttgagaatgttttgataatgaggtagaattagcctaaactagaggagtgctatggggatggagagacacgtgtagaataggatctatataagtgatagcacaaagaacaggacctagtgataatgttatttgggggatgaccgaaaaagaggagccaactgctaccaggtttttggctttgtaagatggagatgtcatttgcagagataggatattgggagatgatgatgtatcgttaaaatagatgcctagatattgaaaataggcagtactaattggtaggttaattatttttggatcattgaaaattaccaacttttactaccatgttggctattcacttttggagatattaaatttgaggcttgtagggatgtgagagcatccaaatgaagatatttggtagtcagttgtctatgggtctgaatccttagaaaaattcggatgtctgtgcaaaactggggcttgatagtactttaggtggtataagaaacgatgagtaggctgggcgcggtggcttatgcctgtaatcccagccctttgggaggctgaggtgggtggatcacaaggtcaggagttcgagaccagcctggcccacaagttgaaaccccgtctctactaaaaaatacaaaaaaaattagctgggcatggtggtgtgcacctgtaatcgcagctacttgggaggctgaggcaggagattcgcttgaacctgggaggcggaggttgcagggagctgagattgtgccattgcactccagcctgggtgacagagtgagactccgtctcaaataaataaataaataaggaaacgatggatttagattagatgacctagggagaatatacagagtgaagaaaaaaactaaagaccctgggatggaatcctgtgtagtgacatttaaggaatggactgaggaagattaactgaaaagaagaccaagaaagcacagaaggagagagccagaaagaaacctatgagagtgtggtagtcagtcaagggaggagagttattcagggaggcagggcaatagtgtcagatattacttgggaggttaagtaaaagagatcattaaggacctagacaagagcagttttgaggtgattagggcagaagccaaattaaagaagaaaggaggttaggcagtgtagagagtaagtataaggcagttgcagcatttgatgacaacatatattcaagatttgttttgttctttttcttaaaaaggaaaagtgttgatcatcttgacatactaatggctgacaagtaggagagcagttgaagatggaaactcagaagaatggtggttatcagcacaatagaatttatccagaaggtggaggaaatgcgtttcacattatggctattatgattagtctcaatttattggagatagatcagagttagtaggcttaatggtaggaagctgaggaagatatttctgacttttgatatcttctatagaaaaggagtaatgttacgaataagttgcaaagtggtgaggtcagaattttgaggagatgaagaggttccagcagggattcttaaatgtttgtgccatttatccctctaggctttaccgggcaactagatggatgcatcacacaaaacatttaagaaaccctgatggattgttcttcaagagttctagtctcttacaggtagaaaaagttcattttcttaggaggagtcagctgaagttttatttgattattcaggttctggaatagaagaaagtgctcattgctgatgagacacaggatcctggggaaatggttgtatacctcgtgtgccaaagatagtagatagaaatttgttagtctgcaggctagtcaccaggagtcaaggtattatacagtttaccttggggtctgtaatcatatattagtattcaccttatactcctcctggtgagcagctttgcaaggaaactttttctggagttttgatgcccttactggtagtacgttgtggatctttctaagttattgctaacagccagaccttctttctatgtgtactttttaggaactatgcaatattgattgattttaagtccagttaaaacacccgcacccacacctgcatgatcgacttacaaaatccttgagaataatggtgaaagatgactttaatggtgaacttggattgattctattaaatgctttttattttcatcagatttcttttttttttttaagctttcagtgcagttcacatgtggtttcttgtttccgtttttctccaaacaagtaattgcattttgcagttcttttaagtcactttatatgaagatacaagccatcaagtagcttttgctatagagatttaatgaagaaggaggagggagggtttaggctcgatagacagatttgctgtttgttttatgactgatagcaacatacataaaatgcagatgtttttcttcaagcatagcaattcaaggacaatcagatgggtaaagtatatgggtattaaagtgttagaagtaccatatagataaggttactgttttgtctcattatggcacctcctgcatgccctttttcctcctcctttttcctttctccttgctccttatcctctttcttctttccagtggctgttttcccttttatactttactgcttctttgtgatcagtgctctctctgtcacttaatggttctcagtgatacatcttttaaagttttaaaaaaataatagacactgagccaggcactgtttaaagcacttcacaggaataaattagtttacttctcatagcaatcctgtgaagttccccattttacaggcaaagagattgggcaaatataatggagggggcaagatatgaatcaagaaaattcgaccctagagttcatatactttaccgctataccatgctgccttgcaaccattgatttaatagcaaacgtggtagtaaaatttggtatttttcatttagccaaaaatagcctatccattagtactggacatttttgatatctagccatctattttaatgatatatattttaatgactctaataaaggttacagtcactaaatccaaacccccttccctgcctttttttttgttttatggccttaatcaaatactcaaactgtgaaaattgtactttagaataatctcttaaagttgtctttatcaatatatgatttattaataccatggatagtttcattttaaaaatgccttttagatatgcacctaatatactaatctgtatcagaatattgctttgtccaacaggctggttattggaggtatatattaaaactatatagaatacacttctggcaatgcaggagcaagatggtatggaattcacttttccaccatacaaacttgagaactggagaaaatataggaagcaaatttttccaaaaagtagactgcacaggactggtattcctgagaaaaggggaaagaacaaggggaaaggagagctctaccattgtcctaggtttctgccaggagctaatttctgaactgcattataaggaaaggggacctaaccacagcagaaggctatggttttgttgaggattgatcaaaattcagggaaacaaaggcagttagaattttgtgttgctgaacacctgaagtgagaactatatgtagagagcgcaccagaactgttcttgggtgttgttttgagggtttagctgagcaccagtctgtgaatgcatacagtgaaaccccagagactgaacatgagcagcttgtgaagaaagagcaattactaggggttaatatgagcaatttctggtatgcttatacaaggccaagaattgagttctttctctctagatttcagagattttattgactacatgggcaattcagtagagaggcgaagtggggctaaattagccttagaatggaggttgctctaatcctaccctaaaaaagcttcacactaatgtgcaaataacttacctgcttgccagaaaaaaaaattaaaaatttgccagcactcgttaaagtagaacttctcaaccttgtcactgaagatgttttgggctggataattgtttgttttcaggggctctctggcacatacaggatgttaagaagcattcctgatttctgctaactagatgtcagtaacactcccccattgtaataaccaaacatgtcttcagttattgcctcatgtctcttggaaggcagaatccaccctgactggaaataactgttgtaaaggattactgtaaaatttaacattcaacaacatcaaaattttaaataagtactaggtatatcaagaagcaggggccgggcgcagtgactcatgcctgcgcccggatccactgcgatggtgtacaagtgctgggtgacgaattgttctgtatcttgttgtatttacatggtgcgacatttgtcaaacattactgaaatgcatatttaaaacgggttcattttattcattgtaaacattctctcaatgaagttgaatgttaaaaatatattacaaaactgtcttctccacttcagtcttctgtgtgacttaggataatattgaaaatggttagggtagatcactatacttgttagcattatatttcttaagttaataacttgttttggcaagccacctgtaaaatggtcatttcgatagatgcaaaaagattctcacgtttgattggagacttttctggtctgagccattatattaaattgtttaagactgtggttttggggtcatctagaattcacttcaaaaattgactttgttactgactacctgtaggtccctgggaaagtcattaatatccctttgtccaagtttatttatttgtaaaatgaggagtaatagtgctgaatgttaagaagctcatgtgggcttataaaaatgagataattcatatgcggtgcttagccaaatgcctggtacagaattagctctgaataaatggtaactactatttttattgtccctattgttcttactgttattttttaacagactaccttagttcagtgaactgttaccacatatttttccttaccccgtacccccggtcttaaatgtttctggatttttactctagaactttgtttcttacttagattataaggctctttgaggatctgatgaaagctgtacctgttttatccagaaaaaagtacataaaaataaccacacagttttccgtagggttgtttgtggactcattgagcctataaataagaacccttgttactgagcaagaatgtaaaaacgctgttacccatataatgttaaacttaaaaattttttattattatatagtaattgagtttccattgactgctttgaaattagacctgttacctaatctctgagctaaaataacagattatgaactattgacctttttaaaataaacatttttgaacattcccagttttatattgagaaactcatgctaactttgattggattgaatcatatagctttaaaaaataatcttatgtctttattgtttgtctcacattatatcatctttggccaaaagctataaattgacatgctgtgtgttttttttttttttttttttttgagacggagtcttgccctgtcgcccaggctggagtgcagtggcgtgatcttggctcactgcaagctccacctcccaggttcacgccattctcctgccttagcctcccgagtagctgggactacaggcacctgccaccatgcccggctaatttttttatatttttagtggagacggggtttcaccgtgttagccagaatggtctcgatctcctgacctcgtgatctgccagtctcagcctcccagagtgctgggattacagacgtgagccaccacaacatgctgtttttaaggacctcgtatgacatgatttcctaattaggatttcttaattttactaattaaatttacctaaaattattatcgttttgcacaataaaaaagtctgtgtaaattgcataaattgcatcttgctcttctggatatttcagtactgaatagtttaattttttttctactgtgttttattagaaggcatatagaatgtagacattatgacaggatgtcaagcgttttgtgattctaggtgtcattcttcaaaaacaaattattgtttcagaaactgttttggctgggcctacttcacctataccttctctgggaaatgtgagtgaaactgcatctggatcagttacacagccaaagaaaattcgaggaattggatttggagacatttttaaagaaggctctgtgaaacttcggacaagaacatccagtagtgaaacagaagagaaaaaaccagaaaaggtggtaatgatggacttgttagattaactccactcattctctcattaagcattttttaaaatgtaaaagtcagtttgtaactctgttagatttctttttttcagatcactaataatttggttatgaatgaggaggctgtgagaaattttgtctccaaatttacaatgattaatattcatgtttgaatctaataaaattagaatgcttatttcttggtaaatttaacacacttagtagaagctttagggtttttagttagcacagtgtaaataaaaattagagggttttttgccttttaaagctaaaattatatataaatttagttatatatataattaatataataaatatatatttaatttgaattagacctaaaatggactgtttttaaaatggatttagaaaatattaaattacttgatattttggcactacttaaatttcctctagattgtcaacattcattaaatttactaaacttctttgaatgtgtggagtattttatttcattagcattttgctggcattgtgaaatgaaaccaagtaagtgagccataaattataagaactaaaaagaggctttaaaataaaaccttaagctgttaatttggtggtaaaatagctacagtctgtagaacattttttcacagttccttctatcagtcctatctctttaactctgaagaaattatagtatttcagtatttatttgattcgtgtagctacatctcatttaaagactgtgttttggttattgagatactattaagtttcctcctaagataggtggtttcaactttttttattcctttcctaacttgctacgtattttcttatgtagcagtgaagagttgggttcaggaaagagaacttccactttctatcctacatattcctagctctgagactatctggcattaggattgtggggtcaaattgattcttggttttaaaggtaaagtttggaattctcatggtttttggggtggtgctctatagccatgtaacagctaggaatgttggacaagcaattcttggcattgtgatagaaattagactagatgatcttgtgccccttctaactctaaagcttaggattatattgaataactttagttgattaatgattatattatcttttaatcatccttgataatgtctactactcaagagttgttattagtgactgtagtctcagggttaccctatataatggtctggtcaggcttgctttgatcactgatccaggaattgataaaatagggagcacatttgctgtgtttgtaggtgcaccacaatatggtgtttagagttggggaaaactaaagtaagtattttagaagataacagaagacacagtagtaggtaggtaagttagcagtgtgttcagatttttaaataatgacatctaaggttaaatgtactgttgtttctgggttaaattactgttaaataataaggttaaattactgttgtaatctgttagtcctttacagattacaatggaaaaatgtctagtagactgtagctataaggaacataagattacctgaatcatttacattcagatagcaatgaagtataaagagtttttttttctcctctttcattttaaggtttagttctgggttaaaatctgggctttgctgctaaattccttttactatggacagatgacttatacaaatttgtattattgtttgaatagtgcccacttaatgcagatagttatgaggctactagtcctatttgcactatttatataaagtgtttagcccagggatttaagttctcaagtgctgttgtttttatttattgtatttgttttattgtagtttttagagatagggtctcaccatgtcatccaggctggaatgcagtggtacaatcatagctcacttataaccttgaactcctggtttcatgcagttctcctgccttggcctccctaagtgttgggattcagacatgaaccactggttcctagcctcttatttattttagagattctaaaattaaatctcattaatatactatggacgtcagagaatattatctttgagacaaggaatctttaaattggtagctctgagctatgatttaaggaactttggagacctttacctgtttcattgctaagttttcagtcacattactatcctagctataagtaccattagggaaagctgggtaactgtaaatggaaactttgtttaacagtattatctttattctatcttaaaatagtttatgccatttttttctattctagcccttaatcctacagtcactgggacccaaaactcagagtgtggagataacaaaaacagataccgaaggtaaaattaaaggtatgtttttgaataaagctttcatattgggaatagtagaaacatactcaaatgtattaagagacttgttggaagcatttgttacactgtcttattagaatagcaaattctattagatgtaagcaccatgaggtcaaggattttgatatactttgttggttgatggatgtatctccttgtagttgaatctgtgcctggaacatcacaaacagtaaatatttgaatgaatggattaatgaaattgttacttaacatacggtattgactataagtattttaaaatttaaagataattaagttcatctctaataacttttagtatactttacacaagatagaggctaaataagtatttgttgaatgaatccatttgtgtgagccacattatttacattctttatttcagctaaagaatattgtagaacattatttgcctatgaaggtactaatgaagatgaacttacttttaaagagggggagataatccatttgataagtaaggtaaggtgtttctgtttttcagtgaattgcttaatttatttatagaaatatttttcaaaagttatacattcaccctagagtgttcttatattcaccctggaatctagaagagctgggactttgtcttgtttctaagtcctgaaaacttggcacgtaataagtgctcagaacgttctctttttgagctaacttttattgactatatttgttgtaatttacatattgggaattattgttaaccatcatatttgttcttttttaagtactttttttttaaaattaacctcaacttcccaggtttttattcttacttctcttccacctcattctattttttctcctgtctgtcgtttggagtgttgtttgtaatgtaaacagaagaaaaatagggaaacaagctaaacatccatgagtatggaaatggttctgaaactctttttactctggaaaatgatgtcaccattttaaagaatgaagtgattttataacttggaataaatcctaatgcaaaataaagagaaaacccagtactacttgtgtgtgggcagaatcctataataactagtattatgggaaaattacaaatattttgtttttgctataaccctgtagaataatttttgaaattctgccccccacccccaaccttttttaagtagaaatggagtcttgctatgttgtccaggctggtctcaaactcttgagctcaagcattcctctcgctttggcctcccaaagtgccgagattacaggtgtgagctaccacacctggccccattgttttacactgactttgttataagatgtcatagtgtatataattttttttaaaaataagttttattgtgtaaagtataatgatgttataggatacgtagtaataaaaaggttattatagtgaagcaaattgacatctgtcatctcacatagttaccttttttgttttagtggcaatagcagctaaaatcatttagcaagaattttataaatgtatgtgaattttcatattaatataatttgcactgattacacctaatttttcatgcaagggtggtgggtatttagaagaaacttagaaggtcttgttaattaaaaaaaaagaaaaagaaaaattaaagacaaggtctagctttgtcgcccaggctggcgtgcagtggtgtgatcatagctcaatgcagccttgagctcatgggcacaagtgatcctcctgcctcagcctcctaagtagctgagactactacagttgcatcccattgcgcctgattaattcttttttcaaaatttttttgtagagacagggtcttgctatgttgcccaggctggtgttgcaaactcctggcgtcaggcaatcttcccacatcagcctctgaagttactgggattacaaagcatgaaccactgtgcctggtcaaatcgtgttaatttttaaagcagctgaataatgtgattaatttttagtatataaagtgttaaaagtgttaagaaggatacagtttagaaattcatattctccctctccaccttcctctcttttccacttcctttcattatatcttttttttttttttgagatgcagtctcgctctgtcacccaggctggagtgcagtggtggtgtgatctcggctcactgcagcctctgcctcccgagttcaagcaattctcctgtctcagcctcctgagtagctgggactacaggcgcctgtcacgatgcctggctaatgtttgtatttttagtagagacggggtttcaccttgttggtcaggctggtctcaaacttctgacctcaggtgttccacccacctcagcctcctaaaatgctgggattacaggtgtgagccaccgtacccggcctcattttatctttctcttttttcctctgagaacattttaacgttataaatggaattttaaaattgatatagtttttaaaactaaacgcaattttgtaactgctgctaaaagtaatacgtgggaaatattttcttttaggacagtgtgatctgtttagttccagccaggcacagtggctcatgcctgtagttcctgcactttgggagaccaaatcaagaggatcatttgagcccagaagtttatgattgcattcctgtggtcccagccacttgggaggctgagttgggaggatcacttgagcccaggaggttgaggctgcagtgagtcatgatcgcatcactgcacttcagcctggccaacagagcaacactttatcttaaaaaaaaaaaaaaggtctattgtcttaattattctattttgctttttaggagactggagaagctggctggtggaggggcgaacttaatggtaaagaaggagtatttccagacaattttgctgtccagataaatgaacttgataaagactttccagtaagcttttgtttttcaatgatgataatacttgaaagaacattttgccactattcttttgcaaacaagtttttttgcattattattgaataatttttatgaaggagtttcagatgtagctattcaggtaggagttatttgagttatagtaaaacaaaataatgtttcagttccgtactttattcttcctttgtttctttctcgactgtactgaaaaataaccttagacttctttattttataatttaagaagggctgtctatcctaataacataaattagtactttcctggaagaaattgtatttttatttaatgttgttgaaaagctctagtttattttaaggtcttgtggatattgctgttatgctgttggtgcatttttttgggagggcaagagcactctgcctccttacagaatttgttatttttgtgtcacttctcagagaaaaagtgaggctgagtcattcatcagtggtcttttgccttcctacaacttggtcccttttccccatggatgaggaatataatagagtttttagaatagagggaaagagcatcaacacaagcacacaacaggatgggctaccatgttaggtttaagccaatgcataactctccaactctatggaagcttaggctgtctgaggcctttgttttgttagattgcattcagtattgattcagccttcatatgctttattttatagttttactaaagaatacgtttttctgcttttattatgtttgtacattacggcttatcaattattcttaatttgtaaaaaccaagtccaccaacttagaagtgtatatcaatattttaaggtattaagtcttaaaaatgagcgaatgtttataaattgagaaaaaacatgtctttgcctttaactgttcctttgagagttccaaagagttaagagtgaaaactaagtctatttgttgctactctgtttttaaaaaccaaaacaaaacaaacaaaaaaaaaaacggtctctcccttgttctgccagtcttcctctccccacaaccccagctgcaaaagaggggtaaaatggtacttaggaatcttaacctaggggaggcagagcagaacatttttgctcattaagatttttaaggtttattcaatccactgaaatatggattgagatatttgactgaattttgaccaatgaggctgttttttctaatgaaataatttgttgtcattgactttttgggtagtttttacgatcttagcattttatattttgtcaaggattgaatgaagaggagagacatttgtataatttagattattactaattagagtttattttaactatatttgatatgaaactggtcagccgtttccaccattattattttaacagaaaccaaagaaaccaccacctcctgctaaggctccaggtatgtaagaagcatattattcagtttgctattttccattttttaaaattctaaaatggtaaaattggatctaatgcaaactattgatttttatcaagtatgatgtctgtaaacatttttagaaatatatgaaaattgagtgttcacatgcattagtatctgtcatttttcttaaagtacaaatggtataaaatagggatcttgaaaatgtagatactttatatgtaattttgagttaataaaattaatcaaatttaaactgttttagaaaacttaatatattgacctggccaactagttattctaccgtttcaaatgaaatccatttgttaatgtctcaaataataatttatgtactcttcttttcagggaatatgctgaaggttaaacaaagtagatgattttaaacagatgaataaattatggtagacctagaagtgtcttcaagagttaaagttttgtaatctggctctttgcttccataattttcgaataattgatctttacaagtgtaataaaaatttctatttcctaaaagatttgctgtttttttagaataattcaagtctttttgtcgcccttggttttagctttatatttgctgacctaatcctagagcaaagaaaacataagttaaaagtaatttttatagaagttggtgttgaaagctttttatatagctttactcttcaatgtggtagccactaaccatgtgtggcttttaaacttaagattaaataaaatttaaaaattcagtttctcagtcataggagtgccatttcaagtgttcagtagtcacatgttggatactgaaaaaatagaatgttttcatcaccacagctcttccatactgcagtacggtagaggatatgatctctaacacctaaatttgacaaagaaggaactgagaccacagagtagggtaatagtggcaggtccaggattagaaattgagcctggtaattccggtacattgttctttctattaaaccatggtttcatctgatgttatttttcaactcatctttactttttagaagtgtaattgtctctgtgctttaaaactgtcttcttaaaaaagtattaatgttttttcccatagctccaaagcctgaactgatagctgcagagaagaaatatttttctttaaagcctgaagaaaagggtgaggctaattttcaactttcaaaaaagcaattatttcttttattgtcattttaaagagaattatttctccacactgagttatttacactgatttttaacaggtattcagtatgtatttaacaatgcttggagttttctgggagggagtagttcatttctcaaacagataacaatttacattcattaaaaaattaaactattcagtaggatgttgtctttattcagttatttcacagactgtataagaaaactaagcattaaataactatgcttttattatttttatagtgtttcagtttttaaaaaattccttagaatgttgaagacccagttcctacttaagcatgaaaataattaattacatattatttaatctcactgcatgtgtttgtcataatgtaaacctggaaagttattccagggtaccacatgtattttgctaaaaaccttattggtttgttgtgaatttggagaaaataagtccttctcattgcacataaagatttgcaatgattgtcactagtagattagtttatatacatcaagaaacttgaatactattttagaatgctttttgtttcttcctccagtgttgtagtctaatccatccttgtttcttgcctaaagtattgtatcctcttacttgatttctctcactttagctccttttctggctcatacttcatgttgttgccaggatcatgttttttttgtttttttttgttttgtttttttttttttgtctcgctctctggcccaggctggagtgcagtggcgcaatatcggctcactgcaagctccgcctcctgggttcatgccattctcctgcctcagcctcctgagtagctgggactacaggcacccgccaccacgcccggctaattttttgtattttttagtagaggcggggtttcaccatgttagccaggatggtctcgatttgctgacctcgtgatccacccacttctgccttccaaagtgctgggattacaggtgtgagcctccgtgcctgggccagtatcatttttttaaggagactgttttttagagcagttttaggttcacagcaaaattgagccaaaagtacagagttcctgtatacttcctttcttcacacaggcacaatttttcccactgttaacattctgtaccagagtggcatatttgttaaaatcagtgagccttcctacattgacacttctttatcactcaaagtccatagtttcctttagtgttcactcctagtgttgtaactattatggattttgacaaatgtataatgtcctgtatccaccattgtagtatcatacagaatagcattactactctaaaaaccttctttattctacctattcatctgtccttcccttcaacccttgtcaaccattaatttttttaatgactccatagttttgccttttccagagtgtcatatagttagaatcatacagcacgtagccttttcaaattggcgtctttcacttaattatatgcctttaaaatttctccgtatgttttcatggcttgggaggcatatgttgttagcatcaaataatatttcaatgtctttatattccacagtttattaatccactcactcactgagggacatcgtgattgcttctaagttttggcacttataaggggagctgctataaatgtgtgtaggtctttgtgtggacatattttctattcatttgggtaaataccaaggagagggattacctgataatatggcaagagtatattgagttttgtaggcgcaactgccaaacttcttccaatgtggctgaaccattttgtactccccctagtaatcagtgagaatttctgttctacgttctagccagcatttggtattttaagtgttttggattttggcctttctaataggtgtgtagtggtattttacttttgttttcagttgcaattccgtaatgatatatgatgttgaatatcttctcatatgcttaattgtcatttgtatatctttggtaaagtgttctggtcttttgttcattttttattcaggttttttttccttcagtttctttctttgtatattttgtatagcaatcctttagtagatgtcttttgcaaatattttctcccagtctgacttgttttcttcacagagcagaagttttaaatttgattgaagcttatcaattacttcttttatggatcatggctttggtgttgtatctaaaaagtcattgccatacccaaggtcatctggattttctcctgtgtaatcttctaggaattttatagttttgtgttttacatttaggtttgtgattcattttgagttaatttttgtgaaagttgtaaggtcattgtctagattcatttttttttttttttggcatgtgaatgtctagttgatccaacaccgtttgttgaaaagactttcagttttcagataaaaatcaaaagttcaaattcaaggccctccagtaactaactgaccccccgattacatttttgatatcatcttccaccctttttgtttactaaatgtagcactcactctctagtccctaaatatgtcatgtactttcctagctttatctttcgttttactttcaaaatggaagtttttttatattctttttttatacttaagaattttaaaaatatgctgcacaaacaatttatgcttaataaaaatattagtctcagattaattctttgtgaactagttaggtaggagtcttagatcagtttttagtacttgtttataatatctgtcctacctgaaaaactcagcttaccaagatatgtagaaccacatgtaagaggtatattgctggctttattatctatttttttactattaaaaaaaatcatgtcaccagttagtcagcagttttgttaaaattcagatagtgacttccccttttccctaaaatcagtcagttgttcttataaataaattggaggccgggcgcggtgtcttacgcctgtaatcccagcactttgggaggccgaggtgggcggatcatgaggtcaggacattgagaccatcctggctaacacggtgaaaccccgtctctactaaaaataaaataaaaaaaaaaaaaccagctgggtgtagcggcgggcgcctgtagtcccagctactcaggaggctgaggcaggagaatggcgtgaactcgggaggcggagcttgcagtgagccgatattgcgccactgcactccagcgtgggcgacagagcaagactccgtctcaaaaaaaaaaaaaggaaggtgatgcatttttgttacttttatctatgcaaaatcctgcccatggtggaatgacagggaccgaatttacactcctgagttaaacaactggaaaattggacaaaatgtatgaaacagtggctttcacatatcggacatcagacagtataagtcactgtgacactgaagtgagacctataattaccacagcttattgtctagaagcagtttacaggcagcagaaaggaggaagccaaacagacctcgatgtcctacagagttgaggatgcagagataggtatttaggaaggcccgggcagctacaatttgtggggcagagtgccagagtggtgggaactgcacagcgagtactcagatctgtagacagcttactgtgaggctttgcctgaatattgatctacacatgcatgaaaagaaatttccataatggagaaataaccattggaaagcaataggtgaagcactctttgtaactcacaaacagttcatttttccatgagccagagtagaaagatctcataatatatagcacattggatagagttcataaaacagtgtatcaccttagactaaaggtttctctgcctctatcttggaaatacggccaacaaattccagaataaaatttggtacaacttaaaagcatataatgaaattttgtattcaagagagtaaaaatcacggcgtccattgtctgattaaagattgccaggcatagaaagagcaagaaaatagcaatacacaaccagggaagaaaaatcagtcagcagaaaagagcaagaaatgacagagatggtggagatagaaggcaagtacattaaaacagctatgataaacgtttcccatgtgtttaaaaaggtagaagaaaatgtgaacattacagtgcaaaaactggaaaatataagaaagacccaaattgaacctttagaaaagaataatacagtatctgaaatgagaaacactgaatggaatgtccagtagagtggaaactgcagaagaaaatgttagtgaacttgaagacatagcaaatagaaccattaaaaatgtatagaaaaaaagtgaacagaatattggttacctgagtgacaatatcaagtggttttacttacctgtaattgggatacctaatggaaaggtgagagaatggggacatgaaaaaacttaaagaaataatggctgaaaattttaatttgatgcaaatttatgacaaaaagcttaaagccaggaagaaaataactgtcaacctatagttttctacctaacaaaaataccttttgggaatgggtcaaaattaaaaccttttgagacaaaatctcagagaacttattgccagtagaactgtattacagaaaatgttaaaaaattacttttggtagaaggaaaacgatactagattggcagttggtattactcaaagcaatgaagaatgccagaagtagtaaatatgtgaatagatatagaagacattttccctccatttaaaaatctcacaagaactgttcactggaatgacttgaaaacttaatataaagtgttggttttggagttttagggtagatatgagaatttttttgtatataggttaaacaagagaaggcataacaaaggaaatgattctaagtattttcagaatgttctcatacacctgatatgcctttaatagatcaggtaccatgaataagaaaaatgtcagtgttttgccagtgacctttggacacatgcattcagagagggccagttgaatattaaatattgttaaattattttttactaagtaacagtaaacataaatcaaagttctacccttgttcccatagttgagagagggagcattttcaaatcatggctaggaccaatttgaagcgtcttaagccttccaccaaggaaataaagcatttttcatttgtatttgtgttcatggtttttatctcatgatcttaggttccatggaaggtatccttcgaaaagctctgttctgtcagagatgtggggcgcagaaaagagctacttagaaaccatgaaactgatcacccctctattttggactcttaagtgattccccgttatttcatgggatattttctcaaatgtttagataggtgattaaactctcactttctactttctgtcccaagccaccacgtggattttctcaaacctgcttagcagttctctgcccctctgttgttttcattttcccagaagtacctaaaatcctggcaagctgtgtcccagaatggtaataatattaccactttgaagcacaagttatcctgctttttgagatgtccttttttgtatttatctttcagtaagatactcatcatgtcattggtatgaaattcatgatacaaagggaggaactcataattattttggaatgcaagtagggaggcatgtaaatgtgtagaagagaatgtaacaaaggtgctgtttcttataaaatcacttaaatggtaacttttatcttatgtcctcctcacttcctatacacacatacacagtcatacccacagaaagagcataaaatggtgctgaaggccagtctggttctatactttcactggtagaagcagtgaatctgctcacttttgctttaggagcatttccttctgaattctattattgtaggctcatggcttcagccaccatttgtatacttctgattcccagtcagtggatggatttatttacatttattgctttccgtgtgtttgcagttccatctgtttgcatttcatactttctgtctaaaatacatacttttttaggggacatccttctttctctggaattgtacttctctcagaatctttcatggccaggtttttctcatcttttagattccagcttaaaattttgcttccttgacagtattttccttacctacactatttaaaagtaggtatttctcattattgtctgttacatattagtttagatgtttgttttgggatattctttaccctgcacttggttaaactccatgagggaaaaggtgtgtgtatagatacctgtaccttacttgccattggttctctaatgcgttacacaataggtatataatacatagggaatacttaatgcagtacttattatataatatgaaggattctttaaaatctgaaggattccagattatgacgtgtttacatttgtttttctgaaacttccttctagtggtatttagctagataatggtggtgtggatagtggaaggtggtatgggtaaaaggaagctgaagtgtttcaagagcaaagaacagaaaatccttattgaaactgacttaaacaatagggaaaacatctcacataattgaaagtctagaagtaggagtcatatgacctgccactcagtgattctgttatggacctgaattatatctttccattctgccatcctcagtgtacactttatcttcagactgtctcctcttgtgatcacaagaatgctgagagtggcaatcagggcgacatgatttcttgtccatttgacagaaaagagaggaaaacctctccccaaccatagaatgtaagtcctttcagtttcttggaccacttttgagcacatttacctctagaccaatgaaacttataagaagaatactatttactgattgtctcagtgtaatcatatgaaagtaggattgatttgggaggactcaactgcattgtctgctgaagactttgagatatatttaggatctatcataaggaatgcaatttaggttctactttgacatcttgttgactaatgagatactaatgattatgacgatggggaaatgagataggaagtatggaatagagacagtttctggaggaaaccatgtgaattcagcttttgacatgggatttgatacgaaatattggctgaacttttactaagagtttgtattaagtgtttagttggaaggtgctattctggaagttaggtattaaatttacaggtatgggtaagattgtccaagaagattgcttagcgtaagaatgcgaagagagctttctcaggatatatacatttaagaagttgtttgatgaccaggaactcttgaatatacacacacacacacaaatgtatatacacacacatatatatacccaaatatacacacatacacacacacaaatatatatacatatatacacacacatatacacatatgtatgtgcacatatatatacacatacgtatgtacacacatatatacacatatgtacacatatatatacacacacacacacacatatatatatatatatttgtcagagtcatctgctagaagtaggagagctacaaataaaatgaagaatcataagatcaagatagaggggaagaggagagcccagtaaagtctggcattggggctcatatttcctgttggagcatttgccaatcttgaaagtggtagcttagcctatgaaaagaactttcgatagacttttgggctcaaggagacaaaaattagagttcaaagctcatgaaagaggaggtatcctagtgaactaggttttgatttagttcctaaagggatttactgttggaggaagtatgaaatggaaatagacctaactctgaggaacactgaagttcaacttctaataatctcaattcttgatgggaggaaggtgacctgggatttttactatccctaccttagcttactgaaagaatgaaagtaaaccttcattgtctagagaagaagacatcatctagagttttaaattatctctatgttttcctgtaaatcttttgtgtcttgtactcattcagagataattaggcatactgatagatatgacacatggctagaaaccaagaacaacagacaatggaacctggcctttaggggatctagatattagagatactagatataagctttaaagtaactgtgcttaataaatgttagaagtaataaaagatggggttgataattttgacagaactagaaccttgtaagtatatatgaatatgagtcagtctaagcttaaatgaatttgtttacatatataagtatatataaatatatacacacaaatgttaatatatgtgtgtatatttttaaaagaaaatatctgaactgaaacataaggagacaaaaaagatagaaaatatggaaaagaccttaagagacataaagaatatggttgactcttgaacaacatgagtttgaactatatggggtccacgtatacacagatttttttcagcctaatggggaataaaaatacagtatttgtgagaatacaaaaccgcatatgaggagagccaacttttgtgcaggcacgttccacagtgctcaccatcgggtttgagtatgtgtgcttttggtatacgtgaggatcttagcaccaatcctctgtatatacagagggatgactgtacagtgggaaggtcttatgtacatgtaattggaggaccagataggagggagaaaaaaatggagcagaaactgtatttgaagatacaatgtttttcaattttctaaaagtgattaaaagcatcaggccacaaaaccaagaatactatggaatccaacctggatatatgcaaagaaaacattgaggcaaggaattgaagaagacacacaaaaaaatggaaaaatattccatgtttaaggattggaagaatcaatattgttaaaacttccatactacccaaagcaatctgcacattcagtgcaatttataacaaagtttataaatttataacaaagttgccattggaaacagcacaaatgttcaacagcaaaagaatgggtaaaagagttgaggtatattcacataccatgttaccacgtagcaacaaataaatgaacgagagctacacacagcaaaatgaatcttaggatttcgttgacataaagttaaaaatattcataaataatctgtggtgttagaagacagcttgggtggaagcaggtggggtagtgattgggaagaaggataagggtaacttcagagatgtggatcatgttcagttcttggcctatgtggtggttactctggtatgttcatgtggtaatagtttctcaaactttatacttaccatttctgaaaatgttatgctgcagtttaaacttcagtgagataaatacgaataaatatattttgtcctaaaattttctaaaatgttaggaaaataggttcaattaagaatagactcactactttttaggtagtacattttttctctaaggcatctccaagtgatcacaaagaatagaatatttgatttttttaaattagaatttatgcacttggaatcactcctgttttggtgcccatattatcacttatttttccatttcaattaatgcagtaggacattgaccctcatctgaattaataaatgggttaacttattacgtacagtgttggtaatgtattgctatattctgaagcaaataaaaggacatattttggttattttgttgtattttgttagcatacattttagacatttttgttaaaaaaattatatacttgagataactcttttctgtatttcattttctttcttggagacagggtctcactctgttgcccaggctggagtgcagtgatgtcatagcccactgcaacctcaaactcctaggctcaggtgattctctcacctcggcctccagagtagctgggactaaaggtacatgtcaccataactggctaattttttaatttatttttttcttttatagatatgggggtattgatttgttgcccaggcttgtcatgaactcctggcttcaagcgatgcccccatctcagcctcccaaagtgtttgggttaaaggcatgagccactgcacccagcctgtgtcttaaattatcataatatctgtaccttatgtaattcttccttggtcattcaggcagctaacatagaacttttttttttctccttaaatctacattttctcttggatttggcaaatttttagctgaactaacattctagtactcacagctggatgttctcaaaagaatgaagttggagccctaccccacactgtaagcaaaaagtaactgaaaatggatcattgaccttaaatataagagttaaaactcttagatgaaaacaagagtaaatcttcatggccttggatttggcaataggtttttagatacgtgtgatattgtgatctaataaggaatgtgcatttaatatttgtccctggttcctggcaccatagctcctaaaacccttgaaatttcctgagtgataaaggtgagaggaacatcttttgttatttataacaagcatctttcaaccacgtctgagtttatattaatgaggaggcttttgtaaagtccctaaggatggggaggggccttgttgccaggggaaccaaccaaatgtttagctttcattaaaaaccctaaacaacagagtttagagagctcatgggtttgtgaacacattgaggggataggaaggtggtacacctggagaagttacggaaactctgcatctcttcctgcataccttgccttttgcatgtgttccatttggctgttctgagctgtatcctttataataaactgttaacagtgagtaaagtgccttcctgagttctgtgagctcttctaacaagttatcaaacccaaggagtgatcatgggaatccccaatttatagccaattgatcagaagtacgagaggacaggacttgagattggaatctgaagtgggagcagtcttgtgggtctgagcctttaacttgtgggatctgatgctaaccccagaaagacagtgtcagaattgaattaaattataggacactcagctggtgccagataattggttgttgtgggaataaatccccacacatttggtgtctcagagtgttatgaatctagagaaaagtattttgttctttttagactatgtcacaaaaagcatatttaaccaaagaaaaaataattgtactttatcaaaattaaaaacttatatgcattaaaggacattaagaaagtaaaaagacaacttacaaaatgggagaaatcttatgagatttgcaagtatctggaatatgtaaaggactgttacaacttaacaacaaaaagacaaacctgtttaaaactgcagcacaggctgaaataggtatttatctaaaggagatatataagttttgttttttataacaagcatgtttataagcatgcttgttatataagcacttgaaaagatgtttaacatcattaatcatgtcagtaagcacttgacaagatgtttaatatcattagtctttagggaaatgcaaatcaaaaccacagcgagcaccacttcacacccactgagatggttaaaaatttttttaagaaaggaaaataagtaataaatgtttgcaaggatgtggagaaattggacttttatacattactggtgcaaatagaaaatgttttagctactatgaaaagcagttaggtggttcttcagaaagttaaacatggaattaccatatgacccagcagttccaaacgtccaagagaattgacaacagactctcgtgtattgtatgtaaatattcatagcagcactatttacagtaggcaaaaggtagaaggaatcctcaatgggtaaacagattgtgttttatatatgtgtgtgtgtatgtttaatggaatattattcagtcacaaaaaggaatgaaatactgctatatgttatgaagaggctaaactgctaaaacattgggctaagcgaaagaagccagacacaaagataattgcatgattccatgtgtatgaagtatccaaaatgggtaaatccatagaagatagaaggcaggttgctgtttgccaggggttaactaattaatgaggaaagggttatcttctggggtgttggaagtgttttagaagtagataaaggtggtggttgcgtaacatcgtgaatgtactaaatggcactgaattgttcattttagaatttttaattttgtgttatgtaaatgtcacctcaactaaaaaaataaaatctagtacataaatatgttgccatcttatagtagttatataataagtcagtaccttatagttgatttagttatggacataaccaggaatgatgagtcgtatttttgttaccttttgatttccatgtattcttttttttagactaacactacagaatttcaagctgttatttgtgtattctgttaaaataaatatattcaatcagtgaacttctctttaatttatatcctttgaccatttttcttggtatgttatataaaacatctcttaatttctagaaatttaagtttggctggttgttataactacaaatagctttatttcgttattgatttcaattggagagtttggttttttacaaattcctggtggtataattatatatagtacattgttacatcttgaggccatataaaaatagatttttgtaccaaatgatgaccagaattttatagactaagctatattttcatatgattcaaagtattaaataagtggtaaaagtgagaaaatagtattttgtattcattgtgaaataagacttgtaatttttaaaaggaagaggtttagctatgtgctacgatgttcaggttttataatcaccagtttctggttgatatgaaatcttacagaattatttgtggtcttgtgatagacatttttttcaaagaccaaataaattttgaaaattattcagtatggtgcttaggagcttcttatttttgtatatacgtcttaagacacattttagctgactgctgtattatgactatctcatgtatgcatgtgtcaattttaatacctatttatgagcacctgaaagatcaggaagcaggtatgtcatgtgtaataaaagagtacttgttgcctttttggtgataaaattgtctttattgacatagtataaaattgtcaaaattgtttttttccagcttattttcttctacttcaaatggaaatacccatttcattgcattattaaatgaaatggtattaataaaattcttagtgcagtactaagaattacaaatataagcctataattctctcgtctgtggctaagcagtcttgccctagtttctcttaacatttgatttttttttccttcaccatcatgctttttaaatttgaatgttatataggacttgagtttctacttgtttttagttctctatatttcagtttcagaaaatagtctggatttaagtctagataattttctggttagagtaaaatcatgtgtggttgtatttgagatagactactacacttaaaagcaaagcttcctgggaacataataaaaagcaggcattatctactaatcggaagcttattagtggttttcctctctaccataataaacattttttaaagttatttaggattattaaattaaaatataactttaaaataagtaaaacagtgcacatgtatacaaatacagagaatgaaagttcatgtctgcctctgtcacacttttccagcctgatacaaacttttggaaatagaaaaacctaaataattttgattgttaataacttgtgaaatattttaaatcttagatgaaaaatcaacactggaacagaaaccttctaaaccagcagctccacaagtcccacccaagaaacctactccacctaccaaagccagtaatttattgagatcttctggaacagtgtacccaaagcgacctgaaaaaccagttcctccaccacctcctatagccaagtaagttttacctaattttaaattagcttactgatttactcacctttgaccttaatggctctattgcctttctaaatctccaggtatgttttttcttatttttcagttatatttatttttaaaattgacatatacaattgtgtgtatttattgtatacaacatgatgttttaaagcgtatatataattcattgtggaatggcttcggtaactgtgataacctcacatagttaacatttttatgatgagaacacttaacattcactcttagcatttttaaagaatgcggtacatcacattaactgcagtcactaaaatgtacaatggatttcttaaaacttattccctctatctaaccgtatgtattccttgaccacatcttcccactcccctccaactcacaaccacttcaggctctggtaatcaccattctactctatttctatgggatcaacttttttagacttcacatttgagtggagaacatgtggtatttgtctttctgtgcctggcttatttgacttaacatcctccagattcgtcgatgatgttgcaaatggcaggcttgctttctttttttatggctgaatggtattctttgtgtatatatgccacattttctttattcattcatccattgatactttaggttgcttccatattttggctgttgtgaatagtgctgtagtaaacatgggaatgcatatatttctttgacatattgattttatttcctttggatatggacccagtaatggaattgctagatcatatgataattatctttttaatttctcgagggacctttgtactgttttccataatggctgtgggaatttacattcctaccagcagtgtgcaagggttccctttccttaagatgctcaccaacacttattatcttttatctttttgaaaagttaaagtttattttaatgttgtaaataacatccaagaagaatataaacatgttgaaagctggatatgtaaacaaagatcacaggcaggttctgggaattttattggagctttggttattaaaatgcatcagtaaattcccagggtgctaagcactattctgttggctgtgccaacagtcctcatgcatgcttaaaacacttgggggaattatagtacaaatccagtcagggttggaaccatggcaaaccaagggctcttagagatggacctgtttgtgctgctaggcatcatggagaaagcagcagacgaagaggtgaaggaggcttataggtagaaggccctctcctgccacccagacaagttggataatcacagagcagctgaactcctccactagctttctcaggccttgctgcagccagggctgcatatgatgatgttagaaaagccaagaagcagacagcatagaggacccagaggcttgatgagagaataaaaaaagctaatcatgacctgaggcccaggcccaggtgagtgagaaggtggaggaaagctagagcaccaggacacttgagcaggagattgaacatcttagtgaatagtgttcatggcagctggaggaacagcagatgatgatccaggagcagatgtgccaggaacttgacttgagattagaagtcagaaaatactgaagacaaaggaacccaaaactaaaactgaaatggaagtacaagaaggatgagtcagaaggcagttactccaaaggtgtcctcctgtggcttttgcaaaagtatggtggaattctcaacctggtgcttttgagtaagaaggcaggtactggtgtcgtggagtttgggactgtcgaggctgcagagatggctgtctggaataaagttggcctgggtgataatcctggaaagatttcctctttcaaaggaggactccagggtgcagtgggccccacccacccaggacagtgaagggacccagtggtgtctcttcttaccacatgcagcagtagtcaaggaatggcagcccatttagtctcctgccacagccttcctaagtcacagccctttttaaaacatcaccaataaactttaaaagcaagaaagaaacaatcccatcagaaactggactaagtacatgaatagacagttctcaaaagaagatatacaaatggccaacaagcatatggaaaaatgctcaaagtcactagttaccagggaatacaaatcaaaaccgcaatgtgataccacctcacttctgcaagaatggccataaatcaaaaaatcaaaaaataatagatgttagcatggatgcagtgaaaagggaacacttgtacactgctggtgggaatgtaaactagtagaaccactatggaaagcagtgtggagattccttaaagaactaaaagcagatctaccatttgatccagcaatcccactactgggtatctacccagaggaaaataagttattatatgaaaaagataacttgcacatgcatgtttatagcagcacaattcgcaattgcaaagtatggaaccagcccagatgcccatgaatcaacgagtgaataaagaaattgtggtatatatatataccatggaatactactcagccgtaaaaaagatggaaaaaatggcattcacagcaacctggatggaattggagactcttattcaagtgaagtaacttaggaatggaaaatcaaacattgtacgttctccctaatatgtgggagctaagctgtgaggacacaaaagcatgagaatgatacagtggactttggagacttgaggggaaagggtgggaggggagtgaaggataaaagactgcacattgggtacagtgtgcactgctcgggtggtgggtgcaccagaatcttagaaatcaccactaaagagcttattcatgtaaccaaatgccacctgtttctcaaaaacctgttgaaataaaaaataatctaaaataataaaaaaaatttaaaaaaaaatacaggagcattctgtacattttgatttagctctcactgttgcttaccttccagagttgtccttctattgttgcaatttaatttttaagtattatttttaatattttctgtatactaatatctgttgaatgttaattttatgttataataattttctacacttaactaaactgttctcacattttttattttattgtgatcagccttaggagagagttttgcgtttatggaaatggttttacagaacagaaagtaatcggtattaggccatacaatctttaatgtcattaaatcacaatttaaaaaaaagtcgtgtttcatactagtgatttttgcgtgtttttttcttatttcaggattaatggggaagtttctagcatttcatcaaaatttgaaactgagccagtatcaaaactaaagctagattctgaacagctgccccttagaccaaaatcagtagactttgattcacttacagtaaggacctccaaagaaacaggtaagtcagcatggacagcggtggtgcatttaaaaaaaaaaattgtcaaagaaactctttaagagatatatttatgcaatttgtgtgtggataaagttggataaagttgaaattacacagttgaaatttgtttaaaatttagcagccaaagtagaaataataaaagaagataagtaaaatttttatggtccttactgatcagactttatggtttcttactgatcagaggactgaaatagatgttaaaagatgacccatctattactccctctttatagtggaatgactgtactacccaacggagatatgaatacactttagttttaaaagtttaaaaatgagatgacatagactttcagtgccagcattagattatatttcataggactttaaatttctcctcttaatctagagatacttttatttccagtggaggaaaatatgctttttctaacccttttgctaatttttttttaagctttaggactggtttttcagcttactgatatctttgtctaatctgtacttcctgttttttttttaatacctattattatttgtaaaatgtaaaacttgaaacggagaactcttgatagttttcattattaaaggcattgtgccttcattactttctggtaattgttaatattttgtgtagtgctttttgcatttgtgtttagtttttttgactttttcaaagcactttctcatgtatgttcttagtttaactctaggaagcagatgcttttttttcctatttggtgtctaaacaaagtaagctacagacacattaaataagcactatcacataaatcaaaggagaactctaaattttcatttttactgtgatattcttttaagaaatcttaatattctaatttttctagcttcattgttcacatttcatgtttacatttaaagttcaagggcagttacacttagatgttttttattaccttattataaaatatgctattacatttcagggtttttcaggtgaccttattcttccctctttcagtttgcgaatgcaaagtttctgacttaaagtgtggcctcctttcagtctttttatttgaacatcttatagatccttttgtcagagttggattccccttgttatggatgaagctatatttactactaatttctgggaattgaaatgttgattgtattttagagaaactcattgaaatttattcggtatgttttatatggtgaaaattatccttattaattgtttgataaacagaaaaagaatcctcatgttttaaaaaatcattcttttttattgagcttatcagtaaatagaatttgatcagttcatattgttttctgtttgatttaaaatatagctagaaatgtgtttcataggttatagttgaagaaaagcagattatttgcccaattttaactctggaaacaaaaaagttattgcaactatattttaaattttcacaaatttgggggatctttatcacataagtctttaaatgttgatggagtccctttgggaattgaaggagtaaaatctggaatccacatcttgctttgtattcatcttgaatgttttacttagtttatgtcaaagtaatggaattttttttaaaatttaggtaaattacaacattttctttttttcgaaacttttcctatatagtgtcacaacacactgccatatttctagtaaaaataatatatgtaataatttcaaactattgatgattggaaagttctgtttttacttggtttgggggaccctatttctatcttttatacatagctgttatttactccctatatagtaaacagagactttgtggaacagggcgtgaaaacatcttatttctgatttgttcttttctttcaataaataaggaaataatctagagatgctgagacttagccaagtcagaaaactaacagctactttcaggctgctgttctttattccttccacttaattatactacctttggtgtactatacttaggccctgtaaagttcagaaaatacagatgttgggaatttagttcatgttaactgtcagattattcactgagcaggttttatatcctcagtcgtgttttaggcacagttgcatgctaagataaaaggcataattgatggaagtcagtagtgtatgtcgtaagcattaattcagagattcctgctacctttttaaattagacgatcatatgttcctagtattagtaatataaaagtgttctacctcttctgtgatgttaatacttcaaaaaaagtattttggctcaaatacagcctcaaatataatgtgtgaaactagcctttttaatatgttttagaaagttgaaaacatacatgaaaaacttattgaaaatttcattattaggcaacgtaataatttgaggttaaataatagaaagtacactgactttgctgttaataaaaggggttttatttactagttgattgctgatagtaagtttcttaatgttttttcccttaactaacaatggaatgatttagtacatgtatatgtctgctggaatacctgacatggaagttattacaaatgttatttttccttctttcctccctcctccattgttttaaacccatcccattttgtttttgttctaatctataaaggatataaatccctgactttgttcacagatatgattttcttatttataaagtcatatgtaaacgtttatgtgtatatataaactatgtatataaatgcagactgacttttgtacatgtaagaaagacatatacagaacactcagattttctttttttaatgacatgacataactttttagcttcttcatatatattctcatatataatgtagttttataaatatcagagctgttaagaaccatgcttacaattttttttctctattacaaacacttcctcaaaaattggtttaaggaaaatctcagtgccactactaattaataataaagcttgtgtggtccacatatttctaaaatcatacattatctgaaaagtaaaattatctttaacttagttttaaaatgtaagatagaaaattttatagtaacatagctgttatattaagaaagcccaactgatgaagtttccttacagtgtagtattgtttttctgtgataagattttctatgattaaaaggcaatttcatgcctgtgatcacagcactttaggaggccaaagcaggaagattgcttgcatccaggagttagagactagcctgggcagcatagtgagactagcctgggtaacatagtgagaccgtgtctctacagaaaaaaaaaaaaaagctgggcatgatggtgtgcacctgtagtcccatggtgtagctactagggagggaggctgaggtgagagggtttcttaaagctgagagttggaggttgtagtgagccttgatcatgccattgctctccagcctgggtgataaagtgagaccctgtctcaaaaataaacaaaaaaaaagcaattttaaagaaacacattattcgatggaagcattcattgttgaataaggaaacacatttgtttttcttcaagtttatttgatatttggtagttgatctattttttaaaaattacttttccaatatttctcatttcttccagaaataatttatggtggaatttttctaataggtacctgttgagtagcatatactataaaaagtgagcctatatctaaactagaatttaaaaaaatttagtttctaatagtttccttgatcataccatattaaagacttgtaagtaccatataaggcattagtgaatttttatttatgtatgaaatattttaaagatagtattgagtcatatttttatagtgagatattttaaagtaatatttaacatatttttcttctttgataccacagaattaaaattgcttttcatcgttgtaatttctatcatgggctaaagactaaaacttgactaaaagttgatttagttataactacattatgagatgtcaacatgctgatttattactctggcctcttaaagcaccaagccatccttttggaaactgtcttggtgttcagtgagtaataaaacaggactttctggcttaatgcatattgaaattaatactaatattaatttttccctttgaaagacaaaggaataaacctaaaacctaatatacatcttgtgtaagttagataacctgcaaatagttatatgccaaacattgaaatggttttattcattctacagctgttcttttttcctgttttgtaaaataattattttggtttagtcttttttctagacattcctatccttgacttttctttccagattttgtttcctagcctgtttgccatgtttcccttcttacgtgtcaggaaattattctacccttctccattttggtaagatgaaagtttataaagcaatcaaaatagtattttcaatataaataggtggtgcacattgatttttctttgtaattttactgaaagtgtacatgtctgtctgtctatttattctaacccttttggttttccatttttagatacaatgaaattcattttggaaaagtttcctgattcgtttaaaatattcttttgataatattttttaagaaaattggcaaccataaaaatcagtttattttctctccaaattggatatttcattttgctttttaaaaattttatgtgttcctagcaacgtgcagattgtaagtggctggcagagtgacaatgtgattgcaaaagctaaatgattgtcgtgcctgttatgccacgtgtacagtgtaaatccattgttatccctcttaggtaaatttaaaagcatttagatatgtcatgagtccaaaatgtgcactgttccattttactaacctaatggcttaaatggagaacctgagagagttttagaatagtaaagttacttgtcttggtgtcatagttcaaaactggacatacagaagacattttacatgagcatggtgtataattttgtaaatctatgttttatttaccctttcagtttcatttttctttgtcttttcctgtgtttttctgtttctttttctttctgcaagttgcttaaatatgcatttgaaaataatctctacaggctaaaatgattggattgtacttgttaaggttttttctttgtgggttgttaatgcacacatcagtgtaaaagcaattttcacccttcaaattacgacatattttaacatcttttaaaaatactgattgctttctttgtgatatttacaaataacatgacatttaaacatatatttaaattcaaccgccttcagattatataatgcatttttcattgtcatttattattatggtttgttatatttcatgattatttacaattatcaaaagactcaaaacaaaaatcaagcatattagagtatctgttttaatgaatcagcttagttgatacaagtgagaacacacaaagaaattgatagaaaaaattatcagcaaattattctagttgttataaaatgcatattaccgaacagtgatgcctttttttctgccttacctttgtgtcctccatcccttaaaagcattttctaaataagttgatgaataagttttgtgggcagtgatgatgagtatctttagatctttttaaagaaacaaataactgagttagaacatataaatatctgacagaaagtattataaacatctaggcagatggtaatgtgaagaattaatacagatctggacgattagaccaaaggaatctgctattagttagaacattttggctgtggttaatattctgagtttggaatctggggtaaaggaaggttatattaaaaatggaagtatctgtagcagtttaccttttgggttcttgattcatatatagatatctgggctttagagttaaagaaatttcctttagcaagactttctgaatcatctaggaaaaggcaaagtattatatatcattgttgtagagtagatttgtccttaaacccaagttaccaggtcagaggtcagccagcctttgatgatgaggaagtaagttggtaatccatgtagctttttctcttttttttttggtatctgatttgccttagatttgtagctgtcttatgattactaaacacaataatgtctaaacaaaggtgcagtgaactataaacagtttgagtcccacctaatactgtgcacatatatatacacataaaggtacattaaatcatgcttttgctttatattgagaaacacaaatcaaaagtggcagggtgccagataaagtttaattcttaacatatgaatattctacttcttgaagttcaaaacaaattttacatgctgattttccgagatcttttaatttattatgagtttaagaagtagatctttgttaggaacttaagatgagttttttatgctactacagtttgtgatacagatttatttttcaccaagtactttttgttgagatctaggtctctattggaaacaacctttatagtgttaataaagtcatatactaatataaatgtatcaggtaaagaggatttttttttttcttttaagggcgagtgttgttttccaaatgcatatgaaaagcacaggtcaatttgtgagttcttcaaagtagtggtactctttttaatttatagtttgtccaaaaactgaaacattattttttacctttaaaaaggtacagttctcttagtaaataatgtttatttttattttctagatgttgtaaattttgatgacatagcttcctcagaaaacttgcttcatctcactgcaaatagaccaaagatgcctggaagaaggttgccgggccgtttcaatggtggacattctgtgagttcatctaattgtcgtaaactacagtatatttagcaaatgcagagtccattggaagatagaggacttatagctctacctaagtttgaaaatcaggaggatagctcttatactcaagtggcaaatgctggtatttaaggagatagagggagagaggtgtgttcattccaacagggtctggaatgaaaggttacagaatcagaaggaaattatcatgaggctatagccacagagcacagggtcaaagggtgacaaagaaagaacctgtttaatttatctttcaacaacagttattaaaattgagcagcagatactcactttaggaaagattgagaaaattttttcccctgaaatattcagtgttttttttcttttctttttttctaaatttttaaaattaacttcagcaggtacataatagatttgtatatttatgggttatgtgagatattttgatacaggcatgaaatgcataataattatatcagggtaaatgcggtatccatcacgtcatgaatttatcttttgtgttacaaaccatctaaattgtactcttagttatttttaagtgtacaattaaattatttttgactagtagttaccctgatgctaccaaatactaggtcttactcattctttctactttttgtactcattaaccatccccccatccctaccgccaccacactaacacccttcccagcctctgataaccatctttctgttctctatctccattagttcagttgttttaatttttatagtgagaatatgcaaagtttgttcttctgtgccaggtttagttcacttaacataatgaactctagttccatccatgttgcaaatgacaggatctcattcttttttgtgactgaatagtagtccattgtctatagttaccacattttctttatccatttgtctgttgatggacacttaggttgattccaattcttggctgtattcttgtgaatagtgctacagtaaacatgggagtgcagatatccctttgatatacagatttcctttttttggtatatacctagcagtgctggatcagatggtagctctatatttagttttttgaggaacttccaaatttttctccataatgattgtactcatttacattccccccaacagtgtacgagggttccctatctccatatccttgccagtatttgctattacctatcttttggataaaaaccattttaattggggtgaggtaataactcgtagttttgatttgtatttctctgatgattgttgtgaaatattcattgtttttgtagtacttgtcctcatgtctaaatgtattaacttctttgtatgctttttctacattgcctggagtactggtggtactgtaatgttaatgtattagctcttaaacactatagtacttttaaaattacctaaatggagaaaatccttactgctaagaggcaagctgtttttgccctcaagatatgcaaatgtgttattcagcttgaaagtatatagcatcctattaataataatgggatatcagcaacagtagcagctgaaaatccataaaagttatttgctttattatccaaagacttactaccttttcttttctttggtctattatgtctcttgacttctaaaaaatcatttagccaactcacagccccgaaaaaatcttgaagttaccaaaagaagaagacagtgccaacctgaagccatctgaattaaaaaaagatacatgctactctccaaaggtgaggtgcattgtggtctaaggtttgttgactttctgggattctttgtggacatcaaacatagggaatttaaggtgttctttaggacgaattattttttctgccaagaaatgaaataattgctgctaaaaaattgagttgtttagcttcatcagactattttctgcaaatgtttttgaaagagcttacattttaattgaataaaataaatattacatatttcatattttttaaggcatagatctctgcatctatttcgtttctccattaaacatacattcttaaggtcaggaatgaacacttgtatagtacttacctagcttggtgcttagtacaataattaagcattcagtatatactggaattaatggcagaatactgtatgtccatggatcctttcatctgttacatgtgttaggtgtcttgtcaaaatttttaccatttttatttaacatagtttcactacaactgagacatagatttaagaaggtcatttaggtttcctcccaaattatttcttgatttcatttcagggcatttttgtcagcgtttccaatttattaaatacacttaatctgattctctcagctgtcagcagtctattgaaattttattaaagtgactttctatttttttagtgaaatagttaaggggtgtcaggctatggactcattttagtgactcttcctggacctattaaattgttcacaattacttttaagtgaagctctttggacattccaaacaataagtattgaatatgaaagatcaaagtaatacctttataatgctgttacattcttgcccctgtttcactaggcaaaccatccataatatacatttgatggatttttctttcttccttttttcttctgttaataaaattgtcattttctacaaaaaccactaatgattacaaatgtattctttagttgtctggtgatttttccagttgtgaacatcaaattgcttttgaatttccaaatttgccacttatcttgaagtacttaattgtttttcttcttgctgttaaaatctttcgaacgtaaatataatattaaataaaatcagaaattttttttttacgttttcagccatctgtgtacctttcaacaccttccagtgcttctaaagcaaatacaactgctttcctgactccattagaaatcaaagctaaagtggaaacagatgatgtgaaaaaaaattccctggatgaacttagagcccagattattgaattgttgtgcattgtagaagcactgaaaaaggatcacgggtaagtagcccttcttttctcctatgagtactacttaacccatgcataaagaatttttttcaaaccatattaagtaaaaatctaatctgtggctgggtgtggtagttcgcgcctgtaatcccagcactttgggagaccaagtttggaggattgcttgagtccaggagttcgagaccagcctggacgacatgacaaaaccccatctttgcaaaaaaaaaaaaaaaaaagaaaagaaaagaaaagaaaaagccaggcttggtgacacatccctgtggtcccagctactcaagaggctgaggtgggaggatgtcttgagcctgggaagtcaaggctgcagtgagccgtgaacatgccagtgcgctccagcctgggcaacaaaaccaagaccctgtctcaaaaaaaagtctctggtatgagcaagtatattttcaaagaaattttcattaacagtccttttctctttttggcaaaaaagttaaattggtgaagttattctagtagctggattgtggaaaacgtgcatacataaccataattttaggctagaaatcttctggtcggatatgattagtttttaaactactaggaaaaatatcgtattttggatctggttgtgtatctatacatatagttaacttagttttcagaggatttgatcactgtttctgtgaggttgagttggacatttataaaatgaatgtgttgggataggtgatctctaaaactcttcccttaactctgaaaattttttgatatggtatatgttgagagataccctagttgaaagttagggactttttagagctaaaacaaatttacaagatcacctattataggtgagctccccctctggctttttaaatgaagaaattgacagagctagaactcaaacccatattatctgttggtttagagatgttttctataaccactagtatttgaattttaaaacttgttcacattttaagcacaattctacaaaagcccagtaggtaaaatatattttaaaaaaagcagttaatctaattgaaatgagagtgagggtgctcatcccttgtcttcaaattcccttctaaaaagatttcttggaatatggtacaaaagttatggccaaataaaaagtataaaagaacaaaaaataaaaataaaacataaatgttatggccagaggccatgttccctctgagcctgattttatcatttcttttccaattttaagttggcctaagaatcttattaaaaataatattgagattaacagtataaggtatttggagtttgcagaacactttcacaggtattccttagaaataaaaaatgtatcttgaatgactacttaaaaatatgttttatatattatgtatatagaggagtttataatttaatacatgatggtatttcttggaatccttcagtttatctgttttgaaagattcttttagtagattctgcaacatgcacattataagctgtaagtttacttgtccagtaaatatttattaatcaccacccatgtaccagttagagaattctcctgattcgattttgttgttttacattttttataccatgtcctgattttcatatgcatattgcctgtaggtgctcttaaattagctctagaacggataaaatatttctgatttatatatatatatatatatgtatttttttttttttttgaatataaaacattttggaagtctttccaaagggtattttcaatatcttgagtttctctggcaaagtgaaactgaatggcaggtttttttttttttaatatctaaaaaacttgcatcagcaggagaagggataaatactattgatatattaatagagaaatactacacagcatacaacaataaaagtaagtttcaacatcaatatgaattaatctaaacattgagaggagggagcaggtcagaagcatacacgcaatcagtgtatttcatttgtataaagttgaaaagcataccaaaccagaaaatatattattttaagaatgtatttgcgtgtggcaaaattagaacaacaaataaataataataaatactataaaactttttctatggaagagggggggaataggattaaggaaagagggtcgctttttgggatatccaaggtactggtaatattttatttctttacttggagttcagaggttttcgctttactcttataatagtagatctttatagcttagttatcactaagaaattattgccaagaagttagttttgaaacattatataaataattttaaaattccttccttatgtattttttcttcatgaattttttcttttttactttttcaagctgttatttctacagtattctcaagaatttttcaagtatttgttgagactgaaaatgtccatacttttgatttagaaatttgatatactaacatattcctcccattccttctgtctcattcctcgattccttccactccttctgtccccagaataatgaatcagccaaacaaaaaacctcgatatttgaataccaaatcacaattataaatatgaaaattttagcagcatgaaaatggtttaaaatttgtgaaaagacataatattgaatattcacttaaagctatagaaaaaaggacaactatatagaaagattagaagggaacacgggaaggtgaaaagatgagttgaggagagactattggctagagtttttaatttgtttggtttttggattttaatgtgttatttaatttttaaaaatagagaaagaaattcaaagtctaggttatgttaccagataaactgttaacttgccttgtattgtgatgtgttgatattcattttaccaaattgcttgggctttcagttttccaacctggaaaatgtatgatagccgaatatagaaaatttcttctaaaggttagatattatttctgtcttcgtgagctgctctgaatttgcttgatttcttgatctcagatttgtcttggttttgctgaatttttaactgttatattgaaccattctaactagagaatcttacatttttcttaattaacattgctattgcccttaaaaagtttttcccatgaactggtaggttaggtaacaaaaagcctgtaaacattagtcaaataaattatttaatcgaaagacttaacagtaataagtactttgtttttaggaaagaactggaaaaactgcgaaaagatttggaagaagagaagacaatgagaagtaatctagaggtaattaatttcttccagcattgagagtttagtgagcataaactggacatgtttttcccaacccaactgggtaatcggttcctgtacaaattatgctatactacttcagttggacatacacacaatggactactattcagtcacaaaaaaagaatgagatcctgtcatttgcaacaacatggatggaactggaggtcattatgttaagccaggcacagaaagagaaactgcatgttcccacttatttgtgggagctaaaaaaaattgaaacgattgaactcatagagatagagaacagaaggatggataccagagggtgggacggatattagtggaattaattagtggcaagggtattcttttgaaattggagtcagtcctcttaaaccctgcctctgctttatcaactaagtttatattttgtaaatcctttgttatttccacaatattcacaggatcttcaccaacagtagattccacctcacaaagctactttctttgctgatccaaaagaagcaactcctcatctgttcaagttcgatccacttttaattctcattgtcttgctgtttttaccacatcttcagttcttttctccactgaagtcttcaatcctcaaagtcatccctgggagttggaatcatcttccaaaatattgacattttgactttctcttatgaatcgtgaatgttcctcatggcatctaaactgatgaattttttccaaatggttttcagtttatttgcctacatttatcagaggaatcactatctatggcagctatagccttccaaaatgtgtatcttaaataataagaattgaaagtctaaatgtctccttgattcatgggctacagaatggatgttgtgttagcagacctgaaagtaacattaatctccttgttcatttccatcagagttcttgggtgactaagggcatggtcagtgagcgttcatattttaaaaataatccttttttttttttcctgagcagtaggtctccactgtgggcttaaaatattcagtaaatcatgctgtaaacagatgtgctgttatccaggctttgttgttccatttgtagagcataggcagagtagatttatcataattcttaagggccaaggattttcagaatgataaataagtgatggtttccattaaagccaccagctgcattcacctaacaagagtcagcctgtcctttgaagctttgaagccagggattgacttctctctagttatggaagtcctagatgatatcttctttcaatagaaggctgttttacctcctttgaaaatttgtttcctgtagccaactcccgtcttagctagatcttctggataacttgctgcagcttctacattagcacttgctttaccttccacttttatgtcatggagatggcttcttaaaccacatgaaccagcctctgctaccttcatacttttcctctgctgcttcgtcacctctgttgggccttcaaagaattgaagagagttagggcctcactctggattaggctttggcttaaggaaatgttacagttggttagatctgctatctagaccactcaaactttccttcatatcaacaataaggctgttaagttttcttattattcatatgttcactgcagtagcacttttaattttcttcaagaacttttcctttgcaatcaaaacttggctgtttggggcaaaaggccaatctcttgacctgctgtggctttcaacattgccttcctctctgagcttagtcatttgtaactttttatttaatgtgagagggatgtgattatttctttcacttgaacacttagagaccatttttgggttattaattggcctaattttattattaggcgtgttctatctcagataataaggaaggccaagtagagggggagagagtcagaagaaaggctgatcagtgtagcagttagaacacacatgacatttatcaattaagtttgctgttttatatgggtgccagaacaattacaatattaacatcaaagatcactggtcacaaatcaccattaacatatataattacagtgaaaacatttgaaatattgtgaaaattgtcaaaatgtgacacagtgatacaaagtgatcacatattgttggaaaaatggcatcaatagagttgctcagcacaggattaccacaagcctttgattgtagacaatgcagtatctgtgaagcacagcaaaacgaagtacaataaaaagaggtatccctgtagttctctcttctgtgcagttaagctattttcattctttctttgctcagggacaggactggtagtggtgacatatggctgtagattcactgcctcccatttaaacttaagagtttatcttaattctccactggtgattggcaatttcgactatttcctttatctttcttagctttctttttctccttcactaatgtttatgttcatttgcattattctttctgcatatctcagagaaagttgtatcctaccttttttagagactcttcccattgtttaagtatttcatactcccttctgttttttattctgcctgattacttaccctatttcttttgtcagcagtttgtagaacaagagagaattggggacttgcagttggaaaaccttggctcttatcctgagaatcaactaacttttttgttttaaactgtgtattagttaggcttagcattttttgcacattatctcattagacacacataacaacatgtaaggattattgttcctattataagattgaaaaaagtagggtttggaatgatagtattaggctactcttgcattgctataaagaaatacctgagactggataatttataaagaaaaatttaattggctcatggttctacaggctgtataggaggaagcatggttcctgcatctgctcagcttctggggaggcctcagggagcttttactcatggtgaaaggggaagtaggagcacacagttcatgtggcgagagagggagtaagagagagagtgggaggggccacgcagttttaaacaaccagatcttgtgtgaacttactcatcatgaaggggatgatccaaacatggatcatctaaacaccccatgatccaaatacctctcacctggccccacctccaacactggggattacttttaatctgagatttggtggggacacagatgcaaatcgtatcaatgattaagtaacagcaatggagctgaaatttaattttaattttaattttaatttaatttaatttatttatttatttatttatttatttatttatttattagcagtggtacgaactcggctgactgcaagctccacctcctgagttcactccgttctcccacctcggtctccagagtagctaggactacaggcgcccgccaccacacccggctagttttatttttgtatttttagtagagacggggtttcactgtgttagccagggtggtcttgaactcctgaccttgtgattcgcccgcctcagcctcccaaagtgctggaattgcaggcatgagccactgcgcctggcctttttttttttttttttttttttttttgagatgaagtcttgctctgttacccaggctggagtgcaatggtgcgatcttggctcactgtaaccaccaccttccaggttcaggcagttctcctgcctcagcctcccgggtagctaggactgtaggcacgtgccaccatacccagctaatttttttgtatttttaacagagatggggttttgccatgttggccaggctggtctcaaactcctgacctcaggtgatccacctgccatgaccctccagagtactgggattacaggcatgagccactgcacctggccttaaagatgtttttaacagaagcaaccaatcttcagaacctttgcacttcggtactaaattatactgtgtgaacttaggcaagtcacttaacctcctttagctttagttgagataatttatgtgaaagtactttgtaaattatcagactttattttatccttgtttccaacattatcctctattggcaacttcactactttgcatgaaaatacttgactttttccattattcagaatcaaagaatagcccccatttaggtctagctgccttcttgatgtactgcagttactttctcttttcacttgaggttcatttgtgaaatatgaaaacaactgccatcctcttaaaaaaagtctacttttgtggtctctgatttttcaccttcaattcagtctgtaaccccttgcatcttaggttaggtttactgatgccaaattcaaggtctcttcttcagtgcctgcaacagatcacattttttaccattgccaccctgtcaaaggtttgtcttggtttagatgatactacatcctattgtctctaacttctccatctcctcttccttctttttttacttttttaattttgtttttagagacagggagtcactctgtcacccaggctagagtacagtgacacaatcatagctcactgcaacctcaaactcctgggatcaagtgatcccgcctcagcctcccaagtagctgagactacaggcatgcactttcatgcctggttaatttttcagttttttgtagggactggttctcaccatgttgcccaggttgatcttgaactcctggcctcaagtgatcctcccactttggcctcccaaagtggtaggattaaaggtatgagccaccatgcctggccttcctcttccttccttgtaacctaaatgtaaatattccttcactggtatccttggcttttctgtttgagcattcacattttgaattcatctatactcatgaatctaatgattagctctagtgcctctcccctctaaatcaaattcgtattttcccagcttgtatcctgtgtttctggctattagtcccccttggatgtttcatcatgaacttagatttagcatgtccccagttaaatttatcatcttcctttcctgttcttttgatttcctgttgctgttgataatttctgttgcccatatagtcatatagacatggtaccttgtacatagttctcttctagttccattcacttctagtcctattagctttacctcctaatctttatgtctttatccccactgtatctgtcttgttctgatgcttactatcttctgcttagctttcttgagtactctaattcttatctcagattaacctttccttcatggagtactttcaagagctttccattacatgctgaataaagttccaacaacttactatatgaggtgtttttataatttggtcctagctatctttctttacttgctgattctccattgtgcctcttacaattgataagtccgaatttttattcttactgtgttttcttggattgtccttttgcctcatcttctaatgcccacgttctacagattctcaaggccctgctcaaacaattaccttcattaaattgatactagtctgtctctgattaaaagtaatttagtggccgggcacggtggctcacacctgtaatcccagcactttggaaggtcaaggtgggtggatcacctgaggtcaggagttcaagaccagcctggccaacatggcaaaaccttgtctctactaaaaaatataaaaattagctgggcatggtggtacacacctgtaatcccagctactagagaggctggggcatgagaatcacttgaacccaggaggcagaggttgctgtgagccgatatcatgccactgcactccagcctgggtgacagaacgagactgtctcaaaaaaaaacgagtagtcttccaaatttgcaagacttgtagttttataagagatgtatatataataacttcctatattttcactgttagggtatgtacttattctacctgtctttgagactgtaaggttgtttgggtaggatccatgtttttttttatctttgctcatagctcctaacacaatgctatatacatattagatatctaataaattattgacaaattaatgaaagtgtacatgttaaaaatatatcttaaattcgcagcatgtaatgtagaaattgagaaatttttaagcgttttttgacttttttcttacattttatacatacatgtttatattcatatgtgaaaataagataatgagacataagaggaacttaatagtgttaaatttgtatatctgacttaatttgccataaaaattatgacaagagtcaaattgtttctcttttggataattcagtatgattttatttttctagcaaagtgagctgttacttggcctctcactgacttgtattacaaatatattttttcttttgttgtgggcacagttttaccctgtatttgtaaaagcacacctaaggcactaaagttttagaataatttatttaaaggagaaagatgtttctccaaagattaaaagtagtactttactataatgttaacattatacagtattataatgttcactaaaaatgaacaatgaacatacaagtgctaaaagagaaactctagcaatgtatttgcctgataactaatttttttccatacattattggggtagaggtggtatttggttacatgagtaagttctttagtggtgatttgtgagattttagtgcacccatcacctgagcagtatatactgcaccacgttcgtagtcttttatccctcgcccccttcccactcttcaactcaagtccccaaagtctgttctatcattcttatgcctttgcttcctcatagcttagctcccacatgtccatgagaacatacaatgtttgattttccattcctgagttacttcattagaataatagtctccaatttcatgcaggtcactgcagatgctgttaattcattcctttttatggctaagtagtattccatcatatacatcacagtttctttatccagttgttgattgatgggcacttgggttggttccatgattttgctgttgtgagtcttgctgctgtaaacatgtgtgtgcaagtatctttttcgaataatgacttcttttcctctgggtagatacccagtagtgggattgctggatcaaatggtggttctacttttagttcttaaaggaatctctgcactgttttctgtagtgggctgtactagtttacgttcccaccagcagtgtagaagtgttccctgatcacctcatccatgccaacatctactgttttttgattttttgattatggccattcttgcaggagtaaggtggtatcggattgtggttttgatttacatttccccgatcattagtgatgttgagcatttcttcatatgtctgttggccatttgcacatcttcttttgaggattgtctattcatgaacttagcccactttttgatgcgattgttttttcttactgatttgttagggtttgttgtagattctggatattagtcctttgtcagatgtatagattctgaagattttttcccactctgtgggttgtctgtttactctgttgactgttccatttgccatgcaaaagctctttaattaggtctcagctatttatctttgtttttattgcatttgcttttgggtttttgttcatgaaatccttgcctgtgccaataactagaagggtttttctgttgttatcttcaagaatttttatagtttcaggtcttaggtttaagtccttaatccatcttgagttgattttggtataaggtgaaagacgaggatccagtttcattctcctacatgcggctagccaattatcccagcaccatttgttgaaaggggtgtcctttatgtttttgtttgctttgtcgaggatcagttggctgtaagtatttgggtttatttctgagttctctgttccattgatctatgtgcctatatttataccagtaccatgctgttttggtgactgtggccttatagtatagtttgaaatcaggtagtgtgatgcctccagatttgttctttttccttagtcttgctttggctatgcgggctctttttttgattcctaatgaattttagaattgttttttccaattctgtgaagaatgatggtggtattttgatgggaattgccttgaatttgtacatggcttttgacagtatggtcattttcacaatattgattctacccatccacgagcgtgggatgtgttttcatttgtgctgtctgtgatttctttcagcagtgttttgtagttttccttgtagaggtcttctgactccttggttaggtgtattcctaagtattttattttatttttttgcagatactgtaaaaggggttgagttcttgatttgattctctgcttggttgttgttggtgtatagaagagctactgatttgtgtagctcttatacccgaaacttcgctgaattgttttatcagttctaggagctttctgaaggagtcttgagggttttcaaggtaaatgattgtatcgtcagcaaacagtgacagtttgacttcctctttattgatttggatgccctttatttatttctctgctctaattgctctggctaggacttccagtactatgttgaagaggagtggtgagagcagacatccttgtcctgtttcagttctcagagggaatgctttcaacttttccccattctgtattatgttggctgtgggtttgtcatagatagcttttattacattgaggtatatcccttgtatgccagttttgctgagagttttaatcataaagggatgctggatgttgtcgaatgttttttctgcatctattgagatgatatgtgatttttgtttttaattctgtttatgtggtatatcacatttattgacttgtgtatgttaaaccatccctgcatccctggtatgaaacccacttgatcatggtggattatctttttgatatgttgtcagatttggttagctagtattttgttaaggattttaacatctgtgttcatcaaagatactggtctgtagttttcgtttttggttacgatcttttctggttttggtatcagggtgatgctggcttcatagaatgaattagggagggttccttctttctctatcttgtggaatagtgtcgaaaggattggtacccattcttctttgaatgtctggtagaattctgctgtgaatccatctggtcctgggcttttttttgttggtaattttttaattatcatttcaaatttgctgcttcttattggcctgttcaggatctctaattcttcctgatttaatctaggagggttgtatttttccagaaattcatccatctcttctaggttttctagtttatgtgcataatgatgttcatagtacccttgaatgatcttttgtgtcattcaagggaccagcagtgggcggggccgtagaactcccaagattatatgcccttagtcttccactactagggtgggtagggaagggccatcaggttggggcagggctaggcatgtctgagctcacgctcttcttgggcgggtcttgctgtggctgctgttggggatgaaggtgagattgccaggtcactggagttgtgtagctaggaggaatatggctgcctatgctgaatcatgctggttgtcagggaagtaggggaaagctggcagtcacaggcctcacccagctcccacgcaaactgaaggagcagtcttaatcccaccgtgcctcccccaacagccctgtttccagacagtgggcgagatgggcttgaaaacttgccccaggctacctgccttctagctgcgaaagaaaagggcttggttcttccctcgcctgtggagtctgcaaaccagatttgccgccctacccagagttgtggcctggaggtctctcgccccgttcaaattgttacaaagtttagctagagatttccttctccctgtggagttttaccccctgcttctctggctgccctccctatggatccctgtggtgccaggcaggaatggcctgcttggggactcagcaagctcccagggcctttcagctgcttcctctaccccccttgtattttgcttggctctctaaattgagtcagatccaggtgaagttggaaacttctgcaaacagaccttcagtttctccagtgcggggtgtgtgttcgggagaggagggtctccctttctcacttccgcagttgggacacacacactatttggggtgtttcccaggtcctgcaagagcagtccgctttcttcagagggtctgtcggtcctctcgggattgctggtttgttcttgcagtcggtctggagttaaaatacacaatgcgagtctccgcatgctgttctgtctggagccgcaatctagtcttgcctcctgtccgccatgatgatccctgtccagtgataactaaatgtatgtcacaaatagcagtttacaagaagtattgctgattatgcatgcagtagtagccttcacactccctactccctcttctaccaatttgtttttcttaccgctttctgtatctttggaataaagactttaataacagatcgggctgacaatgaaagctatcgtctcaatccaaattgaagacaggcttgttgtagtccagtgctgctaaaacattgagctaatcatcataatatttacagaatcatatcaaggaagatcctgaaattaataaacggttcttgagtagttataatcctttaggagattgtgaacatataaaaattatactttttgactatggcaaagtcctaatcgtttaataatgtgctgtttgtcgaagctagccaaagcatgtattgtttatgtgcactcttgaggaaggtgatgccatcaggataaggcaaggcctatatatttcctcatgcagggaaaggttaaagatgatcaaaatgttatagaattgagaagagaaatcaatataaaaaccatgggctttaaagccctaaatcttaccatgacaagtcctgtgtcacttgttagtgtggaacattggcatcctgtttaatgtctttgagcctcaacctagccatttgaatatggcagtattgaataactctgtgtagttattgtgcaaacttaatgaaatgatctccttcttcataaattccttaagttatgaatttccttctgcctaaaggtggaactatatcaagcaccttgactgaatcttagatatattcctgggctttaagatatttaatgtagtatatactggttacagataagtaaattgaaaccaagtcaagtgatttaacaataattataattataattaagtataattagtgaaaaacatggaactaaacaggtctctattctttttactgttgtttatgtatcctttgtttaattatagatacatgtacatttcttaatttggtttcaaggattcttttgttctttgtaggactgactgatttttttacagctttaattttaaatgctcacatgacttaacatttgttctggctgaaagggctataattgcttttttcttattgtaactgccatttaggaacttgcattgtactgttgaaactttattcaaccaaattatagcatgggaaactggattttaggtctggaaaaaaagtctgaaggcttgaaagtatgatcacatcttaatgacatagagtaaaataaactactaaactaaggatattttatgtttgctcaatttatgttttttgttttagatggaaatagagaagctgaaaaaagctgtcctgtcttcttgagtggtgtggacctggtgttcataatgttccagggattcagaagcaacgctatgaacttcagctgacttgttacttaaaaattgtgaattctgttgttgtgataaatatgagcaaatgaagtgtaatatctatagaaaagtagagtgagggtgaatttatatatatattttgttttgccaatatgaagaaaaagaggccttatttcttaactgtgctgggattgcaaacactttttaaaaaattgtttgcttgaaaatactactgaatataaataagaatgtgcacagtagtttttttattgaaacttgtattatttttaaagagatctatactataaatatggtgatatatttacaagtaatctgttaagatatactatttgagagggacagattagccttttagtaactatagtcactactttttccataatgcataagggatataaactctgtgtgtgtgtgtgtgtgtgtgtgtgtgtgtgtgtgtgtgtgtatatatatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaagaatctaaaactgttaatttaacccttaacttgtgcctagaaactacagcacatataaaatatgtaaacaccagcctgttgctgtacttttctgcttattttacagcctcaaatatttctcattatcttgtcacttagttcttcatgtttctccttctgacttttaataatggtaataggaaaacaaaacccaaagcttttcagaacttcagtgtgaggtttcctattttgacaagttaacttgtaaatactcaggttttacgatgtataatttacctaatagaccaaactaactcatggagatattttgaactattatttaggtacaaactttataaagaatgttagtatgtcataaaatataacattacagcttatttaaaaccaaatatagttgaacatatttaaaatacattttcacagaatggatgaattagttgtttcttcagagttacttatgaacagttgaatgctttaaaatgttctgtctgtaggtaacatctaaaacacaagtgggtttatttaaatttttaaaatttgaaattttttatttgcaaaaaattgttttatgctttattatatcgcaaatgagtgtcagatttttgagtaccaatgatcatgcttccattttttttagttttaaaccaccaaaccaatatttttcctttaaattttaatcttataatatagaaatcttatgtaaatgaaattttgtcatgtttcaaataaagagaactgaagtagaaaatagaaatgccagtaaacaacataatgtttaatttacaacttacattaggggtttgggggaatgctaattatatattgagaatatacattagaactcttcaaaatgggctcttctaatgaggtcactactgaacaaaattgttccctcttctgttaaatagaataggtttaaatgactagtcaaatgaattattttcttcttgttaaataaattaaatcttactttcttttaatgaccaaccttaggtaaaacaaaaatattgtaatcctagaaattatcctccagctttctcacctgaaaatctattgaagtgatccctggtcatcctaataatgggatgagggaagtttccagcagatttcaggctgttcttaaagtttttgttggtcattttctcaatagtacatgaaatcaagatgcttatgagcatggaaatgtatttaaagtttttgcttgtgtcctcctcagtcagaatagaaaagtaactgaaatacttttacctttctgtccttgataaaatagtaaagaaaaccaaacaaacccaggcctgatgggaaaaatgattcctttattctagcaacttactttctgttggtatgggaaatgttattaatttctattactaaagttcatatcacaaaatgatatttaataataaccttggggtaaatcatgaattttttttctacgtgtgagtataaaagacaaaagttgaacagcatggaatctcattgccaaattattagtgaatgtatagttcaggtattctttgagacacacagtatcattaatttctgaattgtatttcagtgttattttttgtttgtgaccactaagcttctgtcttaatacaaagctgttaccttctacagaatttaagtctgaagatgtaaagagagaacaggccttgtgtaacagaagatactcttttttatgctccttactgtgatcacagaaaaattaaaaatccaagtgctctctagatttgttgataaacattttatgcttgcatttaaacttgaaatgtatgagcagaatgagacaatcagttaaatcagaaatgagaagtattataatgtaaaggccttgttttgctgtagcaataaaatgaccaagtgcaatgacttgatttaataaaatcatattttaaaagttgctgctatgaatatttttggctataaaattttaccctgacttgctttcaataactgttacgtaatgcagttgatgttgtaacctaacattccaaaaaaaaaattgagagggggaatctcaaaatagtatatacttcactaacttgtttacaggtgctgtatttaaaagcatgcttctctctcaaaaagaaaaattaaaggattttattgccagtcgtgtcagtctttattggttattttttgttaactttagcatttgtgtatttcagagtatgatgaaaattatattacttcaatttccaaatacaagaataaatagtaaaccaaaaacattaaaaattctagacccgtatgacttttactgaacttttctgagtctggtttttcatctgaaactgagacagtaatttctactttacaggattatggggagaatttgaaatagtttatctaaatggctttgtagagtgcttggcatagagtaggttttttttaaaaaaaaaatggaggctgctgttttacctttttaaaaagcattttacagtgatggatatgataaaaattagatggataaggttaagaaaaaggaggcattgtgtatcctttccccctgaatacggtatagtatccttttctttggggagatgctcctttcatttgtattatattgttcaaaggggagctgctaccatcttacagattctacctccttgatcaccccacccaggaaatcccttgagagagtacttggctcaaactgagttactgagttaatcaaagaatgaaatttttaaaattggaaacaaaaagagctaatctcagcatgggagctctccacagttctgtttttctgtcatctggaaaaagctgatttgaaaaacaaaatttagtagagcatagatagatggaaacagaatctggaaggactttgaaactgattgtagctgttgctgagtctcagctgtctattgcttggttctataagcacagacttgctcataagcttgttgggtttctgaactcacaaccgaaaaagtcctgataaataacagaaaacaagatgaaatcaggagaacattaaggtccacatacttttgctgaacatagatcacatatagctttagagattctagtagtgtgctggaagatttgaaacagaaggaataggacaccactataaagcaatgtggaaaattagtgtgtcataagatttttaaaatcttatttaaaaaatttctagttcttactggcttttagaagcactagacaaaaaactttggaggcatataatggtaaaagttttggactatagaatttgtgtttgaagagtgcagatggttttgtctgaaaatacaatttgcaaatttagcccagttctaggaaataaaagcaggtagcagtttaactcacctggatttattaggctgtattctcaagatgcaagagagactgggtctgggtgttaaaatttttttttctgaatcctgttgcatttattttaccactgacaccatttttgtgaatctgctcttccatgtaaggaaaataaattcacaaatagatatcagtattttttgtatagagtcaatagtttttttctgtcatgaaaggtgtggctattttgcaactattggatggtattatttcctatcaggttccaagtgtttcttactgactacatttcagttccctttaaaagtgtgtgaataaagttattgaaagtaaaactacattttaagtgcattgagaaacttttttttttttttattccagtcagggtccttctctattaccctggctagagtgccgtggtgcgacctcagctaactacaacctctgcctcctgggctccagcaatcctcctgcatcagcctcttgagtagttgggactacaggtgcatgccaccacacccacctaatttttttttgtttgttttgtttttgatactgggtttcaccatgttgcctgggctggtcttgaactcctgagtt

SEQ ID NO: 12684 - DNA, 20902 bp, Human
agtatccaagagaaaagggagggaggtttctctaaaacaagacctaagagaaggaacattattgtctagaaagaaagaaataattgaaagtttctgaaaattgagatttcttcatttcaaatgaccttattattagcctgaaaaagcacacacacaaaaaatctcttccttacgtaatagtaatggtgggaatcaaaatgaatccatagatggtggatccagatgggaatgctgctacacgatagtagaattgttctgggaatccacagtgggaaaggatcagttgtagcaaaaagatccagagttgtgcagagggaccatgtcagcagtgatcacttttcagtaaccgtgctttcctgatcatcattttagcatcactgtttggcaagactgtggatggtaggagtggataccagttttttttcactgcctacatatgcttcataagctgtattttgtcttttttcctctacagacctctgtcttctttcctttcatgcccgtaatttatcaaatagatatggttttaatactttgctgatttgacatagcttcctttttcatttcattgattgctactaaaagatgcacaaggctttcaggtcctcacacgaatgatgagataagatccaacatcaagaatctgaagcaaagacactcgtggtttcagaatctataaacagagtttggtaaggccgggtgcggtggctcacgcctataatcctagcactttgggagcctgaggtgggcggatcacccgaggtcaggagttcaagatcagcctggccaacatggtgagacccagtctctactaaaaataaaaaaattagctgggcatggtggtgggcacttgtaatcccagctcctcaggaggctgaggcaggacaattccttgaccctgggaggcggaggttgtagtgagtcgtgattgcgtcactgcactccagcctgggcgatagagttagaccccggctcaaaaaaaaacaaaaaaaaatagagcttggtgattttctgttgagtttgagtttgttggaggaatgcataatgattaggattaggtgtttttctattttaacaagttgacttctagagacatagaagactattctgacatgctacttaaaatttccatacaaattcaggcatatttgtaaaaaagaaaaaaatatcagtgcaaaataagcaagatcacatgagacaactgaaaggcacaaatactatccagatgttttttgttattgcccatttattttggccagtgaacatttgaaaggcccagatatgaagttcagggaccatgcactttgtgtctctccccagtattaatgcacttacatctatctgcttttctcttttagtggaggagataatgcctgttgtgtacagcaagacagtgggtcattgtgtatttacagaagtgatgtggattcctcccagactcattagtgaccagggctgctgggcctgtttgggtttcctagactagagaagaagacaggaaccaggatgggaagacggacatgttacattttaagctggagcttcccctgcagtccacggagcacgttctcggtgtgcagctcatcctgactttctcctatcgattacacgtgagtcagtccgctgggaggctgtcctctcccttgtgtctttttagtagaccagagtccttcttctgatttctagaagacccgcactctagcgggccctcttccccatgtagtttgggatttaacttaggccaatggaatggttttcactagtcatattaactgacatgggctattaatagctcagaaggttctaggcagtgtttcctgcatggctacgctaggtatgtgagggcctcttaggtttcagccaagacaggtgactcttagcacccagagcccttcagatctgatggcggttggtattgttggtccttctaatgatttcagaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacgtaagagcgcttctcattgtccagctcctttgtttctctgtgttactgttcattaagttctttaaagaggggaatgaaaagtagaaatgtcaggccaggcgcagtggctcatacctgtaatcccagcactttgggaggcggagatgtgcggatggatcacttgaggtccggagtttgaaaccagtctggccaacctggtgaaaccctgtctctactaaaaatacaaaaaattagccaggcgtgtggtgcgtgcctgtaatcctagctacttgggagactgaggcaggagaattgcttgaacccaggaggtggaggttacagtgagctgagatctcgccactgcactccagcctgggcaacagagcaagactctgtctcaaaaaaaaaaaaaaaaaaaaaagaaaaagaaaagaaaagtagaaatatcatttctttgtgggtggcaccaaagagggtctctgtagaattcttgccatgaattttttcaaactacagagaaggtacacgcatagttacacctagaagggaagagaaacaaaatctgtgtttgtcgaagaactaaattgcttattgcttttaggtccacgtgggtgcacacacacacattgtgtcttccatacacacgcttggtcacacgcaggatgtactccgaaggacactgtaaaatgatgatgtaaaatgttcatgtaaagtatttcagaaatattactagccatagtttactgaactcataacatatgccacccctgagtgcaggcgtttacctatatcatctcctttaatcatcatggcaacctctgagctgcctgcattgtcctttccccgcactccagccacttgtcccatcactgcccccgcttgctcccttccagcccccctggcctttttgctgttcctcaaacccaagaagcagctgccacctcagggcttttgcttttgccatttcctctgccaggcatccatgtggcttatcggaccatgccattcaggtccctgttcagatatccccaagcccagtccttctctgacctgcttctacagtagcagcccctccttccaccattcctcagccagactctccctcctgccgcctggcctactcaggatatgtgtttgtgtgtttatttgctgtctccctcagccttgacagcagtggcatctcaaatactatcacatccgtgcctagcacactgcctggcagatggtaagctcacagagatacttgtttaaataatgaactcattttgcagaagacgtaactggggcttaaagtgattaattttcccaaaggctcaaatcttgaaagataacagagcctgtctgtgtgcagaactcatgcatctaatcactcattcctcacttttattttatcacaatggggaccatagaagttgagctgaggtacttctgaaaatgaaaaagggatgttatcggttattacagccataaacccagacttgtagatatatagtgggttttactgttgctctgactataatcaatataagttgtaaagaataggaagctgcaacatatgaaatgaatatggcactttttgtttgaatgtctatatatcagattacattaacagcaagcaattatttcctcctttaagggattatatgcttatggtttgcattttatctatatctctatatttaaaagtgataaagaacttagcacccagaaaagaccaagaaaatgacaaaggagttggaagtatggtttcttttttttgtctttgtgtaggggtttttatttgtattttatttttatttttgagacagagtcttgctctgtcacccaggctacagtggagtggcatgatctcggctcactgcaacctctgtctcccaggcttaagagatcctctgatttcagcctcctgaatagctgggattacagccatatgccaccacgcctggctaatttttgttttctttgtagtagagatggggtttcaccatgttggccagactggtctcgaactcctggtctcaagtgatccatctgcctgggcttcccaaagtgttgggattagaggcgtgagcttccatgcctggctttttatttttttttatttttatttttttttgagagatgaagtctttctctgtttcctaaactggagtgtagtgagtggcatgatcatcattgactacggccttgaactcatggcctcaagtggtcctcctgcctcagcctcccaagtcactgggattgtaggcatgagccaccacacctggcgaaaatacggtctgttaaaataatttaaggaattctttctcccgctgagataaagaggggtattttaaaaatagctttaaaacctgtaaaacatggacactgaccccttatttccatccacagaaagaaagactgagagtaaatgggcttaaattgttgcaagagagtttattcatctttgaagagaagattattgatactgcagtaggccaccaagaacaagagggtgctctgtgggaccagcctgggtgggcagcagcctgttttattcatctttgaagaaaagattattgatactgcagtaggccaccaagaacaagagggtgctctgtgggaccagcctgggtgggcagaagggtagaaggaaaaggggaggagtctcccaggtgctcacaccacatcctcctcccgtgtcccagatatccgtgatcaacgggaccagcccctttgcctatgactacgacctcacccatattgttgctgcctaccaggagaggaacggtgagtcacaggtagagcccattcagccgctgctcaggactttcaaggttagtgggggcaacagagacaagcagaactggaacccttgtgatgaaaatgtcaaaacccgtgaatgctcaacgatgggagcaaatatgctgtccaggatttgtctttttcgtcctgatcttcagacctgggaccgcccccacccctccagcatcccatggtccagcaggctagtgatggttaaatgccatcattatcccaccactggcttagtgggtttctcttttaaaaaatataagcctaattgagttgttccccataccacacctatccacacctataacagatgccaaagacaaattgctgttcatgcttttcagagaaaaacagagaacgtgggtgactctccccacattagcagtccagcaggagaacaggagtgcccctgtttcctgccagaaggcacagtgtgcttattccttacagagctctaggccatggcatgtgtggactcggcacgtttgtctggtcggtggctgaggttttctctaaaagcatctacagtgttacttggcaagcagacatcatggagactatacacagacgtctcacaagggggatgactgcaaatccagtattgcttactgattttatggcatatactagtggcattattgcaataatagagggaattttaaaacaaaagtagaaaacattgccctacaaatcaactattttttcattcctttcattctttagccttctgcagatctttttatacagccattgtagtgtagaaacacattgggatccaagttacttttatttatttaaacttggaatataaatacttccccacacagctacaaagctgtgatactacttttagtggcagtatagtattccttcagttagccattcagcacatgtagaagaaactctttccaagttttttatgtattttaacaaaagtattttgactattattttaacaaataatgtgtgatcagctttgcacatgcaatttctctttccttccgaatgatttctttcagttctgaagcacaggataatttccaggtatcaaataatctttatagccttcaactgccagagtcaaacagccatcgtggttaatggttaatgattgcattgcagttaccaccgtcctgaatgatcccaaccccatctggctggtgggcagggccgcagatgctccatttgtgattaatgctatcatccgataccctgtggaagtcatttcatatcctttctgttaaagagtccatgttaaggctggatgtggtggctcctgcctataatttcagcactttgggaggccaaggtgggaggatcatttgaacccaggagttcacaaccagcctggccaagatagtgagtccctgtctctaccaaaaaaaaaaaaaaaaaaattagccaggcatagtggcgtacatgtgtagtcccagttacttgggatgccgaggcaggaggattgcttgagtccaggaattcaagcttgcagtgagcgatgattgtgccactgtactccagcctcggtgacagagtgagaccctgcctcttaaagcaaacaacaatttaaaaaaaatcaatggtagctcagttttcaaagaggaatgattccttagttgtctcaagtagtaacagacgtgggaggttttctcttggaaatcatgacagggttatagcctcataaaaatggctgcgtctttgacatcttaggctacatgtctcagaaaatgactgtatgtctgctattcatataggaacaaataattcatgtcttggtcctatttgtttccaagcaattcttctaggtaagaatcatccatatttatgtcttaataatcatatgatatcccttttatgctaaggttatgtgaaacattcttgccagtccctgtctgacctaaactttggtttaattttgacttaggtcgactaatggaaaatgaaaccaacaccaacactgcagagaagcaaacaaaagagaaggcattttaactggggtcttaggaattacaattccagagacacaaacctaggaagcagctaaattgtgttccgtacaggtgcaattaggcaggggctaagggtgttccaagtttacacaactggaagattttagaagatggatggatggctggttaacagctcaggatatctctagtccatgatcaatctagtttggcatagttgtctgtttaggaggttggtcatcaggcttggtatataaatagctcaaatcaaatgtggctggttttaccatttggccaagttcaggtcagcttccatctgggtgtgtacatgacagaggtcctgcctcctttcgagatacctctgccacagccaattccatcttggattttctcttcatacttaacaccatgtggcccttcactccttaactgtccatacttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcagggactagtttgtggaaaggtctgagagttcctggaggctataattagctttttgggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatctttgccgtactgtgactgggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatgaggccgagcatggtggttcattcctgtaatctcaacactttgggaggccaaggtgggaggatcacttgagcccaggagcttgaggctgcagtgtgctatgattgcaccactgtactgtagcctgggtgacagagtgagaccctatctgttaaaataaataaataaataaataaaaaagtcaaaatggaagatcacatgtacctttttcgagggaaagggtttggaatggcaaagaatagggagggcagaggttgcacacacctgtctttattactcatctacagccatgctttacaaggctctgcctaacgaccttggaacttccatgaggtctttggtgaaagtcccctagttcttccccaggtagatgagttttcagtgggattcacatgccatgtgaaatctacgtgttggataattatgactgtgtctggtgaatatgaaattatttacagaccagatgttgatagtttctgactctgaatcacagcatagctgcaagaggtaaataaaaagcaagaggccgggagcggtggctcacgcctgtaatcccagcactttgggaggccgaggtgggtgaatcacaaggtcaggagatcgagaccatcctggccaacatggtgaaaccccatctccactaaaaatacaaaaattggctgggtgtggcgacacgtgcctgtcatcccaactatttagtaggctgaggcaggagaatcgcttgaaccctggaggcggaggttgcagtgagccgagattgcgccactgcactccagcctggcaacagagctagactccgtctcaaaaaaaaaaaaaaaaagaaatatagaggattttattaactcagctccgacccatagctaagttaaggtttgatgttattactgaatatttggaggcagaaagactcctgattttgccaaatgattagtacagtttcggcttaagtcagatgaggcccccctaatattccatcatgtaaggctaataaagcaattatttcttttttttttttccttccaacttttattgtagactcatggggtatatgtatgggtttcgtatatagctaaattgtacaacctgggggtttggtgtacagattatttcatcacccacgtaataagcatagtacccagtaggtggtttttcttttctttttctttttcttttttttttttttttttgagacagagtctcactctgttacccaggctggagtgcagcagcatgatctcagctcattgcagcctctacctcccaggttcaagtgattctcctgccttaccctcccgagtagctgggattacgggtgcccaccaccatgcccggctaatttttgtgtttttagtagagacagggcttcaccctggtggtcaggctggtctcgaactcctgacctcaagtgatccatccgctttggccacccaaagtgctgggatcacagcagtttgatcacagaagttattatggttggcattctggcacacatctttctaatcttttttgttgtatgtaacctttttagtatcacaaacaacacttttataaaccttgtgtagaaatcattgttgctggtttatttccttaagatacattcagaaaacttatgaccattgttaaggatcttaattcattgccaaaccacagccaggaaagactgctaatttctactcccagcagcagggactcctcgtttcagataccaccatggattaaaggacctcccaatgctctatccttttcagattactggactctgcccgtttgtttctttgtttttgagatggagtctcgctttgtcacccagtctggagtgcaatggccccatctccgctcactgcagcctccacctccggggttcaagctattctcctgtctcagcctacctagtagctgggattacaggcatgtgctaccatgcgcggctaaattttgtattttcagtagagatggggttttgccacgttgaccaggctggtcttgaactcctgacctcaagtgatctgcctgccttgcctcccaaagtgccgggattacagtcatatgccaccaggccaggctgagctgttatttgtaaggggtgggtggggagcttttatttactgaaacatatcctgtattcattggaacatgttatcaagcctgcgcctctgggcggaggctagggcagggagggcacagctcctaaggccacctggtctttcaactcctcccagctgggacactgcaccgggaggcagcacggattcctgtgtcatcaaggtgcctgggtcttggcttagggctgaggttggggccttgggaagggtttggattccaagtcccttggctgcaaggatgcccccaagagcgaggagggccaagattaagattcgacttccttcactagggcctttgtcctcccaggagctcccaggttctctggcgattgggggggtgaggaagggttacaacgttcatttgtggtcagttagatgagaagtgactctgccagcgtcctttgacatccccggctaaaaggtgcgcctcttagagccccagcccacctgggccctcctgctctgccctcggccagcgcccctccccgagacatggcccctcggtcgggggtggggagagggagctgggggcaaaacctgctccttccttccttctcccatttccctggctcccgccggccaccctgggaccgcagccacgtctgaaagctcctcaccaggcagcgctgaagattgcggggcagcgccgagggttgttggccggcgcgcggggagtagagggcgcgggccgcagtgccgggctccggagggagctctgcgccgggtccttccctgtggtagccccaggacacccccatcctcaacatcccattctgggactcctgccctgttcccagattcgctctgcctcgagtctccaggagcttccagtggcttggttacccccgactcttcgtccatgcctcttagagcccctttcccagcctcactgggtgtcccttaatagtcttgggaccttaaggagcaagtcagcccctgcggaacctcccagtgaagagaaagagctggctgtgcggtggaacttggaagagacgacgtctgggagcttttgctgagcccagggggagaggcgtccctctggctgctgctccagctctggcagacacgccaagctttgaggtactttggttcttcattctccaccggaggtgtccccacactcggttgggctgggggccgggccagtggcccagctgtgacgctcctctgtcctgcaccagagacctgggttggcgggaagagctgggggtggcttttccatcagcaacgtggaaagttcatctcccctgctagcgctggtttggaagtgtcttgctggggcttcggctgcacgcgggaatcctcactgcgcagggcaggggtcggggtgcgggttcttattccatacttgggtctcaaagggtgtggctttcaaaagctctccatgaaattcttgagaaaaaatagcttggtgagttaatttgcaaccagactcaggggaagtggagtcgtgcctcactgcctctagggccttgatgttaggctttaggaaaggccctctgggccccaggacagtacaggtgcctaggaaatgtttttttgtttgtttgtttgtttgtttgtttcgagacggagtctcgctctgtcacccaggctgaagtgcagtggcctgatcttggctcactgcaacctgtctcctgggctcaggtgatttcctgcctcagcctctggagtaggtgggattacagacgcccgccaccacacccagctaatttttgtatttttactagagacggtgtttcaccatgttggccaggctgtccaattcctgacctcaggtgatccgccccgctgaggctcccaaagtgctgggatcacaggcgtgagccatggcactgggcccaaatttttgtttttgtttttgttttttcagatggggtctcactctgtcacagagcctggagtgcaattgtgccatctcggctcactgtaatctccacctcctgggttcaagtgattctcctgcctcagcctcccgagtagctgggattataggcatgagccactctgcccagctaattttagcgatggggtttcaccatgttggccaggctggtcttgaactcctgacctcaggtgatctacccatcttggcctcccaaaacactgggattacaggcatgagtcaccgcacctggcctaatttttttttttttttttttttttttgatatggagttttgctcctgttgcccaggctagagtgcaatggcacaatctcggccactgtaacctgtgtctcctgggttcaagctactctcctgcctcagcctccaagtagctgagattacaggcacctgccaccagacctggcctaatttttgtatttttagtagagataggttttgccttgttggccaggctggtcttgaactcctggcgtctggtgaccacccacctaggcctcccaaagtgctgggattacgggcgtaagccactgtgtccaatgtctagcaaatgcaaatgttgacttcctttctctctccttttacacagaggcaaggcagtcaagaattgcattttggccaggcgctatggctcacgcctgtaatcccaacactttgggaggccaagtctgcgatgccctcatctctacttttttaatttcgtgtgacctgtttgtattatttttctaaaaattaaacatgtaataaatatgtgcccccagaaaagaatcaaaaaacggaagaatttagaggggaaggggacagtccttccaggatggaagagttcactggacaaaggcttaggagtgtgacccaccacagggccctgcactgggagtctggctcttggacttaagcccctgccctgcctctttcttactgggtattaatgtctctgagccccactgcttcaattaaaacagatagggatggttatttctacctccaagggacttgggaggataacattcaatcatgaagatgaaagtgcatatcacagggcctggctgactggttctccctaactttgcacccttggccaattgtccactgtgctgaatgtaagtctccttatcagaaagctcccagtgaggaactggtcttctggagactctgtgtggcatagagtgattcaaccaccttaagaagacctctggctttcctggaacacaggtaacaaacaccttagcttgggatcaagatcctccctacccagggaagggctgggctggccaggacaactgtgtttgggccagagcagcagggtcctgcactctgcagggggcaatcacaggtgggagaggcccacagcctgggatcagaagtgccaggagcttcggaacaggagtcctggagtcccagctttcttgctgtctctctaagccttgagtctttcacctgaaaaattgacatcatcatgcccacctcagggcccagagttaagttatccagtggactcgaagcacctagcacttgtgatcattgaagtcagcaaatatgagttcccttcctttctggcactctgttggcaagggagctcaccatccatcagccagcactggaaaaagtacagttgcacttgtagcggaggtggggggctactctcctcatcttccaggttttccaggagtgggtgtggggatccagaaggcagctcgggagtcagcaggtgacagaggtgttgggcatcctccgctcactcctgtccccgcattgaggcgaaggagcagaggtgagatctgctcacaagttagaccctggcttctctcagtgggcagtgtggacaggggaagggggcaggcaaggagcaaaggatgcaggagcaaggagaaaacttccaggctcctcccttccaaagtcacccagccttgagatcattgcagatgcaacaggtgcaaacagaagaacactttaggaccttggaatgcgggaggctggctcagtgttccttccaccctgtgagaaatgcgtgacattcttaaggtccactaaaggctcagggtggttggacgccagaggatggcctgggagatacagggattggaagggtaggtggcctgtgggtgtctcctctgtggggagactcaccaggtggagggggttctttctctccagatgtagctcagcacagggacagtaacagtaacaggggcatgtgtgtaaggaatgcttccccaggccctcccctcataggtgtttgcagcagcatccatcacaacagctctaagaggttaaatattgcaaatcccattctacagaggtgcaaattgagcctcagagaagttaagtcacttgccccaggtctcatagctccccattggcagtgctgggatttggagccagctctctcgcttccatccatcaggagaccccgccagttcccagccatttggagaaatgccctactcagacttattcaacctcagcaagcctggtggtggtgtgacatccgcctaaaccgtcatcaagccctttagctccacaacccaaaagggtctctctacgagttatcctgaagcaaaaggcaggcaggacagctctgttcccaccctggggagctttctatgtacagggctgtctctctgtagggctctgatctcctctccttcctgctttgccagatgtcgagacatctcccatggatttgtgatcagcgttgcagctctcccagcagccctggacggtggtgagtcccctcagctggccaggacagtactctgctctcacctctctgcttcttgggctccatcccagctccccatcaactgatcttcttgcaaacccacagggctccaggacaccctccttctggagcccatgctgcctacagcacttcactccccaccagtgatgacaacagttgctgttctttgtccactttatttacttgtttatctttaatgacaaaagttttttttttgttgtttttttttttttttttgaaacggagtctcactcttcactcaggctgcagtgcagtggcgcaatctcagctcactgccacctctgcctcccaggttcacgccattctcctgcctcagcctcccgagtagctgggactacaggcgcccaccatcacgcctggctaattttttgtatttttagtagagatggggtctcactgtgttagccaggatggtctcgatctcctgacctcgtgatccgcccgcctcggcctcccataatgctgggattacaggcgtgagccaccgcgcctggctgacaaaagttttatacctgcctgttaaaaaaattatataatacagaagcacaccttgtaaaaggtgcaatcctcagttatgggcatgactgcgtgttcccttcccccatcttcattataataaccccccaatccccccagatcctgtgagccaggtaccggaattatccctctttcacacacgggtaaagtgatccgtcacagagagatttaagtgatcttcataagcaagatcataggctaggaagtggcagagccaggattcaacctcggcgagcctggtggtgctctgacatccaccgaagcccccatcaagcccttttagctccacaacctaaaagggtctctctaagaggtatcctgaagcaaaagacaggagttctctttgaaacatagtatttctctctacagatagatagcctgtaggtatgtaagtaggtgggtgggtgggtaggtagacagtttgatgatatcccacattattctgcaactggacttctgctgtgagcacagactatattctggcctatgtcttgactccgtattcctgggaaagtgctcgactgagaccttgggagtcttgggaagtccaatgggtagggtagccgaatctgagggctgatccctgagggcactgggcagtaattggggcatgggatgggcatgagggcccgggtccctaaagttgcccactccacccgaaggcccccagccgcccgcatgtggctgccacggttctccagcaagacagtgacagtgctcctcctggcacagaccacctgcctcctgctcttcatcatctcccggccagggccctcatccccagccggcggcgaggatcgtgtgcacgtgctggtgctgtcctcgtggcgctcgggctcatccttcttgggccagctcttcagccagcaccccgacgtcttctacctgatggagcccgcgtggcatgtgtggaccaccctgtcgcagggcagcgcggcaacgctgcacatggccgtgcgcgacctgatgcgctctatctttttgtgcgacatggacgtgtttgatgcctacatgccacagagccgaaacctgtccgcctttttcaactgggcaacgagccgcgcgctgtgctcgccgcccgcctgcagcgcctttccccgaggcaccatcagcaagcaggacgtatgcaagacactgtgcacgcggcagccattcagcctggcccgggaggcctgccgctcctacagccacgtggtgctcaaggaggtgcgcttcttcaacctgcaggtgctctacccgctgctcagcgaccccgcgctcaacctgcgcatcgtgcacctggtgcgcgacccgcgggccgtgctgcgctcccgggaggcggcgggcccgatactggcacgcgacaacggcatcgtgctgggcaccaacggcaagtgggtggaggccgaccctcacctgcgcctgattcgcgaggtgtgccgcagccacgtgcgcatcgccgaggccgccacactcaagccgccacccttcctgcgcggccgctaccgcctggtgcgcttcgaggacctggcgcgggagccgctggcagagatccgcgcactctacgccttcaccggcctgaccctcacgccacagctcgaggcctggatccacaacatcacccacgggtcggggatcggcaagccaatcgaggccttccatacttcgtctaggaatgcgcgcaacgtctcccaggcctggcgccacgcgttgcccttcactaagatcctgcgcgtgcaggaggtgtgcgccggcgcgctgcagctgctgggctaccggcctgtgtactctgcggaccagcagcgtgacctcaccctggatctggtgctgccacgaggcccagaccacttcagctgggcatcgcctgactgagaactctgggccttagagcaggccccgaactgtggtcgccaggcccaggaggcgactgcatggtggagagggagctggggcgcatggggaagcaggtccctactatcaaccgggagtttggggtcctcccctgaagtaggcaaggactgcacgtttctttctctcctgattctcggttttcctttgagtcttctggagctgccttctcatcaggtgcactcttcatggaaagcaactcttgcccctacctcttctgggcgcagggagtaagttactgctaaattaaattaaatgtgtgccaggccgggtgcggtggctcatgcctgtaatcccagcattttgagaggctgaggcgggtggatcacctgaggtcaggagttcgaaaccagcctggccaacatagtgaaaccccctctctactaaaaatgcaaaaattagtccggcgtggtggcacactcctgtaatcccagctacttaggaggctgaggtgggagaatcacttggactccagaggtggaggttgcagtaagctgagatcatgccactgcaccctagcttgggtggcagagcaagactctatcaaaaaaataagtaataaatttgttcaaaagtcctgcaatctagtgaactgtaacctcattttttctctcttttttctttaattgcatgattccatttatttaaagcagaaaaactagtctatggtgatagaggtcagaataggggatactttgtagggaggatttgactgggatgtaaccttatttattatgtaaacaaactacaacttgaccaggcagtatattcttgtaagaagaaaggagtcttctccaatcatagcagccagccttcagccaggggcagactgcagactgaccagatgtgtccaaattagacaaaggttgagctgtaaccaatcagcctatatccaatgccacttcctttttctgtttataaacgctgcttgcccactgttgctgggtggaggtctctgaaacctctctaatgtagatctctcatttaatggggagggtttggcctttaatcaccatcatccctgaacaaagactgaccaattggactcaaatgctattgaactatctttattgcatggactttgagttatttgattttgactagttgtttgttgaaactcctgataaggagtgtacttcagtttcttggcattgtccactcatagccatcataatagtctccctggtcgggcacagtgactcacgcctgtaatcccagcactttaggaggccaaggcaggcagatcgcttgagctcagaagttcgagaccagcctggccaacatagtgaaaccctgtctctgttaaagatacaaaaaatagccagtgtggttgtgcatgcctgtaatcccagctactcaggaggttgaggcaggagaatctcttgaatccaggaggtggaggttgcagtgagccaagattgcaccactgcactccagccagggtgacagagcaagactccatcttaaataacaataataggccaggcacagtggctcaagcctgtaatcccggcactttggaaggccaaggcgggtggatcacttgaggtcaggagttcaagaccagtctagccaacatggtgaaaccctgtctctactaaaatacaaaaattagccagtgtggttgtgcatgcctgtaatcccagccactcaagaggttgaggcaggagaatcgcttgaacctgggaggtggaggttgcagtgagccaagattgcgccactgtactccagcctgggtaacagagcgagactccctctcaaaaataataataataataaaataataataataatagtctctctgatgtgttgactcccctgggaagtcttacatactcctatgcagccattctttataaatcaactggtctgttagggttagagtaacaaaaacatgaagaaagcataaagaatcattcaactaaggtgaaattgtgaagtcaatactgaaacaaaacaagtccattatgatggtgacaggaaatggagtcagggcccaaggttttggtcaatctctcaaaattgagaggctgaccaaaaggcagaaatgtttaaattcaattaaatttggcccaaagttcccagcactttgggaggccaaggtgggcggatcatgaggtcaggagatcgagaccatcttggccaacatggtgaaaccccatctctactaaaatacaaaaaattagccgggcatggtggcacatgcctataatcccagctactcgggaggctgaggcagaggaatcactagaacccaggaggcagaggttgcagtgagctgagatcgtgcactgcactccagcctggtgacagagcaagactccgtctccaaaaaaaaaaaaagagaatttggcccaaagctgctgccatacctgttgaactgcaacctaacttaatatttaagtaaactgcctcccaactgagactatattcttgtaacaaatagttgaatctcagcaagtcacagcagctgtgctttaaccagtcacaggctgccaactgatcagaccaagtccatataaggcaaatgctgagctgtaccccatcagactgtttctctgtgttacttccaaaaaattcg

SEQ ID NO: 12685 - DNA, 161900 bp, Human
  misc_feature (1)...(161900): n = A,T,C or G
aggattgcttgaacctaggagttcaaggttgcagttagctgtgattatgccattgcactccagcctgggtaacagagtgagaccctgtctgaaaaacaaacaaacaacaataacaagaaatcgaaaataccacaatgccttaaatattatttaaataaaggtttgggttttatccagtaggcagtttggacccaatgaagaatttcagggcactgagtacacatttgtgtattagatatatataattggtgggtcctcagacttcaccagctcatggttttaagataaggtccatttctcctactgggtttctctcctcaaacaattcctgagactccctaaggtatccttgcctgtcccacaaagccattgcagtgattgctcaacccgtctgccagccatcctcagtccaaatagtcctgataccgaaggcctggggtcatattataccatcccttaactggcttcttcaggcttctctgctcctgctatacctatctgccaccacatcccatcccatttccacctactgatgctcttaactccgtaaatactgcacagctaaaaacaacctgtggtattaaacaaaacttcatagatatacagaaaagctgaagaacagcagagaatgattgatcttgctttacaaggggctagtcttagggtcagccccaaatctgaactcaggtccttctacttctcagcaggtctccggggcattacccaccttgagaacctctgggcctattatctacactgtctctgcctaggttcccaatacccttgggccaaggaagaggaagaggatgtttccttccccaaagcctgtttattttcacccccagaataaatgagtgcagacttctatttccttcaaagaaaactccacctacaaagtatgacttgacctttacaagccatataaagcaaacatagtagttaatagtacatttagtcaagtcggagttaaatcttaaatgataccatatgtaggatatcaacagttcatcttaaatctgtatttcagggaaagaatttctctaggatgtagaatgtaatctaggttagaatttctctaattttgcaggggcacgatcctgttgagtatagacccaatttacatttctaaacaagttatgccagtgaagccaaaggcagacaaagtttcttagctacactcttagacaagagaacagaaagccagcatacactctgagaaaaagaggaacatgagttaggaatgaatgcacgttaatttagtgagtttcttaagtgtcaatatggtttcagatggaatcattgaaagaaataggcttgaacaaggaagactctaaactggcaatgaattttccactgggttttgatgaaatgaaggaatccaaaaattataaaataggttgggaatggtattacacggtccaaaatctaccctctaaagaccagcctctggtccctccaagtgcgtctcctttacatctcacattaagtatccttcgagtacttctgaaaagccacattcaccagggtgcctgtgctttgtcgtagcttccaagaagtcagcgagtgaaaggccaatttccaaagtgattcgggaaccactgacactcgcatcgctcttggaagacatgcccaccagaaccgcgcccggggagagcgccttccgcaacgggagggccccgcagtggattatcaaaaaggccacggtcatcgggtgaacacagacccctcagtcctcccgcctcgctctcttgagactgaggggtccgcagaagtcgccacccaaataaaaccacattcctgctgctgcgggcgtgggctcccgggtcgcaagccgggagggtcgagccgaagtctccggcgggccgcaagaggagaagggggcgtggctgcgtcccgggggccgagggcggccggggagggcgggccttggccccgagtgaaggcgcggcggcccaaccggcgtgagagcgcggggccggccttcctgcagcctcttccgctcgccggctgcggcgcctgggacggttgcggtgggtctgggcgctgggaagtcgtccaagatgattaaaaaattcgacaagaaggacgaggagtctggtacgcgcggggcttccgaggcccaccctcagccgcgggacgccccttcccccgcccgccgccactctgctttcaggccggcggggctgggggcgtgggcgccgccgtgccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcaccggctctgtcccaggtccccgggggcaagactgtcccgtgggacacagctcgttgaatgctcaggtgtccagaagtgacctgcgtcttgatgcccgtctttggtccagagcaaatggggaagatgccaagcatcctcaaaaagaaaaaaattctcagtgtttggtagcatctcccacagtgtgagagggggttgggttagtcaacctccatggcctcttgcacctttacgcctgcatgattctctgggaaacttcgtttctgcctctccttaagtgttagaaacacataaaatactgcttacctaaggaaatcaaaagcaccctactacaatctcattaatcttcgttgttgtggaaatgacacatttttaacattcatggaaaaagagggcagggaaagaagacactcattttggagagggttgctgcgaaagagaagtctcagctcttcgagtatggcagtgacagagccgggatcaaaatgatttcattcagttcgtatgcgtattagccatgattatcactgtgccatccaagtgttcacttcccaagcattcagtacccttctctggaaagtatataagtttgtgtagaacagctgttcaggacatttttttgttttgttttataaataggtagtggctccaatcctttccagcatctggagaagagtgctgttttacaggaggtatgactgggaagtatcttgtgccctttcttttctattctgttttagagtggtgggcagagaatccctgggctgctgtgatcacgacatgcaaaacaagaaacgtaacagagtttagggaatatagatttgagggaaaagaaagaggggttacttgtcacaggagaatttggagcttatagaaatgcaaagacatgaagactgtcacaggttgggaattttaaatgtaagaacaggtgtttagtgcaaggttattgaaatcagttatctgtattaatctcattgtattagtatgatatagataagtattgtgatccttatttaactggtatagcccataaagttgaagtagtcaacctaagggaatgagaaagtataggatggaaaatcaaggccacgtgtaataatttatcagataccttagtaaattgagaactatagacaatgttctttggataccgtgattaaaaatagtctgtattaaagttgatttgctataatctgtgatagaaaaggtagaaaagtagcaatgttttttatgttttttcataggctcgtatattcaatgaaactccaatcaatccaagaagatgtttgcatattcttacaaagattctttacttactgaaccaggtatattatttttattttcctcagataagtgtgtcctggaatagaaatactgaagattcagtgaaatactttctggaaagtatatttatttattttaaattcacttaattttaacatatacaacgtttggttaacaaaataatatgtaaaacttgagtacgaggactatgacatatacaggttgagtataccttctttgcaatgctcggaaccagaagtgttttggatttcagatttttttggattttggaatatttgcagaatacatactcactgactattgctaatctgagtatctgaaatccagaatgctctgatgagtgtctccactgagtgttatattggcactcaaaaaatttctgattttggagcatttcagattttggattttgagattagagatgtttaacctatacttcctttttattcatgagatcctaaaccagtgatgcgcatagtagattctcaataaatcctttggtttcaatttaatgagtactagttagagcatgttgtttacatgtatttggagatcttcatgtttttctgaaaatacagtgcaagatcaggcaaattccagatattttcttttttatgtgtgtaatgatgttttaaagctttgattgttaatattcagattttatatttattatccctatgctaccattactagcagaataattctgggcagtagcttaaccattttatgtgccttgatgtccttttctctacatggggattatgataatacctgttacagagttgtaatgactaaatgagataattagtgtaaagcactgagaatagtcctgaacatacagtaagcattcaggaatagttttccttccatcattcagcaaatatttattgcgtagctgctgtgtgctgtgcactgttttaggtgttggggatatagcagacaaaccagcaaaaatatttgcgctcatgaaatgtagattctgcttgctgctgttgttattaatttttcttttctttttcttttttttttttttgccccagacttaaaaaaaactcatgaaatgtctagggccttagaaaatatgattttgtttcatggattcatattccctcagtatcagtggggaattggttccaggacctccattggatactaaagtccatagatgctcaagtccctcatacaaatggtgtagtatttgcatataacctacacatatcctcccatatataagttgtctctgtgattataatacttagactataatctctagattacaatacctggtgcaatgttagtgctgtgtaaatagttgttgtgctgtattgtttagggaataatgacaaaaaaccatctgtacgtgttcagtacaaacatagttttttttttccttgaatattttcaatctgagcctggttgaatccacagattcagaactcatggttatggagggctgactatatatgtctatacacatacagacggacacataaaacatacatatataccatatacctcaggtggtttacatatggtgctaagataaccatggtttccaatttgaattctaagagaatatattatctttactttgttttgtgactgaagacctcactcagagatttaataaagttttcttgtttacaaatgaagactaagcaacaagcacatagattttttttattttttgagatggagtctcgctctgttaccaggctggagtgcagtggcgcaatctcggctcactacaacctccacctccctggttcaagcaattctcctactttagcctcctgagtagctgggattacaggcatgcaccaccacgcctggctaatttttatatttttagtagagacggggtttcaccatattggccaggtgggtctcaaactcctgaccttaggtgatccgcccacctcagcttcccaaagtcctgggattacaggtgtgagctactgtgcctgatcatcaaacacatagttttaaataaaatatatctgttcacaaacaacataatccctctgtgtcagcatatgagaaacatttaaagcatagtcaattgggtttaacttttcatagcacacattgtgtctaagttggccaaatccattgtataaacaaaagttttgaatagtcaaagttgattgagagtaacatgtatttttatgttggtcattacctcttcaatgaggcaactcatgttgaaacatttaattatcttgataaggaaattaccaagcacagcataaacacaattaactatataaacaggtttgggaacataaattttatctctttgcctagaacttggtagagctttatagaaagatacttttgaatttctatgagagttgacatatccatgtgttttctgagtttcaagtaaaaaagtaggatgtaaggttttcctgtataactaaaaagcacacagacttctgggtattcagtaaatagttgtgaaagaaagataaatctcatgctgatgagcaggctggatacactgatttaagtaagtataaacttattgtactttgtcttttatcctaaactgtcagtatttttcaccaaaatttattcttatacctatggcaaatagattgaagactagttatattttatgtggaatctgaagctctgaaaagtgattgagtgtaacgtattatataagattgcttttagtgaagacattaaatattgaaatggtaatatttgaggtaatctatgatttgagatgttttgaaatacgttatctaacactttttcactgctcagaaaatgtagttcccagatcagcatttgcatcacttgttagaaatgccaaatctcaggccaggcgcagtggctcaagcctgtaatcccagcactttgggaggccgaggcaggtggatcacgaggtcaggagttcaagaccagcctggccaacatggtgaaaccccgtctctactaaagataacaaaaaattagttgggcgtggtggtgcacacctgtaatcacagctacttgggaggctgaggcaggagaatcacttgaacccaggaggtggaggttgcagtgagccaagattgcgccattgcactccaacctgagcaacagggtgagactccgtctcaaaaaaaaaaaaaaaaaaaaaaaaaagaaaagaaatgcaaaatctcaggctttaccccagagccactgaatcagaatctgcattttggcaagatcccaggatgaattgtcatgctcattaaactgtttgaagctctgatccaaagcatgtttttaggggcttgaaccaatattgagctacatagcagccccttaagcctagttttttaatatgatgaatctggttcctgcccttttggttggtccccttcttgccattttgctgagattctgaatagatagttccttatattttaatatttattatgctcccatgacatgttaggcattgtgctgggcattatagatatgatctctgctcttaggcagtgtaataataatgtcctattgtgagtgctgtaattttctccctccttgtaaactacaatacttcaggaaaatttcagatactttctactaaaagtttagagatcactatgccagaacttttaagcatggtatgcgatactgaattattttaaataaggggggataaatggctatgtgggtttatgcattgaaagccagaaaaattgcagaggcagaatgtttacaaagagattcttttttcttgagttctaaaggatttttgcagaaatagaaaatcctgtgtgtgtatatgtacatatatatgaatatacactttttaaaatttaaaaattgttttaaattttacttagggtgaacactttggaacaacggaagctacagaagccttctttgcaatgacgcgattgtttcaatctaatgatgtaagtctttttaaattttttttacgatgaaaaacctccttttatttattttccccagggaactaagagtgttctaaattagggagcattgcttgaaatgttttaaattatttaactgcttataaaacttataaatattcattataagacgtgaaaatggaagaattaaagtatgcagtgtaaaacttttccctgcagatctaccgtgaagtcataaagactgttaatacctagcttctggcatgacactgtgaaggtggactgataaagaagtcagtgcacatagctaccacatttgtcagttcttagtcaagtttctggtgggcctgggattgctgttagtcagcagtgctggcagttgagaagaagagctggatgtggagtggggaaggggaataaggaatagaataaggaaaaagaaaaatgagtacaaactaaacctgcctctcattaccttaggccaccctgaccttcagaacatacagctgctgctttttgtctgtcttctaagtgttgtgtacatttttcttttgcctagctctaaggcagaaccatacagggaaggtaattctgggatatgtattttccagctttccattaacataaattggccaaatcctgcagttttttggtatgtattgcatatcatcacatgtcacattttgtgtcaacccccagaacctcttgagatttgagtcttgttatggatctaaataatgagaggttttaggagtagatcttcaggaagatcagcagtcccctgtaaggcagctgtttcaggggaggccattatatactctacaggcaaaggaagactaatttcctcacatatgggataaaggactgatgcttctactagcagaagatgtcacagaatttaggagttcggggtacttggcttcatcagagtctgtccatatatcttcattctacttttcagggccccattccttgccagtcaaggtcctaactttaacataagatgtcctgcaagagtgtgaattcaatttgcattgtaactgagccacctgcaggatatactttgtagaagtctcagccctgtagccacatgatataaggctttctatgaaggcagttatagatttctggcccccttacccagatttgagtagtgcttttaaaactccgagctcatcattttcttttcctgagaaaagaattatccagtgtacctagaaacaactaattaacccattatacaacttatttttactaaaatcttctatggcatccactagttagttacccaaggctttgtcttctgtaggtccttgtctgcagatgatgattttaaatattttgccactgcatgctgtggactactagtagcccctttaccattggaaactggtcattaataccttcaatcaaatcagagaagcaacttcaggttcatatctttaaggacttcttttaaccacttcctgtagcagaaattcagggttcagacagggaaacagaaccactatgagtattgtggaattaggtgtttattagaggaattagactagaaaactaggcaggttgagctgctggagtagggttcagagggaggctgttacataagtcatggaaggctattgcctcttttgtggctttgtttttgcagccaggtgtcttcccaaggctgctgttactcagagggctggcagttgggaagaaaagctggacatgtagtggagaaaaggaagcagagtaagaaagaaaaaggatgaggacaaacttttgaagcctgtagcacagaggtttatattaagaaaagaagatatgaaattgtcttctaggaaatggattagggaaatgtaggattgttcgataggactaatagcctgttgaagttagtgcttatgaatttaaagtattaccaatgtttttctccagctacatggtgaatgtttttctccagctacagcctgcaggttaaagcactgaaggcttagagataggatttaatcaggattgaagttttgccaggttagtgaacagagggagaagcaaaaaagttgagtggttggaacatcgactgtggaatcttcggttaggagggaagcaagaacgggctgacagggacagcaaaaagttggtagaaccagtggattgtaggtcaagagagagtgaaagaagtttggagtcaggagtgtgagtgcttgggaatgaaattagaaagggatgctgttactgataggctgtggcagtgggtgatcattgtagggaggatggcatcattggagaagaggaggtcgaggaatgaagaggtcagaggtttagagataccatctgtatggatattaaaatcaccaatacttattactgggattgcactggagagacagtgaacaaggtactggtattttttaaaaataagggaagtgacctggggtttaatggacaaccagcaatggtagcaggtgacatagtataaaggcataagcttccccacctgtaggcctggtggtatgagggttatgggagagaaaacagctgctatttcagagggttgcaggaggatccctgggagagaaccaggtttcagttaaagaaaaagatgggaacattcagagaagagtttgagaatataggggattttgctgatgaaagtgtcagagaatataatggcgctgattagaagggtggaaaatggagtcagacgaggtgctgtacccagatgcaaggaataagtctgcaggttatgaataatgaccagagtattttaggctttttgtagtgactgaggtaagtagccatgtacagcatgatgtgattagttttaatgattccttaggcaaaaatacggaattgagggagtgattgttttgggacaaagagaggtagagattttgccagaaatatgtggagctccttccgttaccagcattcctttaccagaaggtaattactgtcttgaagttggtattcttctatcgttgtttatattaatatatgaggattacatagtttacatctgtaatcaatactttgcatttttgtgtgtcttaaaatataaaaataacatcttcttcttttgcaatgttgttgttgttgtttttgagttgtcgcccaggctgaagtgcagtggcgcgatcttggctcactgcagcctccgcctcccgggtttgagcgattctcctgcctcagcctctggagtagctgggactgtgggcacgtgccaccatgcctgtctaatttttgtatttttagtagagacagggtttcatcatgttggccaggatggtctcaatttcctgacctctttatctgcccgccttggcctcccaaagtactgggattataggcctgagccaccacacccagcctgcagtgtttataattaatacatttttaagatttactggcttgttacatgtacttctactttatttactttcactactatatggaattccaatatgtgaatatacagtaattctatttatccattctcccattggtagatataagttgttcccacattttacctattacaaatgatactgcacataatgtttatgtacacagtgagactttttctggagtagatacctacaagtggaatttctagataatgcttgtttgttcgttttttttttttttttgagacggagtcttgctctgtcgcccaggctggagtgcaatggcatgatctcggctcactgcaacctttgcctcccaggttcacgccattctcctgcctcagcctcctgagtagctgggactacaggcacccgccaccacacctggataattttttgtatttttagtagagacggggtttcactgtgttagccaggatggtctcgatctgctgaccttgtgatccgcccgtctcagcctcccaaagtgctgggattgcaggcgtaagctaccgcgcccggcctaagcatattttcatgtacttatttgccatctgtatatctgctttgatgaagtgtctgttaaaatttgttaccacttaaaaaaatcaggttgtcggctgggcccggtggctcacgcctgtaatctcagcactttaggaggctgaggtgggcagatcatgaggtcaggagttttagaccagcctggtcaacatagtgaaaccctgtctctactaaaaatacaaaaaattagctgggtgtgctggcaggcacctgtaatcccagctacttgggaggctgaggtgggagaatcacttgaacccaggagggggagattgcagtgagctgagatcgtgccactgcactccagcccaggtaacagtgcaagactccgtgtcaaaaaaaaaaaaatcaggttgtcatcttactgagttataagtttctttatgtattctggatagaagtcctttatcagacagatgttttgtaaatatttcctcccagtctgtggcttgccttttcatttactggactattattttttttttaagtgtagttttacatgcggtaaaattcatcctttttagggtatcattctatgagctttgacaaacacatatagtggtgttatcaccaccacaattgaggtttagaacatttccatctcctcaaaaagttcccccgtgtctctttatcatctgtttctccttgcctccctcagcccctggcaatctatctcctttctgtccttataaatttgccttttccaggaagtcatatgaatgatatcatactgtatgaagccttttttgagtttcttttcagttacttagcataatgcatgtgagattcatccatattattgtttgtatcagtagtttatttttattttgtcgtcgtattccattgaatggatgtacctctgtttatctgtttgccagttgaaggatatttggcttgttaccagtttttggtgattataaacaacattgctataaacattcatgttttgatttttggatgaacatacatttttatttcttttggataaatgcctgggagtgggattgctgggccatatgtaggtatggtatgtttaactttgtaagaaactaccaacccatttttctaaaatatttgtaatcattcccgccatcactgtatgagagcagcagtttgctctgcattctggccagcactttgtattgtcgtttttatttttgtttttaattttagctattctgataggtgtataatggtatccctttgtgacttaaatttgcatttttccaatgactgatgatctcaaacatcttttcatttgtatttttaccttccgtatatcttctgttggtgaaggatttgttaatatcttttgcccattaaaaaaattggattgtttattttcttattattgagttttaagaggtctttatgcattctggatacaaatcctttatcagatatgtttcacaattattgtctctcagtatatggcttatgtttttattttgttaaagtctttcaaagggcagaagttttaaattttgatgaagtccagtttatcaaatttttttctgttacaggtgatgctttttatgtcatatcatagaaatctttccttaaccgaaggggacaacgattttctcctgtgctttttttctgggtgtttgtagttttatatcaattaccttatgatccatttcatattgatttttgtatatggtataaagtaatggttggtttcttttcacctcttttctcttcctccatccactgcctcttccttttcttccttcttcattttctcaacacatggttctggaacaattgaatatccatatggaaggagaaaggggaggagggggaggagatgatgaagatgattgagttacattggcacgttggcacattattttgtctcattgacctatatgtctgttcttactttagctctatgctgtcttgattaactataggtttaaaatctatagtaagttttatagtgcaaatctttctatttttcaaaattgttttggttcttttgggccctttgcatttccatatggattttaaatatctatattatatatagataatatagaaatatgtagatatctagaaatagacaaggttatattatatataatataatctttttatatagatataaaaatgctgctggaactttggtggggcttgcattaaatctaaagagcaattttaggagaatggacattatagcactattgagttttctgcttcacaaacatggtatatatccctttattcaagtctctctaacttctgtctgcagtattttatagttttcagtgtacaagtcttgcacatattttgtgaaatttacccctaaagtagatagtatgttttgatgcttttgtatttgtattgtttattggtagtctctagaattaaatgaacttttatatattgacctttttcttgtgatctccttaaatgtttgttagagttcactattgcagctgtcttcttagtgggaaggcttttcggggttaattaacttcatttaaaaaatgtatatatgatgccattcaggttatttgtcttcttgagtgtactctggtagtttgtatctttcaaggaatttcagttaaattgttgaacttggcataaagctcttcataatattcctccattcttttaatgtctgcagaatccttagtggtgtctcttccttcattctgatattggtaaattgtattttctctcttttatttctaggaagcttgtctagggatttataaactttattgatcttgtcatagaaccagctttctgtttcattgatttttttaaaaattaattatttttctcttccaaactaattgtgcgaaaagaaaaaaaaaagctaaaaaatcaaaccaaaagaaggggaaaaaaagaggaagagaaacatagatcaaataggacaaacataaatcttataatgacctggtagatatagacccaaatatatcattatccacattaaatgtaaatgaagagcacaaagatcatttacaaaaagttgattgtatattgagccataaagcaagacacaacacatttcaaaggattgaaatcatatagactgtgttctttatttacaatgggatagtgttggaaattaataaaaaaagaataactagataaattgccatttattttgatagtaagaacatttttctgttttgtttacagccatgataaagtaaatggactggatttaccctgctactataaatacctagaaaatcaaacaaaatttatgacataacagttttcagatattggataataggcatcccaggactgtgatctgaagaagggaaactaggtcagccctaggattgtactagatcatggcccagaaacagattacaggcctagttctctctcagagttgagaaaacgaatggaggttgggagccaggaaagctcgaatttatgaagcagaataccaaagaagaaggagctggagagaaaaaagaggggcggggagagaaggaaggaggagagggagggattccatgatctgttgaggactatccctggagtctttggttaagtaaaaactgatctgtgtgtgtaaaaaaggaaactactcaaagctaaggaaagaatccgaaaaacacagaactcagaatagtttgtattcccaccagtgagagtggaaagaccttctattgcataagacatctggtatagttctcaaaaggaaaccattcataagtaattattacctaagtaatgggaatatactataaccttacactaaaactttaaaaagcctgtaagtaagcctcaaagtgaaaaaaaaacaaacaaactagtcctggttaaccttccctcacgacagaatagagttcaatactatttaagatcatacaccaaaataaacttcacaatgtgcagcatctaataaattatcagatatgcaaataaacaggaaatattatctataaacaggagaaaaatggatcagcagacacaaacccagaaatggtaaaggtgatggaatgagcagatgatgtcattaaaacaactattaacatgatctatatgcttaagttgtaaagaaaggcataacaagaataaagcataaaataggagagatacaaagagatccaaatacacttcccaaaaattaaaaaaaaagaaaagaaatatataaaatgaaaactacactgcatggggttaatagcaaattagagatgtaggacaaacaaacaaacaaacaaaaaaacccagggtcattgaagacagcagtagaagtccaaaataaagcagagaggaaaaaaagacagagtagaaataaacagagcatcagcaacctgtggggtaatactttggaagtttttttattgtttatattcaaaattgcaatgggtttttgacttatcaaaatcaaatactcatctttgtgttttccctactcatgggaaattcgagagtcttaggatactctgattccttatacgtatatgagtatatcaacatatgtgtatatatacatacacacgtgcacatttacattaatatattctatgccatcattttcttgtgagtcttgtttgctcattgtgacttactcctgtctttagcactttttaaaaactcttcattccttgctctatttctgagttactctggaatgattttccttgtgcttgaagaatataccttttagaacctcattttggtagatgttagatactatattccatgccagtaagatccttctgtggctgtgaatgtttggttgtcttcatttctagcatctgtgaatttctctttattttgtccttggctacacatttaaaatttttgttctgattttattcagcatttctgtgtatttgtttatgcagtatgttttagtggttaagagcacatttttggccaacattttgtgttgtttgtcttttgaattttcaccattttggtgggtgtgaggtagtttctgaaacgtggttttaatttttcattggataagtaattttcatttccctgatgactaataatgttgagcccccattttttgtgttttaatgaaatttttttcgtatctctagttttcttctgcttctcacagaactttttttttctttaaattggggtggggtgttcctgaaattttgattcttattttttgttttcttctcatagtagctttgatctgccccatgtgtgtgcctatactggctttctgtgtgtgttttttttctgtttttaatcaccacgaggatcctcactctcttttctttccttaatgggttcagtagtatcaaggttttctccatagcttggactctggagctgcgtctgatgtatttgggtttctctacttaaaagaaatttgaggttactcagtaagggatgaggctggacagactagaggaacctggtgtctggctgctgcccatttatccatagtgtatgaataaatcagagatccagttgagtcggggagagtaggtggagcattgttagcttagtacttacttggatccaggtattcatctagaaatctcatttagggttcaggaggaaacattggtatacactgaactgaggaaagtgcagagtttgcacattttccaggaatgagcctttaattaatactgtacgccgtctctactaaaaatacaaaaattagccaggtgtggtggtgagtgcctgtaattccagctacccaggaggctgcggcaggagaattgcttgaaccccggaggcggaggttgtggtgagccacgattgcgccattgcactccagcctaggcaacagagcgtaactctgtctcaaaaaaacaaaacaagacaaaacaaaaaacctttgtctttggactcaagctatcatagtctaagtttgtatctctcagtagaaagatccatataattgaatttttaagtttttacctattgtgtcaatgcatcagttgtgtttaggaaatattagtattctgaatagtttctcacccagatattaatttttttttttggtagatgagactcttttaaagaatatctttctaaaatatatatctacttggggtcctcacttcaaataatttaaaaaaccatttcctaatcaataatctgttaccttttataaatgatttttcagcaaacattgaggagaatgtgctaccttaccatcaaagaaatggctaccatctctgaggatgtgataattgtcacaagcaggtatgtaaatggtcaaaatctaggatgagatacttatatatttgctgtttgctttctgttgatttcattttttgaccataagaaagccaataggaatttaaaagaatataatatcttaaagcattcttttctaaaatgaagttttcatcatgtgaaagccatccttatctgataaagcaaaggaagaagttacaaaagataatactgatagatttgagtgcatcaaaattttcataaaaatggataaaactaaaaagtaaaagataacgtgcactgaaataaaatatttacaacaaatacatcaaaggctagcatctgtaatatataaagaacttttaaaaagaaacaagtgataattcatcaaataaccaatataaaggatctaaacgtctttagatagtcgttctcactagtaaccaaaaaacataaattaaaaattcaagaatgaggtataatattttttactcatcaaaatggcaaaaaagcaaacaggcagcattcagtacttgtgtaagggagacatactcttgtacaaaggagacagagtaataaattgattcaatttttctagaaagtaatttagcaacatttattgaataattgaaaggctttatccctttgacctagtaaggccacatctgtggaactatccttggaaaataatcagacataacacagaaaaacttatatatattgatgtttgttgcaacaccatttacagtagaaaaaaggacaaacaacttacgtgtctaccattgataaaattatttaattaaccatatcatcatattataaaatattttaaaatttggagatatttttgaaacatctgatataaataagtcttcataaagtgctaaatgggggttggagtcaatctacgtattccatatagtctcactttaaagaacattttatgtgccagacatggtggctcatgcctgtaatcccagcactttgggaggccgacgcaggtggatcatctgaggtcaggacaagaccaacctggccaacatggtgaaactccttctctactaaaaatacaaaaaaattggccgggcgcggtggctcacacctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggggacagagcgagactccgtctcaaaaaaaaaaaaaaaaaaaaaaaaaaaaaaatacaaaaaaattagccaggcattggtagcacgctcctgtaattccagctacttgggaggctgaggcgggagaatcgctggagcctgggaggtggagattgcggtgagccgagatcgtgccactgcactccagcctgggtgacagagcgagactcagtctcagaaaaaaaaaacattttatgtatatatataaaaaatgtggatagaagttatacagacttatctctggatagttgggattgtggctgatatttattttcttttaaactttttataatttgcaaatgtcctagaataagtatatataatttatagttctaagtgtgtaatgaacattatttttaaaatagttgcctttttaattactataactcattgaagtgaatctggttttgtataacataataaattgtagaggagggtgcttgtgtttaaccagtagtagtatggaatgtagtttcaattaggaaagctttcagctgaaaataacagaaaagcagatgtaaacagtgacataaacaagatgggagtttattttttctcatataatcgtaagtctagaggcttggagtagctggtgttggctcagtcattcagcagtgtcagggtagtgtctcttgaattctttggacattctccattgttgcaaaatagatgcccaaattactggcaatgtaccatattcaaggctagaggggtcctgggaaggaagccagggaaggccacaccatctgcctctttcatcaggaatctaatatcttttcccaaggcaatttttagatttcacttggcacaactgtgttatatgactatccttaggaagccaggaaagtgagtatttagtattttatagcccaagtattagggacagaaaagggagaaggggttgaaaatggatgtcggattagttaactaatggtgtctaccacaagtaaaaaaacaaacaaatgaacaaaaaaacccagaaaaccttcagttagattgctagattcactaatattttgaaaattttaaaataaattagttgttgactgagagttttttgtttgtttcttttagcgctgtcaatacttgcctctgagttttgctaggctaccttgaattatggtgtatttctattaatagttcattttaagtgattagtagttgtggtaggcaggataatagtgacccaaagatgtccacgtcccaattcctaggacctgtgaatatgtacattacatggcaaaagggaattaagattgcaaaacagcagatagggagattattttggatcattcaggtgggccctttaaggactacacttcttaaaaatggaagtgggatgcagaagaggcgtcagtaagagatgtgatgatggaaacaaggtcagagatgcagtgttgctggatttggagatgggggaagagggccatgagtcaaggaatgtggtaacctctagagactggaaaaagcaaggattcacccttctagcctccggaaaggactgtagccctaccgatatcttgattttagcccagtgagacaagtgttggacttctaacttttataactgtaagataaagaaatgaatgttgtattttcctctaagtttgtggtactttgttacagcagcaatagaagactaatgcagattttggtacctggaagtggggtgctgccgtaacaaatacctaaaaatgtggaagtagctttggaattatgcagtgagcacatctggaagaattttgaggtgcaagatagaaaacgcctagattgccatgacaatagaaatatggatgttaatgactctattagacttagaaaaaagtgagcagcaggatagagaaaacatttatcatcttagagaatacctaaatcattgtgaacagatggtggaaatgcattaaaggtgctggctcagaggaaaatgttgggaattagaggaaaagggatccctgttatagtggcagaaagctcatcaggcttgtatactgcaattacatggaaaggaggacttacaaacagtgaacttggatgtttaactgaagagatttccaagcaaagtgttgaagttatggcctagttatggcctagtttctttttgccactaatagtaaaattgaaagtagagaaataagtcaagaagagacctgttaaacaaaaaggaaccagggcttgatgattttggaaattcttagtctacccaagtggctaagggtgctaaagtcaggagtttcacggtcaggaaaacgtgctctaaagaaaaagccaaaggagtcactgcacaaccttttgctgaaacctcagaaagatgaaaaggtcagagcattcactcacacaaaacactgaagagatcaaggggtgtgactcatagattcccttagcatctaagtagaagccagaaatagagatgggattatctaggcaagatctgtggaggagcctcttgtctaatggagtgagtctctgtacttatacagtagacccacaaggtttttgagaattctacgtcagcagcaactcagagctagagagagaggatgaagtgaaagactcaaagaggaggcaaaattcctcttcatctgtggacctatggaattagaaaagaaatgagaggatgaagtgaaagaaggctatcagagccccaaattctataggcaggaaacaagccgatgaaactactcagctttaaatacacgctggttaccctttatgaaaaaggaaggaagactctgagggcaaaagggcagtcctgtagggtggaactgagaactttacagaattctgcccgtgcagagacctattccaggttgcctaactggatttcagaattgcttgggaccaatgatgtcttccctttcactttctttcattttgaatgggaatatctgtaactatatcctacggcagtcccgtccttgtattttgggagcaggggatttcttttctaattccgtaggtccgaagatggagaggaattttgcctcaggatggattataccaagagtctcacccacaccaaatttagattttgataataagattgagatttttgagtccatgagatttagatgagattttggactttgaattgatgctgcagtgtgttgagactttggggggatcttggaagggggtgaatgaatgtattttgcttgtgaaatggacatagccctaatgacacagtgattttagcccagtgagacttatgttggacttctaatctacagaactgaaaataataaattcatgttgttttaagccactaattgtggtaatttgttacagcaggaatagaaaactaatattatagatgacctttctgtatgcatagaaaatttgttggcttggcaagaaaccatggagattaaaaaaatctgaaggcacatacttcacaaaagaatatatgcaaatggccaataagcacaatgttcttaacattattagtcatcagggaaatgcaaattaaaatcttagtgagataggctgggcacggtggctcacgcgtgtaatcccagcactttgggaggccgaggtgggtggatcatgaggtcaggagatcgagaccgtcctggctaacacggtgaaaccctgtctctactaaaaatacaaaaaattagctgggcgtggtggcaggcatctgtagtcccagctactcaggaggctgaggcaggagaattgcttgaacccgggaggcggaggttgtggtgagccgagatcatgccactgcactccagcctgggcgaccgagtgagacttcgtctcgaaaaaaaaaaaaaaaaatcttaatgaggtacagcatacccactagaatggttacaacaaaaaagcttgacaataccaaaataaaaaagcctattccaatatcgaacatttggaacaattgaaactcccatacactgtagataggaatgtagaatgatacaaccaccgtagaaaagttttggcagtttcttataaagttaattatatacctgccctgtgaccagtaataccccttctaggtatttactcaaggaaaatgaatacatatatggccacaaaaaagactgtacaagaatgtcataacagccttatgagggttcttcaaaaagtttgtgggaaatgtgtgttatgaaaaaatatccatggagtttgtattagtccattttcatactgctataaagatactacctgaggccaggcacagtgcctcacacctgtaatcccagcactatgggtggctgaggtggggcggatcactttaggtcaggagtttgagaccagcctggccaacatggggaaaccccatataaaaatacaaaaattagcttgatgtggtggcacacgcctgtagtctcagctactcaggaagctgtgacaggagagtcgcttgaacctgggaggcagagattgcagtgagccaggatctcaccactgcactccagcctgggtgacagagcgagattccatcttaaaaataaataaataaataaatatatatatacacatatatatatatacatatatatatatacacatatatatgcatatatatatatacgtatatatatatacacacacaaacacacactatccgagactgggtaatttataaaggaaaggggtgtaattgactcacagttccgcgtggctgggggaggcctcaggaaacttacaatcatggcagaaggggaagcaggcacatcttacatggtggcaagagagagaaaagagtgaaagcacagcaaaaactgccatttataaaactatcagatctcatgagaactcactatcacaaaaacagcatgggagaaactgcccccatgatccaatcacctacctccctcaacacgtggggattgcaattcgagatgagatttcggtggagatgacagagccaaaccatatcagaattcaaaatttttttgcactaaaatataaactcatgactaacttgttaataacatgtccgaacagtaactagcttgagacactaatacatccgtttgaaaataatccatttcagagcaacatcaattctgctaaaattgaaacaagaacaaacattacatttatggtgaactttgggtagaagaatggtgaaattatcgatgtgttacaaaaaagcatggcaatagtgacccaaagaaatcagcagtttacaaatggataagttgtattaagaagggatgagacaatgttaaccatgaagcccttcgtcttcagcagcagaccatctacatcaatttgtaaaactgatgattaacagcagcaatagccaatgtatggacacctcatttggttcagccttacccaattctgactgataaaattaaagttgagcaaactatttaatggatgtcaaaactattgcatctagattggctgcaggcaagagcagagctttaagtggaagttttaaacaagtgagatcaagatcctgagacatttccttgaggaattataacgggagaagaaatgtggctagcagtccaatcctgaagacaaagtatgatcaaagcaatagctaccaagaggtggaagtggaagtggtccagtcaaagcaaaagtggacctgtcaaaaacagggcaacagtttttggagatgcttgagggattttgcttgttcactttctggagggccaagtaatgataatagcttattatgagagtatttagagaaagttggccaaagctttagtagaaaaacacttgggaaagcttcaccagagagtccttctccaccgtgacagtgtgtctgttcatttgtctcatcaaacaagggcaattttgcaagagtgtccgtaggcatccaccttagagttcttatctggcttctttcttttgcttcctaatcttgaaaaaaatctctaaagagcacccatgtttcttcagttaataatggaaaaatgggtgagcgtgggggatgtggctgggtgggtgccggggcttcacctccaaggcagtggccggatcatgattgaggtgattgagcccctggagcctctagtgcctgtggattttggcagtctcgaggcagtggtccggttggagaaagacatcatcttcgcccatgggctccaccccatggacaccgacgggtggagcccatggagtcggtcctggagggcagatgtctatacctgagatctaacaatgtagtagaaggcaactgtgctgaagaattactacaaaactcccattgcgtcgtgaaggagtattttgtggccccccaggtaatatctctttgccaaagctggatgaacaagagcctttctcacacagccgagtagctcattctggaaagggggtactctctgaatacgtggaagcatgaggaccatattttcttactgtgaacactaattttcctgctttttccagtcacctgaaaaaatggatgcttaagcatttcttttctttttttttttttttttgtttttgggatgaagtctcgctcttgtcccccaggctggagtgcaatggtgtgatctcatctcgctgcaatctctgcctcctgggttcaagcgattctcctgcctcagcctcctgagtagctgggattacaggcacctgccaccacacccggctaatttttgtatttttagtagagaaggggtttcaccatattggccaggttggtctcgaacttgtgacctcaggtgatctgcctgcctcggcctcccaaaatgctgggattacaggcgtgagccactgcgcccggccagcatttcttaatagcagactcttctgaagacagaattgggaaatatctggcaccaacaaggcaatgagttcctgatgctaactgaagtaaaaggaaagcaaaagtcagcttccaaggaaatagcttccaaggtattcacttaacaggcctgttcagtatggaagacactatttatccccctttaactctcgccaaaggactataccaactgcatgaaagtgaacttttacatctacttaaatggtagatggagcaccttgatcactatgtgacaaccttggttgtcatttttagttgctatttgaattgatttgagcagccctatcttcaccggacatacctgaatttgttcctaggtacccactttgttcctagaaaagggctaactttctactatggtctgaagagtgttcaaagtagactagagcttgggaactcctaacctagaaccatctgccatcccacaaagtgattagatgcaaaagggatactagtcatacctagtgtttctctttctgaaaagagaacttatcctaaaagtagccatgggcctgggacaaagtagccctttccacccccaaaatgattattagattgacgtgagtccaagattgtggagttttttgttttttgttttaaaacagataccaagaataaatgaaacctatttagggattcattctctaattaatagattctaagtaatagaatcggagagagactttttcctctaaccaaactgccaaagttgtttttggctaagaatttcccaatgatctttgcactgctgctcatttcttttatttttctgagatagggtctctctctgtcacccaggctggagtgcagtggtgtgatcacagatcactgcaacctccaacttctgggctcaagttatcctcccacctcagcctcctgagtagccaggactacaggtgtgtatcaccgcctccagttaatttgtgtgtgtgttttttttaaatagagatggggtcttgttatgttgcctatctggtcttgaactcctggcctcagaggatcctctgacatgccttggcctcccaaagtgctgggatcacaggcgtaaaccacgatgcgtagcttgttactcattcttaaaagtctgtgtttatttttcccattcccttcttttatctgcagtccttcttttttctttaaggcagcttaatttacaagcttggccttgagttaaaagagaaccccgaacgttgaagttgaagttctcaaaccaacatcagagcaactatcttaatccccatataaacaaagttatctactcctggctccttaaaaaaataataataatgtaaaaatgactgcattgacatgcttacattcccagcaacttcaattgtttagggatggactaaatgactggtatcatcactttaaaatgtgtcttgaacttgatggagctatgtcgataaataaaatttatagtttttgtgggtttttttttttttgagacacagtctcgctctgtcgcccaggctggagtgcagtggcgcgatcttggctcagtgcaagctccgcctcccgggttcatgccatcctactgcctcagcctcccgagtagctgggactacaggtgcccgccaccacgcctggctaatatttgtatttttagtagagacggggtttcaccatgttagccaggatggtctcgatctcctgacctcatgatccgcccgcctcggcctcccaaagtgctgggagccaccgcgcccggcctatagtttttgtttttgttttgagacggagtcttgttctgtcacacaggctggagtggaatggtgtgcccttggctcactgcagcctccgcctcccaggcttaagccttccaagtagctgggattacagctgtgtgccaccacgcccagctaatttttgtatttttagtagagatgtggtttcaccatgttggccgggctggtctcaaactcctgacctcaagtgatctgcccgtcttggcctcccaaagtgctgggcttacaggcgtgagctactgtgctcagccgttaggtttattttttaattccatttttccacagattttttgaagtcccctcgtatttgtgatagccctaaactggaaacatcccaaatgctcatcaaagaagaaggaacaaattgtggtatattcatgcaatagactattactcagcaataaaaggaaaaaattgctgattcaggcaacaacatggataaacttctaaaacatttatgttggaaagaaaacagacacaaaagaatatatgctggatgattctcttcgtataaactccaagaacagcccccaaactcatctgtggtgatagaagtcagaagtctactgggttagaggaaattgattggaaatgggcatgagggaactttctggggtgatggaaatgttcagtatttttattttggatggaggttacatagatgatcacaattgccaaaactgatttagcataatatttcagttgtccattttattgtataaattacagctcggtgaaaaaaaaaaagagatgtagttagtgtcttaactaactaaatgtatattgacaacctgattttactgttctactcattacaagaaggcatacccttatgtgatggcacccacccagtgaaagtctggaattgagtcctgagagaattgaggaattgagaattgagagaattgaggaattgagaattgagagaattgagaattctggaattgagtcctgaggaatgatccatcactcacattaggaagtactctggggagtgggcatcagtatgtgagaagttacgtcccggtttcagaaaatcaaatgaaaaattcaaagaccatggtttaggaagaaataaatgggttgtagaaactgttatcagctaggcagttttgaaatcaattgtgccgataatgtgtggattcgggtagggggagaaagatactttgtgcttcctaaggaaactaaatgctaagttcatccacttagtaagaaatatacaagcccgaaacaacttttctatttgaatggtgcagctgttcctgaataattacttctgaagatttactgccaggaaatggtttagaacaagaaaatgagatactattatgacttaaccaccactgtagtgaaactcctctcaaagatttccagtaacttcttacttagttaattttaaaagttaattttctgtccacattttacctgacctctttcccagttttaacatggttaaatacttcctggagttgtaccatctttggctttcagaaaccatagtcctggatttcctctcctctttgatttctccattttatcctatgatagctcagaagtggctggttttcttctgcctgtcatctaaatattggtattccctagggttcatatcagtgctgtagttctttcccaaactcatcatgctctttgataccctttatatttgtacatgcttctccctgtgcctggaattattctgttgccttttccacatagctcaaatacatgtcattataggtactgacttccttcttcttctttcttgacagattagtcattgtcttctctgttgttctcttttttttttttttttttttgagaggtagggtcttgctatgttgattaggttggtcttgaactcctgacctcaagcagtcctctcatctcagcctcccaaagtgctggaattacaggtgagagccactacccctagcctcggttgttctaacacttgatttttttttttaacctctgttctagtattttaatatattgtactataattatttgcatagtttttctgccttctgaattattaattctttgagagaaagaaacacatataactttgtatcatcaatacctggaaaagtgctttgtattattagacatgcaataaaagtgttgcatgagttaaaagataatccattttctctcttcaagcaagggagttggaatcagaaggattatttatttccctctctacctcaggaaagcactcacacaggcagaagtggagaaaggtgtgttaatgtgtgttgagaaacctttctgtctcctacttcccttctctttttcctgcccagtttgcaagccaactttcctgatttatttggattaacacttattttattttaaaatgaaattggggcagacttttcaggaaagatgatgaagtgatgccacgtctcaaaacttccttctctaaagcctagtgaaatgaacaacagtgaataaaagggaaagccaggagacttctaattctagccaagatgaaataaagctactggagcccatctttcccagtgattacaaataataaataataataataataataaataacaaccctggacaaaaaaacaaaaacaattacctgaagcctccaaatagtaaatatagtaggtgaattagggagagaaaacaatacttaatgaatgaccaatatagcaacagtgagtttcatggttaattttcatctttataccttgagtttgacccaagggcagactgaatcagggaactatatagtaggtgtggtcaatagagactgagaaagaagcccatctctctggcctgagcacagtttacaaaaaaaaaaaaaaaaaaaaaaaggttggtggtgactgcaagctggagagctgggggagaatccttgtttgtttgtttgtttgtgtttttcttgttttctttcccgtcctgaggtcagccctagttgtggaacaactttactaggatacgacagcaatgttgtgagcacttaaaaccctcggaagaaacctaccactgagaaaagggacggctgttgggtgaagagtgggggaaaagccacatcattattttttctttctatcttttcttacctcttcatcatgaaggtgggcccacttgcatagtacagggagctgaaactcttgagagaaccccatatttctggctgacgacctgggaaaggtgtctttgactgccagatggtatgggaaaaaagatatgaggaaagacatggaggaatggataatttaccaaagcactacatgtatggactattcctaaagaagcatagcaaaagctttgaagtataaactgacattggaatcaatatgcacagaaggcgaggcagaacttgtaatctgaaactaactgggttgattccttgctaaaacaaaaaagtcagtagtccccagaggcttttaataggatccagagtctcatgacataatcaaaatatgcaggatacaatccaaaaccagtcaaccaggaaaggaaattgattccattgaaccaatgttaatctctacaagtgtgtcattttggggttggtatctgttgattggaaaaaacttggaaattttcaagggaaaagataatcaatagatacccccaaaatgacccagttgtagggattcttaaatactttaaagcagctactgcaaccatgtactataaaggcagacactcttgaaatcaatggaaagaggaattctcagcagtgagctatatatacaaaaccaaatgaaaattctagaaatgacagactataatatgtaaagtaaaaagattcattagctcagacgtggaggtgtggctggcaagatggccgaataggaacagctctggtctccagctcccagcgagatcaacgtggaaggcgggtgatttctgcatttccaaccgaggtacccggctcttctcactgggactggttagacagtgggtgcagcccctggagggcaagttgaagcaggatggggcattgcctcaccagggaagtgcaaggggttggggaactccctcccctagccaagggaagctataagggactgcaccttgaggaatggtgcacttcagcccagatactacgcttttcccatggtcttcaaacctgcagaccaggagattccctctggtgcctacgccaccagggccctgggtttcaaggacaaaactgggcggccgtttgggcagacaccgagctagctgcaggagttttttttttcatacctcagtggcgcctggaatgccagcgagacagaactgttcactcttctggaaagggggctgaagccagggagccaagtggtctagctcagtggatcccacccccacggagcccagcaagctaagatccactggcttgaaattcttgctgccagcacagcagtctgaagttgacctgggatacttgagcttggtgtggggggaggggtgtctgccattactgaggcttgagtaggtggttttccgctcacagtataaacaaaggtgcccagaagtttgaactgggcggaacccactgcagctcggcaaagcctctgtagccagaccgcctctctagattcctcctctctgggcagggcatctctgaaagaaaggcagcagccccagttaggggcttttggataaaactcccatctccctgggacagagcacctgggggaaggggcggctgtgggcacagtttcagtagacttgaacgttcctgcctgctggctctgaagaggacagcagatctcccagaacagtgctcaagctctcctaagggtcagactacctcctcaagtgggtccctgacccctgtgcctccttactgggagatacctcccagcaggggtcaacagacacctcatacaggagagctccagctggcatctggcaggagcccctctgggacaaagcttccagaggaaggaacaggcggcaatctttgctgttctgcggcctctgctggtgatacccaggcaaacagggtctggagtggacctccagcaaattccagcagacctgcagcagagggtcctgactgttagaaggaaaactaacaaacagaaaggaatagcatcaacatcaacaaaaaggacatccacacagaaaccccatctgaaggtcaccaacatcaaagaccaaagatagataaatccacgaggctgaggaaaaaccagtgcaaaaaggctgaaaattccaaaaaccagaatgcctcttctccaaaggatcacaactccttgccaacaagggaacaaaactggacagataatgagtttgacaaattggcagaagtaggcttcagagggtaggtaataacaaactcctcagagctaacggagcatgttctaacccaatgtaaggaagctaagaaccttgaaaaaaggttagaggagttgctaagtagaataaccagcttagaaagaaaataaataacctgatgtagctgaaaaacacagcatgagaacatcgtgaagcatacacaagtatcaatagccaaattgatcaagtggaagaaaggatatcggagattgaagataaatctaatgaaataaagtgtgaagacaagattagagaagaaagaatgaaaaggaatgaaaaaagcctccaagaaatatgggactatgtcaaaagaccaaacctacgtttgattggcgtacctgaaagtgatggggagaatggaaccaagttggaaaacactcttcaggatattatccagaagaacttccccaacctagcaagacaggccaacattcaaattcaggaaatacagagaatatcacaaagatactcctcgagaagagcaaccccacaacacataattgtcagattcaccaacgttgaaatgaaggaaaaaatgttaagggcagccagagagaaaggtcgggttactcacaaagggaagcccatcagactaacagtggatctctctgcagaaaccctacaagccagaagagagtgggggccaatattcaacattcttaaagaaaagaattttcagcccggaattttatatccagacaaactaaccttcataagtgaaggagaaataaaatcctttacagagaagcaaatcctgagagattatgtcaccaccaggcctgcctttcaagagctcctgaaaggagcactaaatatggaaaggaaaaacaagtgtcagccactgcaaaaacataccaaatggtaaagaccattgacactatgaagaaactgcatcaactaatgggcaaaatagccagctagcatcataatgaaaggatcaaattcacatataacaatatcaaccttaaatgtaaactggctaaatgccccagtggaaagacacagactggcaaattggataaggagtcaagatccattggtgtactgtattcaggagactgatctcacatgcagagacacacataggcttaaaataaagggatggaagaatatttaccaagcaaatgaaagcaaaaaaaaaaaaaaaaaaaaccggttgcaatcctagtctctgataaaacagactttaaaccaacaaagatcaaaagagacaaagaaaggcattacataatggtaaagggatcaatgcaacaagaagagctaactatcctaaatatatgaaatataaatgcacccaatgcaggagcacccagattcataaagcaagttcttagagacctacaaagagacctagactcccacacaataatagtgggagtcttttaacaccccactgtcagtattagacagatcaacgaaacagaaaattaacaaggatattcaggacttgaactcagctctggatcaagcggacctaatagaaatctacagaactctccaccccaaatcaacggaatatacattcttctccacaccacattggacatattctaaaattgtccacataattggaagtaaaacactcctcagcaaatgcaaaagaacagaaatcataagaaacagttgctcagaccatggtgcaatccaattagaattcaggattaagaaactcactcaaaccatacaactacatggaaactgaacaacctgcccctgaatgactactgggtaaataatgaaattaaggcagaaataaataagttctttgaaaccaatcagatcaaagatacaacgtaacataatctctgggacacagctaaagcagtgtttagagggaaatttatagcactaaatgcccacaggagaaagcaggaaagatctaaaatctacaccccaatatcacaattaaaagaactagagaagctagagcaaacaaattcaaaagctagcagaagacaagaaataactaagagcagagcagaactgaaggagatagagacacaaaaaatccttcaaaaaatcaatgaatccaggagctggttttttgaaaagattagcaaaatagatggactgctagccagactaataaagaagagagaagaatcaaatagacacaataaaaaatgataaaagatatcaccactgatcccacagaaatacaaactaccataacagaatactataaacacctctatgcaaataaactagaaaacctagaagaaatggataaattcctggacacacacaccctcccgagactaaatcaggaagaagttgaatccctgaatagaccaataacaagttctgaaattgtggcagtaattaatagcctaccaaccaaaaaaagcccaggaccagacaggttcacagccgaattctaccagaggtacaaaaagcagctggtactattccttctgaaactgctccaaacaatagaaaaagagggactcctccctaactcattttatgaggccagcatcatcctgataccaaaacctggcagagacacaacaaaaaaagaaaatttcaggccaataaccctgatgaacatcgatgcgaaaatcctcaataaaatacgggcaaaccgaatccagcagcacatcaaaaagcttatctagtatgatcaagttggcttcatccctgggatgcaaggctggttcagcatacacaaatcaacaaatgtaatccatcacataaacagagccaatgacaaaaaccacatgattatctcaatagatgcagaaaaggcctttgataaaattaaacaccccttcatgctaaaaattctcaaaaaactaggtgttgatggaacgtatctcaaaataataagagctatttatgacaaacccacagccaatatcatactgaatgggcaaaagctggcagcattccctttgaaaacaggcacaagacaaggatgccctctctcaccactcctattcaacatattattggaagttctggctagggctattaagcaagagaaagcaataaaggtattcagataggaggaagtcagattgtctctgtttgcagatgacatgattgtatatttggaaaaccccatcatctcagcccgaaatctccttaagctgataagcaacttcagcaaagtctcagggtacaaaatcagtgtgcaaaaatcacaggcattcctatatatcaataatagacaaacagccaaatcatgagtgaactcccattcacaattgctacaaagaataaaatacctaggaattcaacttataagggatgggaaggacctcttcaaggagaactacaaactacttctcaaggaaataagagaggacacaaacaaatggaaaaacattccatgctcatggataggaagaatcaatactgtgaaaatggccatactgcccaaagtaatgtgtagaatcagtgctatccccattaagctcccattggctttcttcacataattagaaaaaaactactttaaatttcatatggaaccaaaaaagatcccacatagccaagacaatcctaagcaaaaagaacaaagctggaggcatcacgctacctgacttcaaactatactacaaggatacagtaaccaaaacagcatgatactggtatcaaaacagatacatagaccaacggaaaagaacagaggcctcagaaataacaccacacatttacaaccatctgatctttgacaaacctgacaaaaacaagcaatggggaaaggattccctatttaataaatgatgttgggaaaactggctagctatatgcagaaaactcaaactggacccctttcttacaccttatacaaaaattaactcaaaatggattaaagacttaaatgtaagacctaaaaccataaaaaccctagaagaaaacctcggtaataccattcaggacataggcatgggcaaagacttcatgactaaaacaccaaaagcaatggcaacaaaagccaaaatagacaaatgggatctaattaaactaaagagcttctgcacaatgaaagaaactatcatcagagtgaacaggcaacctacagaatgggagaaaatttttgcagtctatccatctgacaaagggctgatatctagaatctaccaagaacttaaatttgcaagaaaaaaaccatcccatcaaaaagtgggtgaaggatatgaacagacacttctcaaaagaagagattatgaaataaagctcatcatcactggtcattagagaaatgcaaatcaaaaccacaatgagataccatctcatgccacttagagtggcgatcattaaaaagtcaggaaacaacagatgctggagaggatgtggagaaataggaatgcctttacactgttggtgggagtgtaaattagttcaaccattgtggaagacagtgtggcgattcctcaaggatctagaaccagaaatacctttagagccagtaatcgcattactgggtatatatccaaaggattataaatcattctgctataaagacacatgcacatgtatgtttattgcagcactgttcacaatagcaaacacttggaaccagcccaaatgcccgtcaatgatagattggataaagaaaatgtggcacatatacaccatgtaatactatgcagccataaaaaaggatgagttcatgtcctttgcagggacatggataaagctggaaaccatcattctcagcaaactaacacgggaacagaaaaccaaacactgcatgttctcactcataggtgggagttgaacagtgagaacacatggacacagggagaggaacatcacacaccggggcctgtctcggggtggggggctagaggagggatatcattaggagaagtacctaatgtagatgacaggttgatgggtgcagcaaaccaccatggcacatgtatacctgtgtaacaaacctgcatgttccgcacatgtatcccagaacttaaagtataataataataaaaaaaatcattggttcatctcagtagcagaatggagatgtcagaggaacaggttagtgaatttaaagataaaccagtagaaataaatcccaactgaaaagagagagagaaaaaagaaaacaaaaataaacagcctcactggcctgtgagactgtatcaaagggcctaacatttgtgacattgaagtccctgaagaagaggagaaaggtattggtgcgaaaaaaaaatttgagaaaataatgactgaaaacttacaaatttggagaaagataaatttacagactcaagaaactaagtgaaacttagacaaggtaaattcaaaggactctgctctcagtcacttaatgaaactgctgaacaccaaagatgaggaaaactgttgaaagcaccaagaggaacatgattcattacatatacacatcactgtgggtttctcatcagaaaatctggaagtctaaaaacagtggaacaccaactttaaagtgctgaaagaaaggaagtgatgactcagaataccatatccactgaaaatatcttccaggaatgaaggtgaaataaagacttcctcagatgtaggtaaactaaaaggtatttgtcaccagcagacctgctctacagtaaatattatagtaaatgaagttttttcaggctgaagggagatgacactagattgatcccaccaaaacaacatatggatagtacttaaagaaaacaacaacagctgaaaacaactgtcaatccagaattcgatttccagtgaaaataactttcaaaagtgaaggtgataaaaaggcaatttcagacttaaaaaccgctgaaagaatttatctctgacagagtcacattaattataaaagggatttttttcaccaggatgaaaatgataatgaagatatggatctatgcaaagaaatgaagaatactggaaatgttaaactgagtagataaacaagaaattttccttgtttacgtaattttaaaagttaattgactgcttaaagaaaagaatttagtatggagtttataacatatgtaaaataaaatctgtgacaaaaatagcatgaggcaaagaagagaaatggtactttattactataaagtttgtatcctctttatgaagtgttttagcacttgaagaaaatctaataggttaaagatttactgtataaagccaccactaaaataacaatgcagaattatagctaataagccaacaaaagagttaaatagaatcataacatatattccacccaaaagaaggttggggaggaaaagaaaagggaacaaaattcaggccaggtgcagtggctcacacctgtaatcccagcacactgggagaccgaggcaggtggatcgcctgaggtcaggagttggagaccagcctggccaacatggcgaaaccccatctctactaagaatacaaaaattagccaggtgtgatggcacgtgcctgtaatcccagttactcggagaatcatttgaacctgggaggcggaggttgcagtgagcccagatgatgccactgcactccagcctgggtgacagagcaagtctccatctcaaaaaaaaaaaaaaaaagaaaagaaaaagaaaagggaacaaaaaccagatgagatgaatggaaaagaaatagcaagatgacagactccaacccaaccatatcaataattacattaaaggcacctattctaaacacttcaattaaaagggaaagatggctagattggattttttttaagagatggggtcactcagtgcagtgacatgatcatagctcactgcatctttaaacccctgggctcaagcggtcctcccaagtagttggaactacaggcattagccactgtgcccagctcagattggatttcttaaaaaagccaaatccaactttatgctgcctataaaaacataccttaaatataaagaaacaaatagattagaagtaaaaagatgaagcaagatataccatgctaactgtaatcacaagaagctgtatgtcttcagataatgtagactccagaataaataatattactagggataaaggggtcagcttaccaagaggacaaagtaatattgtttatggagctaataacagagtttcacagtgcttgaaacaaaaattggtagaattgaaaggagaaatcaacagatccacaattaaagctggaaatttcagtactcatctctcaaaaacatagagcaagtatacagaaaaattattaaggaaaaacaatttgaacaagaaaactgagactctttgctgatgacattgtctatgtagaaaatttgtggaatccaacaaaagctacaggaagtaataagtgagcttagcaaatttgcagaatacaagatcaatatgcaaaaatcaattatgttgtatatacttgccaagagcagttgtaagttgcaattaatcctgtttacagtagcatcaaaatatgaaatactttggggtgaatctgatgaaagatgtataagatatatagactaaaaactacaaaacattggtgatagaaattaaataagacctaaataggggccgggtgcggtggctcaaacctgtaatcccagcactttgggaggccaaggcaggtggatcatgaagtcaagagatcgagaccatcctggccaacatggtgaaaccccatctctactaaaaatacaaaaattaggtatggtggcgcgtgtctgtaatcccagtacttgggaggctgaggcgagagaatcacttgaacccgggaggcagaggttgcagtgagccgagattgcgccattgcactacagcctgggcgacaagagcgaaactctgtctgaaaaaaaaaaaaggaaaggaaagaaagaaacaaaatgctagtaattaaaaacagtagcagagatgaagattgctttcagattcattcgtagacttaacacagccaaagaaagaataaatgtacctgaagataggtctataaaaatgcctaaactgacacacaagaagacttcctaaaaaagaatttcaagagctgagagaatatcaaacagactagcatatgtagaattccaggagaagggctaggcgtggtggcgcaaacttgtaatcccagcactttgggaggccgaggtgggtggatcacctgaggtcaggagtttgagaccagcctggccaacttggcaaaaccccctctctattaaagatacaaaaaattagccaggcatggtggcatgtgcctgtagtcccagctactcgggaggctgaggcaggagaattgcttgaacccgggaggcagaggttgcagtgagccgagatcacaccactgcattccagcctgtatgacagagtgaaactctgtctcaaaaaaaaaaaaatgataataataataaaattccagaaggagaaaggagagagaaagcatttgaggtaataatggccatttttttccccaaaattaattacagacaacaaaatgcatgtccagaaagctcaaagaacaccacatgggacacatacacatacctctaggcatatcagtgaaactgccaaaaagaaaatttaaatagaaaattttaaaggtaccccccccaaaaaaggacaaaacattatacaaatagaaacagattatagtagactgtttttttcagaaaacatgcaagctagaagacaatgttgtgtcaactgataattttatacccagtgagactatctttaaaaggtgatagaaaagtaaagacttactaatttatgagacagcatcttgctctgttgtccaggttggagtgcagtggcatgactcctgtgctcaagcagtcttcctatctcagcctcctgagtagctaggactacaggcgaacactactatgcctgactaattttttatttttgtttttgtagagagaggtctcattacgatgctcagactggtcttgaacttctggcatcaagtgatcctcctgcctcggcctcccaaagtgctgggattactgggatgagccactgtgcccagcctaaagactttcttacacaacaaaaactgataatttattggtagctgtcttactctgcaagaaatgttaaaggatattcttcagatagaaggaatatgataccaagcagaaacttggagctacacaaaaagaacactggaaacaagccagggcaaaatcacattcacttttttctttttgaaaaattattctggacaatagctgtatgtctaaaacaaaaaatagtagtgtaatgtgtttaaagcatatataaaaatatattagaacaattgcacaaagaatagaaggaaagtattgggaatatacccttgagaggttcttattctagccatgaagtgatactcttagttattaagtaaagatataaaccctggggcaacaactaaaaaaaatttaaagaagtataaacaataaactagtaaaggaagtaaaatggaataataaaaatagttggtaccaaagttattaaaggaaaaaagtgttcagttaacccaaactcaggcagaaagggggcgggggtagaggagatgggcagagaaacaaagaccagatggaacaaatataaaactagccagaccacagactgatttgaggaataataaaactgtagtctcctgcaaaacaacaacaaaaacaaaaacagaaaacaaactaacaagaccacagatttcaatccagtcataatcagtaattatattaataatggattgtctaaacacaccagttgaatgacatgtatggacttctcgttagttgaagacaatgaaggctgtatactaatcaatgactcaaaatctccctaaatgataagaaacaattttacaactacagttgttcttggtaaaactacatcctcagagttatttcagttcagagaatactgaaaagtatgaaaccactttgagtaaaaagaaaaactgccaaatgccagtatggtaattcctcatccctcccctgaaccgcaccccgccccccgaaccacaccccccaccccccgcatccccaaagtctttggggcaagcagtggccaaccactaaggttgtagatagatagaagagggaggttagcaaccaccaggcaggaacaacaactagaaagattaaagttgttgctgtgggtagtgactatctggggctggtgtcatgaagacggtaaaaagaattgcccaagatgggtgtaggtaaagaaagacggattctttaaaaaagtggaaacatgttgctagggtgcaatggcccagtcagcaagagtggagctgacttcagggagacaaaggcttgcctgggattttataggatggtgctcttgctgtgctgaagagggctttgtgcagtactgataacaccaaggttgcagttagctaacttgcatttttctattagctgatggtctagtgataagttgggcataggaagattgtgaattatttgtgcaggagggctatgtgtcctagaccatgaagaaaggccgacttacagcttatctgcgttctctttttgcttttccttggtcctgccagcctgacttcttttccctgattaggactccacagttgtaattcagaaaatactaaaaagttagtggggaagataagagcatttactataggaaacggatttcaaagtgtacttgatttaaagatttaagcacaatagaaaagcctgggcaacatggtgaaacctcatctctaccaaataaggaaaatacgtaaattacgtgggcatggtgggcatgcttgtggtcccagctactcaggaggctgagatgagagaattgcttgagcctgggaggtggaggtttgccatgagccagtatcgtgctactgcactccagccttggcaacagagcgaccctgtctcagaggctagacatacaatttaaagagaaatactcaacataaaagggcaaatgtaatttaaaaggaccaccacaacataaagggacagtgttccaaacatacacttctccaggagaaaaaaggcaaaaaggaaaaaagaagtgccttttggcaatcaggtgtcaatgggaaaaggaaggaaaggtggatatttagggtctttcaaggtctaagtgtaagagttaaagaaagaggaaagaaacatgaaaagcagctcaacagtcaaagataggtttattttggagaataaacatgagagggacttctggccgatttcgttcaggagcgctctctcttatagactaagagtattcattagccaggcatggtggctcacgcctgtaatcccagcactttgggaggccgagttgggtggatcatgaggtcaggtgttcgagaccagcctggctaacaaagtgaaatcctgtctctactaaaaaatagaaaaaaaaaaaaaaaaaaaattagcctggtgtggtggcaggcactcgggaggctgacatctctctggcccgaggggaagttgtctcggggctggcatgtctctggtcagggaggggtttattttatggttggaatgtttctggttggagatgtcatttgtgatttatggtcatgctgaatttgggggaaaaaaggcaaatcactacataactacatatcagaatctatagactatatagcactgcaagatgactgtagttaacagttatttattatgtattttcaaatagctcagagaggattttgaatgttcccagtaaaagaaatgataaatgtttgaggagatggatgtgctaattaccctgatgtgataactatgcattctatgtatcaaaacatcactgtgtaccccatcagtatatacaattattatgtgtcagttaaaaataaattattaaatctatatggtgaattaaaggagtgatcaaagaaaaactcattgcagtaaataccttttatcaatgaaaaggaaggaataaaaagtgaattaaattcttagctcaaaaaaactaggtaaagaacaacaaagtaattcaaaagaaagcatatgataggaattagtatagataaaaacagaaattaatgaggaaaaaatagaaaaacatatctaattattaaatcaaaatcctatttttgaaaaaattaacaatataaataaacccgtaagctaagttggtaaaaaaaaaaacggagaaagcataaatatgcaaaataaatgacaagggagaaacagaagaaatgtaaaaatcaaaagacaaatttgtagtctttgaaataaatttgaaacctagatttaatggataattttttaggcaaatacagcttgtcaaaaatgacccccttttttttttaatggggaaacactagaggcatttccactaagatcaggaaccacagcaaggatgttcattatcttcactgctattcaacattgtgctggaggtatttagcaatgcagttaggcaagagaaaccaagttgaaacataagaatgagttaacaaagaagtaaagctatctgtttttagatgatgtgattgaatacctaggaaccccagataatcagtaataaaatgaactcaataatttagtgggacagcaggatataaaattcatatataataatcaatagtcttcttatttctcaaaagaagatatacagacagccaacaaacatatgaaaaaatgcccaacatcactaatcatctaggaaaagcaaattaaaaccacaatgagataccactttatttctgccagaatggccgtaattaaaaagtcaaaaaacaatagatgttggcatagatgtgataaaaagggaacattattacactgctgatgggaatgtaaattagtacaaccactatggaaaacagtatagagattctttaaagagttaaaagtagaactgccattcgacccagcaatcccactactgggtatctactcgaaggaaaagaagtcattatatgaaaaagacacatgcacatgcatgtttataacagcacagttcacaattgcaaagacgtggaaccaacctaagtgcccatcagtcaacaagtagattaagaaaatgtagtatgtatatacaccatggaatacagccataaaaaggaacaaaagaatgtcttttgcagcaacttggatggaactggaggccattattctaagtcaagtaacttgaatggaaaaccaagtatcgtatgtttaacttacaggtgggagctaagctacaaggacacaaaggcaaaagaatgacataatggactttggggcttggaagaggggaaggttaggagggggtgagggataaaagactacatattgggtaccgtgtacactgcttgggtgatgggtgcactaaaatctcagaaatcaccactaaagaacttatctatgtaaccaaaaaccacctgtacccctaaaactattgaaataaaaaagtaaaaaaaatcaatagtcttcatagaaacagcacatagaggacataatagtagatagaaccccatttacaacaacaaccaaaaagattaaacactcaggaatacatttgacaataaatgtacaaaacttagaaaaaatattaagccccttactcttgtctgaatgtttgtgtccccccaagtatgtattttcaattcctaacctccaagttcatggtgttgggaagtgaggcctttgggggtgattagattatgaggatggagcccttgggattggaattagtgcccttatgaaaagactgcagagagctagctagtctcttctaccatgtgaagacacagctagaagagatgccatctgaaccaggaaacaggaccttgccagtcaccagatttgccagtatcttgatctgggacttcctagactccagaattatgaaaaataaatgtttattgtttataagaaacctagtctgtaatattttgttatagcagcccaaatagactaagatattcctgaaagactcaaagtatacttaaacaaatataaagataccttgttttttgaaaaaaaaaattgttttatttttcaatttttttccttgagacaaggtctcattatgttgcccaggctgtcctcaaactcctggctcaagcaatcctcccacctcagccttctgagtagctggggccgtagcatgcaccaccatgcccagagttattgcctgttttttaataggccaactcaatgttataaaaattttattcctccctaaactaatttataaattcaatggaatcccaatgaaaataccaacaggagttaggcaggttggtactaaagttcacgtggaaaatataatgtaagaatagctgggaagtcactgaaaaaggaaaaccatgagggattgggtagaggggagaggaagctagctctactagtcagtaaatctaaggcgtgtacaattaaaacagcatggtactggcacatgaacagactaacagaccgtggaataaaattgtgtggtgactctataatgtggtcaccttggtcagactgatctatgtttttcagatacaatctgatacaaatggaaagtacagaattagacccatggaatagactaagacagcatcccatctgtaccccaaatgtgaattagagaccctggttcctggggccagtgtttttcaggtgtgaaaagacagaagcatttaactcattggcccttgattcctgttggttgaggattatctttagcacagaaataccccacacttcaggattatatatttctgagtgacacgttggcaaccacaggcagctgacactcccatgtcagagaagtcagggccacaaactgagccagtttgcatatttggaatgatgatcactgttaggtcactttggattcttcattctagtgaaggtaaggaaagtgctaccgtactcatagaggtcattgaccttgattcctgtcaggagctaggatcatttctgtataatggtggcagaaaggactctgtctagaattcatggtattcccttgagtatattttggtgctttcttgcctctgacagtggtggtaggggtagagaacaatcagtggttcaatcagggtgcacccaacacagggcttacatcctttgggataaaggtttgagtcaactattggagaagtagccaaaaccaggtaaagtgctggccagtggggaaggaaatgtagaatgggtggttttaggaaggagatgatgaatatcaattatggccttggaattagttgtagcagcaaggattgaactatgttccactcaccttcctttatttagtcttttgtagaaatagtgattgctaccatcttgaagcctccatgatagattagacttaatggaggacatgaacaaatttgagggatggaaagggtagactgtattggacacctcttttgagccacttcacatggtctcaggccttatctgtgattccagctgtggcatcatgagcaagtcttttggggctcagctcactggcattgttactgccttacttcaggtatgcactgagtgttttttgcctactcagattcacttgcagctcacgtgtatactccccagaagtatgggggaattaatactctggggttaacgttcagccaggggctaacagttagtggttctgagatgtatttcataaggctcctcggaagattgctcattaaataaccagtggccagcatcagtgacccactcaaggaaaggtctttatattgtttttacctccttccctgttcatttccctgtcattcacttcaccgtctgaacaccttcctaaataaactacctttatgcaagcctttgctgtcaggacagccaaagctatgacagaggtatagaacatgggttgacaagctatggtacatggccaaaaccatgtaaataaagtttttttgttgtctttttttttttttttttttttttgagatggagtctcgctctgtctcccagggtggagtacagtggcatgatcttggctcactgcaacctccatctcctgggttccagtgactctcccacctcagcctcccgagtagctgggattataggtgtgggctgccacacccagctaattttttgtgtttttagtagagacggggtttcactatgttggccaggctggtcgcgaactcctgaccttgttattcacccgcttcggcctcccaaagtgctgggattacaggtgtgagccaccgcgtctggccagttttttatatttttagtagagacgaggtttcaccacgttggtcaggctggtcttgaacccctgacctcaagtgatccacccgccttggcctcccaaaatgctgggattacaggcgtgagcaccgtgcccagctgtaaataaagttttgttggaacacagccacactatttcttaatgtattgtgtataactgcctttgtgctgcagctacagaattgagtagttgtgaggagatcatataacctgtaaagtctaaaatatttacagaataaatgtgccattcctgtgcattgatttcccagtgctgctggaacaagttaccacaaacttagtaacttaaaaaatctggtggcttaaaacaacacaaattcttttacagttctggaggctagaagtctaaaatcagtttcaccggtttgatgtcagaagtataggcagagcaggttccttctgcaggctctagggcaaaatctgttttcttgccttttctagcttctggaggctacttgcattcctcgaatcctagctcccctttcccatcattccagtctcttgattcgttgtcacatatgcttcctgtgtcaaatctccctctgccttgctcttatggggacacttgtgattacatttaggactcacccaaataattcaatataatttccccatctcagtgtctttaacttaatcacatctgcaaagtaccttttgccatataaagtgcatttaaggatctagggagtaggactttgatgtctttgggggctgttgtttagcttaccacaggcttctgtctggtccctaaagatttacatccatcctacatgcaaaacacattcaccatattgtaaaaatcttccaaaatctaaacccattgcattaactcaggtctaaaatctcgttaaatattataactcaaaagtcccaaatctcataatctaatcatctaactccagtataggtgagtttctgggtatgattcatcccaagacagaattcctctttatctatggacctgtgaaactagcaaacaagttatgtgctgctaaaatactgtggtgggacaggcatagaataacaattatatacattcccattcagaaagggagacaatgagaggaaagaaaagagtcactagcaccagacaatttttaaatttaatcaggtaaacttttaggtttcaagggttgggaatagtccctgtggcacccagctccactctatgggccagagggttgtgtatgtattgtgtatggctgtttttatgttacagcaaccaaatcaagtggttatggggtagtcatatagcctgcaaagcctgaaatatttactagattgttccctgtcagaatgtatgcttgttgagggcaggagtctttgtgtcttttgcttgctaaagtatcctaagtgtctggaacagtgtctgacacttaacagacactcattgaaatgctgaactaaaagaaaaaaatttaagcaatttaatagagatgagagggcaaaacttttgacattgctgaagtagtaaccctatttatagataaaacattaaaaaagagaacttttaaaaacatagctacgtattaaaataaatctacatattaaaatagcatactgtattccaataaaaattgtaacagaatgactgacaccaacatgcatcttggttaacttgtactgtggagagaaacaagtaatttttaagacttctggcagaaaaagctagtcatttaaaagtgagaaaaactaagtccgacttcagccattcatggcagttttcagtgtcagaaaagaatggggacagtatctgcaaagttttaagaaacagaacatgtgatacaagaataatacagctaagcgaattgtcattcaagtacagggacaacaagcagacttccacactggaaagaattcagggaccataacacctgtgagcttttcttgaaaaataaaattaagcattgaagttatattaaatcaaaagagtgaattctgtaatagaggggctacaggaaatgaattaccagtgagcattgaatgtattcaattatagaagtagggttaaactactgtagaaattatgattaaagatagaatgtaaatgttataatccatgataatacaaaaagaataatactaacaaaaatttggagatacacgggagggcagatgagagaggagaaagcttacgtacattaatttttttgctttcatagcttaactcttttatctaaagttttatggcagcgacaaaaagaactagaatgtaaatctcccatatttcagagagaaaacacattcacttaggaaaacaaaagacactcttacatctgtattgtccaataagatagccattagatacatatggctattatagtgaacattaattgaacttttgtaaaattgaaaattcagttcattagtcacactagctatatttcaagtgctcattagacacatttagcttgtggctactatgctgaatgatggaacattttccatcattgaaaaaagttctgttggataacactgccttataggaaacaaagaaagtactaaaaatagagatgtaacacaaaacaaattcatagaattaacaccagacattgcctattaaaagaaatacagattagtttaaaaataaaatacagctaactatatgctacatattgtgatgtatataaaacaaggcaaagcaaaatttgaatataaaaggaggggtgaaagcatataaggcaaacactactgaaaggaagcttgggtgaaggtattaataattagaaaattgaattaaatgcaaaaagttttgaaggagacaagaatgaggtactttatccaaaatgaggaggaactgtcatgaattatttattaatgtaacaccaaagtacataagccaaaaatcacaaaaaatgtaaatagaaacaaaatagtatcagcctttgttttaaaaagaaggaaaaacctaagggtaaaaaagatatgaataatatacttgatacagattgattaatacttatgaaaaccttacctttataatagaaaagtcacctttataagtattcatggaacacttacaaattattcagcattcagcccctgaaaacctgttaattctagaatgtggaaatatagtagagacttattctgtcattacaatgcaatcaaatgatacatttattttgagaagaaaatgaacagatagtacccagatatgtcaaaatggaaaaataaaaagaaaacctcaacttttgggacagtatataagtaaaaattgaaattacagaatatttttaaaatctaatgatgaaaacctatgagttcaactaaagctatggtcagaggaaaattcatagtccttggcacttaaattactgaacgagtgtattgttcagggctccccattgctggcagtagaatctagttcatagatcctcttggaaatccggaaaaccaagcttgcatctgacagagccagaaagagtgcatcagggaaaaatgcccacgctacaaaattttttggtgcaggacacttccaaaaaaagtcttttttttttttttttttttttttttgagacagggtctcactctgtcacccaggttggagtacagtggtgccatctcagctcactgcaacctctgcctcctgggttcaagcagtcctcccacctcaacctcccaagtagctgagactacaggcacaccccacaacaccagtctaatttttgtattatctgtagagatggggtttagtcatgtttcccaggctggtcttgcactcctgagctcaagtaatcctcccaccttgacctcccaaagtgctgggattacagacatgagccaccacacctggccaaattgctttcctaattgaaaaagaaatgaaggactatcagtcaaaacttcttcctcttggtttcctaatggagggagtcagagttgtagaccattttggattatgtgagaggagttgaggaagtggagagattgatagcagtagtataaatgcatggggagctaaagaagggagggtaaaaggttaaaaacctctttaaagcatggacatggaattttgtagctagttcacacctctgcctgtttttgaagctcagcagaaaggtctgaagccattgataattttagaaagccatgccaaagagagatacctcttgagttaattatttttgttaatttatttttaaaagttatgtctagtctgatgggattttaggatttgggggtatgtcagactaggacgctttataccattgtccttagtttatcttttatgctaattatcagtatctaaaattatggggaaggggttgttttgtttacgtgattatctttcttcctcccagaatgataagttccatgaaggcaaaggactttttgctttttactaattttgctcattgctttattcttgaattagaacagtcttctacgcagtagtcttagcacatatacaaagaatatgctccataaatatttgttgaattagtagctgcattaagataattatgggacaattggaaattggctaggggtgaactccatgggagagattttaattgatcttatgttaaccaatttgatttttcttagtctgactaaagacatgactggaaaagaagatgtataccgaggcccggccatcagagctctctgcaggatcaccgatgtaagttatctgtttcactgagttaccaaatggaacactatgtttatctgcaggtggccatgtagatttagtaggatttcctagtctgactttgtgaattttcagtataagagaaacatgatcaccagaaaggcttttgtggctccaggctttcttttgtcttcagatttttttcctttatttatgttagtccattttctctctttatttgcccccttgaactgttgtagtgagggtacattgcttgcaggaaacaaaaacccattcaaatttatcttaaaaagctttattataggacacaaatctcagaatttgaggtgaagcttataggtagacaccagggcaagaaattgggcagctttaagaattcaacagcagattttttttctttttcttttttgagtcggagtctcgtgctttcgcccaggctggagtgcagtggcacgatcttggctcactgcaacctccgcctcccgggttcaagtaattctcctgcctcagcctcctgagtagctgggatttgaggcacccaccaccacacctggctaatttttttttttgtagcagtttgaacaaactgaaaactttattcttctgtgtgagctgaactcaagtttcagaataatcatcgccatgtgggaggctttttgttaaaatgcagaagaaatctcaaaatactgtatttatatctgccttccactgctgccaatatagtaagcatctcctacacaatcaacaataaacagcaaatgatgcagttcatagagtattttgcacttggaaaaaaatatatatctgaattgtaaaaagaagtgtttggattttgtatgtcttttttattattgttaaaatactaaatgaaacttctcagcctggcatcttttcctctatctcaatagcttatcctagagccagaaaaagccttgaggagacaatgtcttctggcttccagataaaacttatccaaattttttggcaactcatccctaatgattttaaaatttgaaaaggcttgtctttttgtctatccttaaaagcaatatcaagtattatgtcctaagggggatctaaggagtgggggaaatttattgttcctcctcaccacagtacagtccacaaccactggctggcccacaggtggctcagcacttccctagtcagggtgtcccacctctaggaaagcgccagcactgaaggtcacccagtgtcattctttgtatgcagtacactcttggccaccaaacagtattgtgaaatacagatcattcagccgctaccaccatcactactcctacagggcacaagaaagcaatctccaatctcttttataaataaacagtcctaacttctaggctcagagatgatagataaaacttagctgttgcaattatataattccctgacatgaaattttattggatttaatatctacatgatatagccatttaagagtataacttgaggaaaaaggaaagatctacctgatcaaaaaacatgttggggtggcctatcagaatcttaaacttcccctttagcatctataacgaagacatagatgaagtgcattcattccataattactgagctcctattatatgccaggcactgagcacctgctcatcagctcattgacaatagccatgctcaagatccacactcctcatgtaactttctgattataattgatcttcccagataagatttccccaacaggagcgataatccagttcacttggtggctgtaagtataaaagaatgcactggcattctattatgtacattaacttcctatgagtttgatttaatgtgacaaaacatgaacacctttgtgtggactgacccaaaatcacacttctagaactgcaaagccaaggaccgtatccatgaccttcatgctacaccaacttggagccatcctttttgacttctctcataactcacttctattccaagaacaacaagtcttcctccttacttcctaggacatttgctttggtgtctcaaaataatggatagtcagggacattggagtttggatatgcctatattaagaagtcttccaagtggggtaaatgaagattttcctagggtatggtaagactgcaaggaatacccaggcaatatcctcaaatctgtctgaggagagttttaaaggaataaatttccagatcttcaacttccctatgaaatattttctaaaaccaggccgatgcccagctaatttttgtatttttagtagaaacagggtttcaccatgttggccaggctattcactgtggtgatccatcatgtactagacacaggccctcttattgaaacatttaagagagagaatctgattagtcagcaataggccagtagcttatatccacctgtgtctgagtcaggtgtttaacattgatccagttcattatatctggagggatgagatcatgtagtatgttaggctgtctctttctgggaactctgagtaggaagggtaggccaggcattaccaagcaaattgaataatagctatatacccatgcttgggtatattttaggtgtatgtttgtaaccttcttaagttgtaaaggttgagcaggaccaaattatacatctgataaatctggattctagaaggagtaatagaaatgctttaatattttttggtgcactgttgttctgttgtgattgttttttattttttgcattacattggtagcagcgtgagacttgaccatgctagtgctagcaataaaactctttttttcatctgaatattgctctcagtctttttactcatctttatctgccaccaccttcccagtgctttttcccagttaaagttaaaaagaactgtatttccagaggattttatgttgagggctcactatagtagtacactacacatttaattctttatgtatctcagataatcagggattacgtttgatttctaggactctctgggatctgtatataatatgtgcccttcacatagaggaatcttcataacttcaaaagcaggctccatctccatataggaatttctttatgactttcctgatgggttcagcctctgcttgtgtatttcttccaaactgagattctccattttgagacagtttatttcattgttgaacagttattcttctttatatataatcttaaatgttctttcttaaagcttcaacttcgttgtttgggttctgccctttgggatattattactatattatcatccttttagtgcattctgaatatttgcacagaaacaaatataagattggtttttgaaaattattttgaagcataagagtaattttgcataaacatgtttttccttaacaattttttctttttgaatgttattagggaacaatgttgcaagccattgaaagatacatgaagcaggccattgtggataaagtttccagtgtatccagttcagcactggtatcttccctggtaagtgaacaagcagcttcctagttcttaagcatggtacagttttgagttgcgaaaacaaagtatcactatgattgtctcacaaatgaaacagttaaaaatatgtatacacctctattactttatccaagtgtgttttatctagagcaggggtccccaccccagggcttcagaccagtactggtctgtgacctgtcaggaactgggctgcacagcaggtggtgagtggcaggcaagcgagcattgctgcctgagctccgcctcctgccagaccagcagcagtgtgagattctcataggagctcgaaccctattgtgagctgcgcatgcagggatctaggttgccggcctcatatgagaatctaatgcctaatgatctgaggtggaacagtttcatccaaaaactatccctctgccctctgtccatgggaaaattgtcttccataaaaccaatccctggtgccaaaaaggttggagattgctgatctataggatcattgagcaattaaaaacataaaatgttcgtatgtttgaaaggttttggaaatctgaaagttatgttgtacacataataaaagaggggtaagtgtggggtatgggacaggaaagaaacctaggacccttttctttcatttaaaatcttctttatgacctgcctttatgacttctactacttgtctctttgtcctctgctttttctggtgccctttgtctacgtgtatccttcaatccaaagtttcctgtcccacttctgaatttcctcccaggaagtggtcttttttttagtaatacatttttctttccgtttttcagcagaacacaatttatacattaaaacctatcacattgcatttgattaacgtcagttacctatatgtgaatgtgtaagacatctaaatacaagagttcctgattctggaatataattggctgagttttatagcagagaatatactagtactctctttcttccaggggagtttcctggaagtaaagcttgttatgataacgttatttaagcaccgttctgttgactgtccatccctatcctgttcttcctctttcattacttccttttacacacctctcccagcttacatatactcacctttgtaacaggtatgggagaaaatacttctggtttatcagttgctccaggagtaaagacacaaaatagacttataagagctacatagttttcttcctcttgggaaatgtctgtgattttcaaagaaaactaactcatgtttctaagcttctagtgaccaagcattatttattctcattttttttttctgtatttagcacatgatgaagataagctatgatgtggttaagcgctggatcaatgaagcccaagaagctgcatcaagtgataatattatggtccaggtattgtcattgaatcacattagcttgtctcaggatcagcattctttaaacctgtattgtaggggcagtgtattgattccctagataaacattaactaaaggcaaattaagcagctactagtacgtattctgaagtaggaatctcactaattatgattactgccatttgaatactgcccttcaggtgtttcatagaagctagatgaccctttgtaggaatatttgggaaagattgttatattcagtagtagattgagatgctcgtggcagtcttttatttgaaaaataatttgtgtaaaaagataattccaagttctgaggccttgattataggcattataaaaatcatacggagcagcttttactttatgaaactttgaaaccattttgtcaaaaagagctcttttgatatttattaggttattcttaagaggaataagattaaattcttcactggaaattgtgtgtaaagtaccccattttatttgagagggtgtttatgccctcttgatgtttataacttctatggtaacatattcagttattaggaaacagagtagtcatttttcccttgggaaacactctcattctcctgactctgatcatgtgtttttatacaaagtgtcaagatgatgacactcttgtagcctgctttaggagattaatcctttaattactaagatggccacagatgatgtaaagccactcgtagagacagatagcaccagtaaagccctggacccgagagcgtgtgtactgaggatgtgtgagccagtgttgagcctgctagagccatcttcaggttgtatgtcacctcctttatgcctgccagtctgaattgacagcttctaggggtaaattagaaacgtttaatcttttcagtcttgcctgtgtttagttcagtgtgaaaaaaatatttgtgtacatgtgacctgggtattttaaagaaatctttaatctagttccgtgtaattctatttttgtgtaaatattttgacatctttctaatccatgtgctaccttctttttcatgttctttagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatgggtaagtgtcttcacctaaacctgggttattttccatttgcgaagttaatataccttagagtttatttcctttttgaattttttttggggcagtgctaactttacagatgagttcaatgtttttcaattttttaaaaaaattatggaatttcaagtcacactttttttaaccttactgtatgctcttgtatatgtacttaattattaatagcacattaacaaactgatattgaacaaaaaatatatgcattgatcataagatatatagataattaaatatgaaagttggcagggacattaagaattatcctatcccttttatttttataaaagagaatgttgaagtactgcatttagtgatttgcctaagatcattccacaagtctgaggcacataagatgtgaccaaatatactttagcagtctttcgaaggctagggaagggcaggaatgagaaatcttttgaggtatagtaagctgggcatggatctagggagcaaagaagaccccttccccagcctgaaggcttatggctgagctctaaaacaaagatttcttatgtggcctggcaaactgaggtgtaacacagagaaagatctctagaatctgccactactactaatgccctgctgaaaggggaaacctgatctgttcctcagatcatttgtaaacagcagataactgaatttaattaaagctgcagcaaagtcctgacccagatcaactattagctgctaaaaatgaaaaaggacctgcacttttctaatgataagtattagttacatcagtgtctactgcacctttataagcagtgtctagcaaacaatcaaaaaatacagaggcagtgacatgtaacccataaacaagagggaaaaaaatagtcagtagaagctgacttacagatgacccacatatagaaattaggaggcagtgactttagaaattactaggcagtgacttttaaacaacttctctaaagtgaacaccaaaggagttttgtaaagtgaacttttgtaacttttgtaaattacatctttccactaaagagtggaaaagatggacaaaatgtgtaaatgggtaaggaattcaatagataaatagaaactagaaaaaaaatcttgaaccaaaaaatacaatatcaaaaataaaaatttatttgaagcacttaatagcagattggacacagtggaaaaaagattagagaacttaaagacaagtcaatagaaattgtccaaactgaagcatagggagaaaaataagaaaagaaaataaaagaatagaacatctgaagcctagggaatatatcaaaaagtctaatacttgtgtaatgagtctcagaaggaaaggaaacagaatggaatagaataaatctttgaagagataatggatatgttagtccattttcatgctgctgataaagacatacccgagactgggcaatttacaaaaggaagaagtttaatggacttacaattccacgtggctggggaagcctcacaatcatggtggaaggcaaggaggaacaagtcacgtcttgaatggatggcagcaggcaaagagagagagcgcttgtgcagggaaactcccatttttaaaaccatcagatctcatgagacttactgtcatgagaacagcatgggaaacacttgcccccatgattcaattacctcccacttggtccctcccataacacatggaaattcaagatgagatttgggtggggacacaggcaaaccatatcaatggatgagaattttccaaaatgaatgaaaggggctgggtgcggtggctcatggctgtaatcctagcactttgggaggctgaggcaggtgaatcgcttgagctcaggagttcaagacaagcctgggcaacatgacaaaaccccatctctatcagaagaaaatacaaaaattagccaggcatggtgacgcaggcctgtggtcccagctactcaggaggctgaggtgggaggatcggttgagcatgggaggctgggaggcagaggttacagtgacctgagatgacaccactgcactccaacccgggtgacagagtgagatccccatctcaaaaaataacaacaacaaacccaaaatgaatccaagatggccagtgacactcaagtaggataaataaaaaccacacctaatcataacctagtcatatatattacaagtaaaaagttgaaaaccaaaagagaaagaatgaaagaaaagcttgaaagtcgcctttttttaaaaaaaagacaaattagattcattagattcagggaaacaaaaataagaatcgttgacttctcattagaaaaatggatacgagaggataatggacatcttaaaattgttgaaacaaataactgaaaatctggagttctatactctaaaagtattcttccaaatgaaggtgaaattaaaacattttcaaccaggaaaaaacaaaaacccgaaaggatttgtgtctgcatacctgcatcatgaaggatgctaaaaggagtttttccagctaaaaagaaatgatagtagatggatgccaggatcttcaggaggaatgaaggacaagagaaagggtaaatgtgtaggtaaattaaaaggtaaatatgtaggtaaattataaatatatacaatttttactaaaaccagcagcaaattatggggcttatatatatgtagaagtgaaatatatgaaaatagtagtataaagggcatgagggagaaaaatggacatttgtaaagtttttgtatcatgcagtagtatattatttgatgatacactgtgataaggatgaatattgtaatctcttgaggatgaatattataactaacaaaaaaatctttgtaaaacatatagatcttaaatgtcaacagagaagataaaatggaatatttaaaaatattcagttgagcttcctccttccaataatggtgtagcttggccagcttaatcctcctgcaaataataattgacattagtacaaagctataccttcccaaaatgaagataacccacaacagtatgaaaatattggggagtggtgaaaagcaagcaaaaactggagggaagcagttgatgcctgaaagacaaaagctatactgggtgaaatttgtggggtttttttgctattctcctgagggcattctgtaattcctcagtgtaggatgacagaaagctacagtatttctggacagagtggtcaaaacagtttgaggttggaagagtaactgaaaacttagagtggaaaacctggaaaagagggagccataaaaggaatgagtctcaaaatgaattttaaactctgcaaaaatcactggctgaccaactgaactacatatatacaggagaatactctaggagacctgccaaaagcagtagttgtaagataaaagaattgaatggagaattcagctgcaactcactatggaggaaataaagtttggagtttgatcccagccaagcttcttgctaaagaaactccatgagttctagagtctttacagtatatcattacaatgtttaatagatggtaaaaattgccagaagtacaaagaatttggaaaatgtgactagtagccaagagaaaaagcaatcaatagaaactaaccctgatatgatccagacgttggaattagcaaacaaaaactttgtagcatctattataaatttgtccatgactttatttatttatttatttatttatttatttatttatttatttatgacagtctctctcactctgttgtgaagcctggactgcagtggcgtgatcctggctcactgcaacctctgccttccacgttcaagcaatcctctcacctcagcctcccaagtagctgggactacagggatgcaccaccacacctggctaatttttgtactttttgtagagatggggttccgcagtgttgcccaggccggtctcaaactcctgagctcaagcaatcaatctgcctcagcctcccaaagtgctggtattataggtgtgcaccaccacagccagccttgtccatgactttaatggaaaatagttaccatgaatgaacaggggaaatggaaacgacaaaaagagctaagtagaaattctagagcttaaaaatactctgtcaggattcaaccagagaagtagaacctggaggatataaatatgtagagatttgtttattgattatgtaattcgggggccagctaagcaaatctaaaattcataggataggctgtcaggaagggaagattgcagggaggctggaactcaggggcacaggccaaagttgctctccgtaggtgaaatttgtcatttcacattttactgtaaacagcaagataaaactgggtcacatcttcatttttggaattttcctcaagtaaatatccaacttcatcgtttacaagttctgcttcacaaataactacagggcacaaattcactaagctctctgccaatacataataacaaggatctaccttactcaagtttacattaatgtgttttttacttccttctgagccctcactacagcatcttttaagtccagatttctgtaggcagttcataagccctgaccagcagtgtccttaagaaccagatcgattgatctttctttctccttccttccttccttcttccttccttctttctctttcttttctctttctttcttttctttctctctctctttctttttctttctctttctctttctttctctctctctctctctctttcttttttttatttattttaaagtcttgctctgctgcccaggctggagtacagtggcacagtctcagctcactacaacctccgcttcctgggttcaagccattcatatgcctcagcctcttgagtagctggaactataggcatcccagcactttgggaggctgaggtgggtggatcatttaagatcagatttcttataagtctcttcaaaactaggcttcctccatcatgctcctcaaaattcttccaagcttccacccagtgcctaattccagtcagttctacaatttgaggtatttgtcgcagtaacacttcacttacaggtaccaaaatctgttagttttttttattgttgccataacaaattaccattaaatgtaatggcttacaacaagatccatttattatctcagatctgtagattagaagtctgacacaggcctcatggggctaaagtgaagatgttggtggagtgctgttgcttactggaggctttgaggaagaatccacttccaatctcatttaagtcgttggccaaattcatttccttgagactgtaggttgtaggtctctgtttccttgctggctttcagctggaggttagtctgtgcctctagaggttgcctgtattccttctcatgctttcaatgagcaactaaaggcctctctttgagtcccttgcatgttgattcatacgtgtcagagccagcaatagtgtgttgagctgcactttgaatctctctgatttgcctttctgccacatttcttctgcctcctctttcagcacatctgctttaaagtgctcatgtgattagattgcacctacctgggtaatttaggtgacaatcttaattatatcagcacagttcctttgccatgttgtaacgtaacatattcatcagttctaggaatgaagacatagacatctttggggagccattctgccccagcaagtgcaataactgaatcagataatttgctgaatggacttaacagcagattagagatggctgatgagagagtcaaagagagttagtgaatttgaagatagagcaggagaaagtagctagtttgaagaacagagagaaaacagattaaagaaaataaagagcctcgaagaactgtgggataagatcaagtggcctaacacatatgtaattggaatctggaagcaaaggtgatagaatggagcaaaaaagatatatgaagaaataatgaccaaatatttcccagtatgggtttattctagtagtataaggttgatctaacagtaaaacatagcataatatacctcattttaaaaatacagaagagtcttaatgccttaatgggtgcagaaaaaagcggttgataaaatttaatggcaattcatgattgaaatctctgccaccaggactggaagggaacatgattattctgacaacagtacaaaaaaactccactaaactttatacttattggtggactattaaaagctttcccctagagattgtgaatgagacagacaaaaatgcctgctatttttattttttaaatagtattttgctagaaggcttactttgtgcaataagtgaagaaaataaaatacctaaaaatttgaaaggaggacgtaacactatatttggagataatatggctatatatataggaaatgcaaaataaactgtacattatctattagagctcatatgtaaatttaccagtgttgctggtcaatatccgaagtcattttatttcttattccagcaacccatcaaaaagataaaattttgtaaaaatggtacaatttataattatattgaaatcaaatccttgggaatgtatctactaaaatttgtgtatatctctacacagaaaattacacaatattaaagtatgacctaagtaaatgaggcatataacatttatggaatattcaatattgtaaagatacatcttcttaaattgacctatggattccacaaacccctaattacaatcccaattggcttcttataaataaccaaacagaaatgcctacatttgtgtgttaaaagacatacagttgatccttgaacaacatgggtttgaactgcatgggtccacttacacatggattttcttccacctctgccacccttgagacatcaagacctcctcttccaccccagcctactcaatgtaagatgatgaggatgaagacctttatgatgatccactttcacttaatgaatagttatatcttctcttccttatgattttcttaatattttcttttctctagcttactttattgtaagaatacaatatatattacatataacataaaacgtgttaatgaactatttttgttatcaacaagatgattaatagtaggttattagtgatattttgggggagtcaaaagttacatgtgaatttgcagctacatgggggttggcactgttaaccccatgttgttcgaggatcaactgtacaagatgcctatagtactgttattcataattgccgcaaatttttttttttttttttttttttttgagactgagttttgctcctgttgcccaggccagagtgtaatggtgccatcttggctcactgcaacctctgcctcccgggttcaattgattctcctgcctcagcctccccagtagctgagattgcaggcacgcaccaccacaccctgctaattttttgtatttttagtagagacggagtgtgaccatgttcgccaggctggtcttgaacttctgacctcaggtgatccacctgcctcggcctcccaaagtgctgggattacaggcatgagccaccatgcccaaattgccacaaaatggaagcagtccaaatgtctatcagtgccagaatcaaaaaataaattgtggtatattcatatagtcagatagtatacaataatggaaatgaacaattactgttaaatacaatcacataaatacatctcaccaagaagtcatacacaaatgaatacattttatatagttccatttatgtttattttagacttaacataggcacaactaacctgtggtattgaaagttagtatagtgattatctctgaggtaggagcacattaattttgtagtaattcacgtatgattttcatactgtcatgtgtaacaccagattaaagggatagtaaatatttatttttccatataatttttgcaggtcaggggtttgggaatgtcttagctggatggttcttatttggggtagaaaagttgataattctgaattgatgtttacaaataatttttttttaattagaagctctaaaattccagaggatgacaacatgagaaataatggtgtagaaggtggtattagtttatggccataccaccttaaacaagccaggtctcatctgatcttggaagctaagcaaggttgggcctggttagtacttggatgcgagacaatctggtaataccggatgctgtaggctttaaaaaaaaaggaaagtggttggccgggtgtggtggctcatgcctgtagtcccagcactttgggaggccgaggcaggaggatcacttgaggtcaggagttcgagaccagcctggccaatatggtgaaacccccgtctctactaaaaatacaaaaattagctgggtgtgatggtgtgtgcctgtaatcccagctattcaggaggctgagcaggagaattgcttgaacccaggaggcagaggttgcagtgacctgagactgtgccactatactccaacctgggcaacagagtgagactttgtctcaaaaaaagtaaaaaaaggaaggtggtattagatggaagtaaaagtatgctgtgtatgtgtgttgtcatcttgtatgggaggaaaatatggtaataatataaaactttattgtaatattatagatatagctaatataatatttaattatataaagaatgtaaattgaatgtaaagctttcaaaatgtcgaagaaaatggagtgaggaaaagttgattgaaaattgataaggaaaaaattgattgaggtaaagccttcaaatagacaacaggaaagaaatcggttagaagtaagtgtaactgtatgtgttatctcttgctatgtggtatattggaccaaaaattcacagcttataagtaatacttactattccctagttgctatggtcagggatctgagagaatctgtccagtttgattcaaggtccctccctcgtatgagtttataatcaagtcgttggcctagcctgcagtcatctgggcctggaggatccacgtaattttacttatatagttgttgacaagcctcagtttctccctggctgttggccagatgctttagtttctcactttgagagccttccctccttccttccttccttccttctttgcttccttccttccttctttgcttccttccttccttccctccttccttccttcctttttttattatactttaagttctggggtacatgtgcagaatgtgtagaacgtgcagttttgttgcataggtatacatgtgccatggtggtttgctgcacccatcaacctgtcatctacattaggtatttctcctaacgctatccctcccctggcttcccacccgcgacaggccccggtgtgtgatgttcctctccttgtgtccatgggttctcattgttcaactcccacttatgagtgagaacatgtgcggtatttggttttctgttcttgtgttagtttgttgagaatgatggtttccagtttcatccgtgtccctgcaaaggacatgaactcatccttttttatggctgcatagtattacatggtgtatatgtgccacattatctttacccagtctatcattgatgggcatttgggttggttccaagtctttgctattgtgaatagtgccacaataaacatacgtgtgcatgtgtctttagagtagaatgatttataatcctttgggtatatacccagtaatgggattgctgggtcaaatggtatttctggtttaaatccttgaggaattgccacactgtcttccacaatggttgaactaatttacactcccaacagtgtaaaagagttcctatttctccacatcctctccagcatctgttgtttcctgactttttaatgattgccattctgagtgccgtgagatggtatctcattgtggttttgatttgcgtttctctaatgaccagtgatgatgagcttttttcctgcctgaatgttctcacagcatggcagctggcttctcccaaagcaagggaattgagagaaagagtgagcctgatatggaagttgcagtgttttataaccgaatctcaaaagtgacaggccatcacctctcatgtattcctttggtcacacagacaaactctggtgtatataatgtctacacaaggatgtggaattgtagaagtggatattttggggggccatcttggaggctggctagaacacaaaatataacatttatcataatgaatgtaattgaatttacatattaaaagaggctcagattgggtaaacaaaatgaaacaagagacctttatgcctttagaaaagacacaaacaaaatgacaggaaacattgaaaataaatatataaaaaatgtatactaactatacactcacacacataaaaaatgccatgtagcaatattaatataagccaaaataggaatcagtgtgtagtgcactaaaaatgacaaaatgggccaggcatagtggctcacgcctgtaatcctagcactttgggaggccaaggtgagtggattgcctgagcccaggagttcgagaccagcctgggcaacatggaaaaaccctgtctctactaaaaatacaaaaaaattagccaggcgtggtggcacgttcctgtagtcccagctacttgggaggttaaggcacgagaatctcttgaacccaggaggcggaggttgcggtgagccaagattgtgccacaacactccagcctgggtgacagcgtctctgtctcaaaaaataaataaataaataaaaatgacaaaatggaattttgtattttgacaaaagtaatggtctaaaaaaatataacaggaatgaacttgtatatgcttaatattaacaatatatagtttcaaaatatgcacatcaaaatcttaatacaggaaactaagtcctcttgatctcttcatggagactttaacacaactgtctcagaaactgagaaatcaagtataaaaatgtaagactgtaactgatttgtatgttactgataacaaaattgacctcctatttagaaccctgcatctaagagagaatatacagtattaattctttctaaaattttaaagtgaaaactgtacttatagaaaactgcataaaacataatagttgtgtgtccaatatatacagttgctatgaaacacccttataatgaccacatgtattaggaagtagcacatttctttgtaccccagaaatgctttatatatcctccttgatcatgattatttacccccagagcaaattactatcctaatttcatatcaaatttttcctgggtatgcatccctaaacagtaaagtttagttttgccttgttttgaatgctctgtcaatagaatcatgttatattttgtgtcttcttttttttttcttctagtgaaagtatagagatttactgcaaagagaaatgtacaaactcaagaaaggggagtgtgggcatactcaagagagagttccatacaaggggggtttggggctgctacctttatgggttgctttaactaaggggtagaatatttatgaaaatctctaggaaaaggtggcgatgtctctgaactgtagtgccacccactcatacccaatgcgggtgttcttggaactgtcatggcaccaatgggtgtgtgacttagtatgttaatgagcatataatgaggtcctaggtgaaatctaggtcaaatccagtgccatattgggtctggttggtcttagccagctctgttcacatgttgttcacttaccagcccatagcctctagtcatgtgaaactgctgcctggagttttctatactcaggtgaccacccagtattattcctgtctcattttatccccctcagagacttccatcccttattcttaagggttgatgagggaggaggacagttttctatatctgcttcctgctgatttaggggcattggccctgcctggcaccagcatggaaacctctggctgcctgctctaagggtcccaagggtgggtcatcagaagagtctgcatctgaggcagggattgcttggaatccttgcatgaccatcattttgacgtggaactttgcaacctagaagacataactttacaaagaggttaaacaagcaaggactaaaaaccaataataagaggatagctactagaagtcctagggaaggtaggaaccatgtcacactaggtaggtagcctttgatggggtcccagatggcttgcatgatagagttattgaaattatttagctggatagcccgttggtaaatcttttgaacttgtagttcagctaatactgaactgttagtataagaacagaagatggggcttattgcagcgcaagcccctccgagcagttgatgctttggcccagttagggcctcatgcagtggcttagtaatgagctgaaatcctgggatccaaatcgtgccatacctaggaaagttatgagttgcttcttcatttgtgaaggtctcgtctttaagatagcctcctattgtttgacagacaagatccggtttcctgggcttaggatgtatcccagatattttatttccattttagaaatctgggccttagatggagagacctgataatcttctttctcccaggaagtttaggacttgaatggtattcttatctgagttctctttagtggaactatatacaaggatgtcatccacatcttggagtacggcttccctttctacctctagctcccttaattctcatgccgaggcattgctgaacaagtaagggctatccctaaagccctgaggcagtactgtgcaggtgtactgctgggtaataatagtttcaggattagtccactcaaaagcaaacaaatattgagagtcagtgtgcagagggatacaaaaaaaaaagcatccttgagatcttataccatgaaccagcccttgctctaatgtcccagcttcctacactagaagcggcaaccatttcctacaggtttgctgttagggctgtttggtccttgggcgaagaatccccctgggtgtcatttgggcctgctgtctgtcccattgtttgccatgctgagtcctttcagcctcttcagccctatccctattattgaataacctaaaagctacatgaaacatgtgagtaataggcatttgggatcccaaagccaatttctgcactttcctcctcatgttcctcctgatgtcagatgctgatagactaataaagtatgtccttagaaaaatttggccagcatcaatattgggttcaatgttagcatatattttttagggccttcacaaggctcccctggaacacagcagggttttcatcttttctttgagttatttcccttattttattatagctcacaggcttagtggtacctttttttcattcctttcactaaacaagtcatcatgtgatttttttttttcttagataagcctggccctgttgataattccaattagggccactgttaggcacagacatggcctttacagtatattgttcggggtcccaagccaacaaggtgtcagcataagcctgggcctgtgcccaaatacactgcttttcctcaggggtacaacacatggacaagataatatgaatatgtccccaggttaactcagatgagagtgagagagcccagaacccctccataactttagttaggtcctctgaaaattggcccaacctctgtctgcagtaggctagatcagacatcgaaaaagatacacccagatagtcccagcacccccactggccacctccctaagtgggcataacttagaatggtcaagaatgtaggaaatgcactgtgggcaaccctagcagggctctgctccttctgtagagaagggtgtgaaggttggtaaggagatggactagcaggagtctgggggtacatttcccaaaagggggatcgtgcagggtatctggtgtcccatttggttcccctaaagggctgtgagcctaacaaaggcagcagttcccgcgagggtcaaggttctgataaagagccgtgaaggcttgtattaatacatatgctacttcagtccacttcttctgatgtttacaaaaaagatttaattccaagatggtattgcattttacggtcctagactctggccattgcaccccattttctaaaagagagttacccatagccttgacttgtcctcggcacgacctgaaagagaaaagaacagtatagtttcctcttcggagggactagttccagcatttacaaaatgccaggtgaatgagctggtggttctaatgtggctgtggatgctctgggctaggtggccataaagatgatactggtggactgcagtggagtccccagatgccaatgggacctcagccccagccagtgtccaggctcttgacaccagctccatggtcaggccggggagacagttgtccatgttcccttggctggctgccttggtgtccaggtgtccctggagccctagtgttgcccaggcgtccatggcccctggggctttgctttcaaggttgagtaggatgagtgtggacctagtttgaaagcagcaagcctgccaaaatccatctgaatatttattaccaagtaaaacttcgtagtagagataattcagcatggccaaataatagccaccttgaagggcccccttaaaacaataggcctagatttggcattccagcggacctattttgctgtgtccagagttcactaaacttttgtgtgaagtatgaggaagaagcatgagaagagaaaaccacaaaagcagggtttaaagagagatgggaaagggaaaacagttcccaaccaaggtcagtgtcttagcgcagctggtcccttgggagaacagaagacttcccaggaataagtcataatgctccttggcagctgtccagccactgggacatgggattttaccctactcaccctcattagcctcttgcccaggaggcccatggcacctcagagctcaggtgtaggtcaaagccttcccacctccatttgtcactgtcagggcgaactgcgttttccagctggaggaagcagaggcactacggctgaggggagtcaggctgtaggaacaaggaagaaagtagcagtaactccagagaacgagaagactccaattaaggccccaatgggacttaccaactgctggtggttctaatgtggctgatgatgctctgggctggatggccataaagatgatactggtaggctggagggggggggtccccaaatgccgatgggacctcagcgccagccggtgtccagactcttgacaccatcatgagaaggaattcaaggatgagtcagaaaatagtgaaagtacagagattttatttcaaagcaaaaagtgcacactcaagggagtgtgggggtactcaagagagttgcatcttgttttgttcatttagtattttcttctaagatttcacccttgtttttgcttatagcttttgttcacttaaattctattttatatttccttgataatttcccagcttataacttttgagatgtaactcataaaccataaaactcaccttttaaaagtatatagttaatttttagtatattcacaaaactatgtaaccaccaccactaattccagaccatttgcatcacctcacaaagaaagcacccaacccattaacagtcactctgcattctccttttccctctcgccctggaaaatacaaatccatttttttgtctctggatttgcctgttctggacatctcatataaatggaatcacacaatatgtggccttttgtttctggcttctttcatttagtataatgttttcaagattcgtttatattgtagaagttatcagtacttctctttatggctgaataatattacattgtataaatataccgtattttatttatccattcatctgttgatggacatttggctcgtattcattttttggctattaatgaataatgctgctataaatggtcatgtgtaattttttatgtgacaatacatttcagttctttggggtacatacctaggatcagaactgctaggtcataatataactctgtgtctagctttttgaggaactgccaaactgttttccaagggggctgcaccattttccattttatcagtagtgtttgagagcccaatttctccacatcctcaccaacacttgtcattgtctgtcttttttattatacccaccccagtaggtgtaaagaggttgtgtgaatctagttgtggttttgatttgcattaccctagtgatcagtgatgttgaacatcttttcatgtgtttattgccaatctccatatcttctttggagagatgcctatttaaaatctttgcccatttaaaaaattaggttgtcttttattgttgaattgtattagttctttgtatatgttggatactaaacccttatcagatacataatttataaatgtttcctccaattctttgggtcatctcttcactttcttgatatagtgttctttcaaacacagaagttttacattttgataaagtctaatttttctgtgttttgtttgcttgtgcttttggtattacccctaagaaaccattgcctaattcaaggtcacaaagatttacacctgttttcttcaaagagtttattatagttttacattttacatttgggtctttgatccattttgagatcatttttgtgtatgctgtgggatagagattcaacttaattctttgcatgtggctatccagttgtctcagcaccgtttcatgaaaaacgatttgttctccattgaattgtcttggtgtgcttgtcaaagaattgtgattttaatttctaatttcctaattactaatgagtttgacaacttttttctgtgtttactatccatttggatatcctttctattgaaatatttgtttgagttttacccagtttttaacttggttttctgctttgttcccattgattttctaggagttctttatgtcttctaaatgtgagtccgatgttgattgtatgtgttgcaagtagcttttcccatactctagcttgtctcttccctttcttggtgtcttttgatgaacagagctccgtaagtgtaaggtagtcacatttatcagtcttttactttagaaataatgtgtttggtgtcttgcataagaaacattttcttaccccaaattcacaaatatatcctctgtactattttccataagcattatagcttcaactttcatattttaggtttgtaatctacctggaattgtttcatttttttttcttttttggatatagtataaggtagcaatttaatttctttcttctccatatgaaaacccaataatctcagcaccattagttgaaatatgtgtctatacccactactgtgcaatattagctttgttataaatcaggtgtctttatgtggattggtctatttctggactcatattcaccactgctttttatttctgtttatgtgccagcaacactccaccttattataatagctttctttatgttagtgtagatgtatgctagagaaaatcttcctcccttacttttctgtaagagtattttccagctcttgttttgcatcattacttctctgtgtgtgtctatataatttcatcagggattacttaaccttcccttcagtggagtttgcctcttcctaggagattctcaccaaggccattaataacaaccaaggagttccaacctggccagtcttattttccagatattttattcattgggactttagggctatttcccagttgcagttagtgattagccatcctgatgactgggcatgctgccaaaatgccaaaatgagtctttcacctctggtcctttgctttacttccagaaaactgcagtagaaacctgacctgatgtccagttttctgtgacagtttttatgtaattaagcgcaaatggccaagtagaattcatacaaagcctactagagtaatattcattggaggaaaacttataaagcctggagtaataccagatgcacttgtccccacattgcccattctttctatgtcagtgtatagaagtctaatgacattttcatactatgagatagggcttacaaccttgggctttatagtttttaaactgcattaagtacagaagctgaagctactcactgttgtgatcaggtgggatacaagagcagcataatgtggcatagttttggtgtaagcccaattttgacaacctagcataaattttgaggggaagtatcccttccctggtataatcagaggctgtgacccagatcttacaggtatatgacatggcatgccagtagcaggaatctttgtcagcattcacggttagggaagtatttaatatcagccttcccttggcatgatgaaaagtctggcgtgtttgctatattttttaaaaaagataccccttatcaaatcataaaagttctttttattcctagtttattgattttttatgatgaatagatttgtttttaattttaccatgcttttcctgccattagggaaagaatcatttgatttttctttgttattattataatattgtttaattttaatctgttcatattattttctagttttgtactaccttgagaaatttggactcttttttttttttttttgatcattcttgggtgtttctcgcagagggggatttggcagggtcataggacaatagtggagggaaggtcagcagataaacaagtaaacaaaggtctctggttttcctaggcagaggaccctgtggccttccacagtgtttgtgtccctgggtacttgagattagggagtggcgatgactcttaacgagcatgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaattttttgttagtacagaacaaaatgaaaagtctcccatgtctacctctttctacacagacacggcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccgggcggggggctgaccccccccacctcccttccggacggggcagctggccgggcggggggctgacccccccacctcccttctggacggggcggctggccgggcggggggctgacccccacctccctcctggagggggtggctgccgggcagagacgctcctcacttcccagacggggtggctgccgggcggaggggctcctcacttctcagacggtgtggctgccgggcagaggggcttctcacttctcagacggggcggttgccaggcagagggtctcctcacttctcagacggggcggctgggcagagacgctcctcacatcccagacgggggggcagggcagaggtgctccccacatctcagatgatgggcggccgggcagagacgctcctcactttccagactgggcagccaggcagagaggctcctcacatcccagacgatgggcggccaggcagagacgctcctcacttcccagacggggtggtggccgggcagaggctgcaatctcagcactttggggggccaaggcaggcagctgggaggtggaggttgtagcgagccgagatcatgccactgcactccagcctgggcaccattgagcactgagtgaacacaactccgtctgccatcccggcacctcgggaggccgaggctggcggatcactcgcggttaggagctggagaccagcccggccaacacagcgaaaccccgtctccaccaaaaaaatacgaaaaccagtcaggcgtggcggcgcgcacctgcagtcgcaggcactcggcaggctgaggcaggagaatcaggcagggaggttgcagtgagccgagatggcagcagcacagtccagcttcggctcggcatgagagggagaccgtggaaagagagggagagggagaccgtggggagagggagagggagaccgtggggagagggagagagagaccgtggggagagggagagggagagggagagctctcctgaacatttaaagaagtagagaaatttggactcttacattcataaaaataggttatagatggggtaaaggcttaaataaacagaacctcaaattttcatctagttaaaactaaacataagaaaaatacaatcttttgataggaaaaataaaatattgatagtttttacaacaaaaatttaacgtcttttacgattaaaaaatacataaagttagacaaaaatagactgggagaaaaatatttgctacacatacatttgctactcatggagaactagtatccaaatatataaagaactcttacaaatcaggagaaaagatatcctgatggagaaatttgggattaacgcgcagctccagatgaggaaatgcacctgccaataaacaaaaataagcatcacctcactattgattagagaaatgcagactaaaacaaggtgacattattttttcatctatcaggttgaacaaatttaaaatgttttgtagtatctagtgttggctagaacatgggtattctcataccacattgctgagaatataaattggtagaaatactttgtaaggtaatttggtagtgtctattaaaaagtaaacatggccaggtgcggtggcacacacctgtagttccagctactggggaggctgaagtggaaggattgcatgaggccaggagttcaagactagccccgccaacatagcaagaccctgtctctaaatttttttttttaagttagccaggtgtggtggtgagcacctatagtaccagctacttgggaggctaaggtgggaggatcacagaaggccttcaaggttgcattgagctgtgatcacacctgtaaattgctactgcactgtagcctaggtgacacagtgagacccgactcttaaaaaaaaaaaaagtaaacctgtacagtgtttggaatccagcagtttctcccttgcatatctgctgcagagaaacacttgtacactttcacaaggaaacatatacaaatatttcaattccagtattacttgtaatatcaaaatattgagagatgtctttaacatcctttgaattaacgattggacaaaatgtttagttgtattatgggatgttataaaatgtttaatcaggaattaattattgtttcatgaaaaaaaaaactgtgtgaagtaaatatacagccaatgccatttctgtaaaagaaaaaactacacactgaatatagtttctccttgtgtgtatatgtgtgtggcggggggtaaatatttttttatattgggaaagataaataacaaattctcattatagtcattatctttagggagctgggagaagaggactgcattggggaagattgtcaaagaggactgtctccatgttctaagctttttttttattattatactttaagttttagggtacatgtgcacaacgtgcaggtttgttacatatgtatacatgtgccatgctggtgtgctgcacccattaacttgtcatttagcattagatatatctcctaatgctatcccttccccctccccctgccccacaacagtcctcagtgtgtgatgatccccttcctgtgtccatgtgttctcattgttcaattcccacctatgagcaagaacatgcggtgtttggttttttgtccttgtgatattttgctgagaatgatgatttccaatttcatccatgtccctacaaagaacatgaactcatcattttttatggctgcatagtattccatggtgtatatgggccacattttcttaatccggtctatcattgttggacatttgggttggttccaagtctttgctattgtgaataatgctgcaataaacatacgtgtgcatgtgtctttatagcagcatgatttgtagtcctttggatatatacccagtaatgggatggctgggtcaaatggtatttctaattctagatccctgaggaatcgccacactgacttccacaatggttgaactagtttacagtcccaccaacagtgtaaaagtgttcctatttctccacatcctctccagcacctgttgtttcctgactttttaatgattgccattctaactggcgtgagatggtatctcattgtggttttgatttgcatttctctgatggccagtgatggtgagcattttttcatgtgttttttggttgcataaatgtcttcttttgagaagtgtctgttcatatacttcgcccactttttgatggggttgtttgtttttttttcttgtaaatttgtttgagttcattgtagattctggatattagccctttgtcagatgagtaggttgcaaaaattttctcccattctgtaggttgcctattcactctgatggtggtttcttttgctgtgctgaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccctcttgaattaatttttgtataaggtgcaaggaagggatccagtttcagctttctacatatggctagccagttttcccagcaccgtttattaaatagggaatccatgttctaagttttaaaagaggaatttaaatttaaaaatttaaaggtgaatattgtacaattaaaatttttattcaaaagcaagtattatattttcatttgcatttaacattaacagaatgatttttgtagtaacaatatccaactggatattggaaagcattttaggactatagagaatagagccttctgttagtttcttgaatagtatttttcttttcttttcttttcttttttttgagatggagtctcactctatcgcccaggctggagtgcagtggtgccatctcggctcactgtagcgtccaccttctgtgttccagcgattctccttccttagcctcccgggtagctgggattacaggcatgcgccaccatgcctggctaatttttgtattttcagtagagacggggtttcatcatgctggccaggctgttctcaaactcctgacctcaggcgatctgcctgcctccgcctcctaaagtgctaggattacaagcgtgagccaccacgcccagctgaatggtattttttaatataatagaatttatgatgggttaatattaaaggataggaattatatgtaatttataaactgcttttaaaatgcaagagttttttattactgttgagtgttggctaatagctatggttctaatcaatcatagtttgttgattggaattgaaagaagttacttttggtgccacttatagataggaaggaaaagattcacatttaggatgctgtaaatacttattttttagaaaatttttccataagttggctgggcacggtggctcacgcctgtaatcccagcactttgggaggccgaggtgggcagatgacgacgtcaggagatcaagaccatcctggctaacatggtaaaacgctgtctctactaaaaatccaaaaaattagcccggcgtggtggcgggtgcctgtagtcccagctactcgggaggctgaggcaggagagtggcatgaacccggaaggcagagcttgcagtgagccgagatagcgccactgcattcctgcctgggcaacacagcgagactctgtctcaaaaaaaaatttttttttccataagttattggggtacaggtggtatttggttacacaagtaagttctttagtggtgatttgtgagatgttggtgcacccatcacctgagcagtatacactccaccatatttgaagcctttaacccttgcctgcttcccactctccccccaagtcccaaaagtccattgtatgattcgtatgcctttgagtcctcatagcttagctcctaatttaagtgagaacatacaatgtttggttttcaattcctgagttacttcacttagaataatagtctccaatctcatccaggttgttgtgagtgccattaattcattccttttttatggctgagtagtattccatcatataaatataccacagtttccttatccacttgttgattgatgggcatttgggttggttccatgattttgcagttgcaaattgtactgctataaacatgtgtgtgaagtatcttttttatataatgacttcttttcctcgagtagatactgcgtagtgggattgctggatcaaatggtagttctacttttagttctttaaggaatctccacactgtttttctatagtggttgtactagtttacattcccaccagcagtgtagaagtattccctgttcaccgcatccatgccaacatgtactgttttttgatttttttgattgtggccattcttgcaggagtaaggtggtatcacattgtggttttgatttgcatttccctgatcattagtgatgttgagcatttttttatatgttcgttgctcatttgtatatcttcttttgagaattgtctattcagttccttagcccactttttgatggaattgtttttttcttactgatttgttagagtttgttgtagattctggatattagtcctttgtcagatgtatagattatgaagattttctcccactctgcggggttgtctctttactctgctgactgttccttttgccgtgcaaaagctctttagtttaataaagtcccaactatttaatctctgtttttattgcatttgcttttgggttcttgatcattaaatgcttgcctaagccaatgtgtagaagggtttttccaatgttatcttctaggatttttatagtttcaggtcttagattttagtccttaatccttcttgagttgatttttgtataaggtaagcgatgaggatccagtttcattctgctacatgtggctagccagttatcccagcaacattagttgaaaagggtgtcctttctcaactttatagttttgcttgctttgtcaaagatcagttggctgtaagtatttgggtatatttctgggttctctattctgttacattggcctatgtgcctgtttttataccagtaccttgctgttttggtgactctggccttatagtataatttgaaatcaggtaatgtgatgcctccagatttgttcttttagcttagtcttgctttggctatgggctcttttttggttccatatgaattttagaatttttttttctaattctgtgaagaatgatggtggtattttgatggttttgatggggattgcattgaatttgtagattgcttttggcagtatggtcattttcacagtattgattctacccatccatgagcatgggatgtgtttccatttgtttgtgtcatgtatgatttctttcagcagtgttttgtagttttccttgtagaggcctttcacctccttggttagatatattcctaagtattttattttttttgcagctattgtaaaaggggttgagttcttgatttgattctccgcttagttgctattggtgtatagaagagctactgatttgtgaacattaatcttgtattcagaaactttgctgaattcttgtatcagttctaagagatttctggaggagtctttagggttttcaaggtaaatgatcctatcgtcagcaaacagtgacagtttgacttcctctttatcgatttggatgccctttatttcttgggcatccttgtctgattgctctggctacaacttctatgttgaagaggcgtggtgagagtgggcatcgttatcttgtttcagttctcagagggaatgctttcaacttttccccattcaatattatgttggctgtgggtttgtcatagatggcttttgttacatcaaggtatgtccgttgcataccaatttcgctgagagttttaatcataaagggatgctggattttgtcaaatgctttttctgcatctattgcgatgatcatgtgatttttgtttttaattttgtttatgtgatgtatcacatttattgacttgtgtatgttaaaccatccctgcatccctggtatgaaacccacttggtcatggtggattatccttgatatattgttggattcagttagctagtattttgttaaggattttagcatctgtgttcatcaaggatatcagtctgtagttttctttttttgttatgtcctttcatggttttggtattagggcaatactggcttcatagaatgagttcgggagggttgcttctttctctgtcttgtggaatagtttcaaaaggattgggaccaattcttctttgaatgtctggtaaaattctgtgaattctgtgaaaagtctggtcctggactttaaatctgaatctccctcaagtaaacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattctagttatacattcttctaaatttttttcaaagctttcaacttctttgcctttggtttgaatgtcctcccgtagctcagagtaatttgatcgtctgaagccttcttctctcagctcgtcaaagtcattctccatccagctttgttccgttgctggtgaggaactgcattcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtcttttggttcgtctgtgctctgcccccagaggtggagcctacagaggcaggcaggcctccttgagctgtggtgggctccacccagttggagcttccctgctgctttgtttacctaagcaagcctgggcaatggcgggcgcccctcccccagcctcgctgccgccttgcagtttgatctcagactgctgtgctagcaatcagcgagattccgtgggcgtaggaccctccgagccaggtgcgggatgtaatctcgtggtgggctgttttttttttttgtttgtttttttttgtttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggcctgggctgttttttaagccggtcggaaaagctcaatattcgggtgggagtgacccgattttccaggtgcgtccatcacccctttctttgactcggaaagggaactccctgacccttgcgcttcccaagtgaggcaatgcctcgccctggtttggcttgcgcacggtgcgtgcacccactgacctgcgcccactgtctggcactccctagtgagatgaacccagtacctcagatggaaatgcagaaatcaccggtcttctgcgtcgctcacactgggagctgtagacgggagctgttcctattcggccatcttggctcctccttctcaatcattctggacttttttttgttggtaatttttaaattaccatttcaatctcgctgcttgttattggtctgttcaggggatctaattcttcctgatttaagctaggagagttgtatttttccagcagtttattcatttcttccaggttttctagtttatgtgtgtaaagatgttcattgtaggtttgaatgatcatttgtatttcagtggtgtcagttgtaatatcttctgtttcgtttcttaatgaagttatttggattttctctcttcttggttgatcttgctaatggtctatcaattttatttatctttttgaagaaccagctttttgttttatttacctttggtatttttttgtttgtttgtttgtttcaatttcatttagttttgctctgatcttagttatttcctttcttctgctaggtttaggtttgggtttggtttgttcttgtttttctagttccttgaggtgtatccttataatgtcagtttgtgctctttcagtctttttgatgtaggcacttgaactttttgagcttttgaacttttgagcttttgatggagggctatgaactttcctcttagcactgcctttgctgtattccagaggttctgataggttgtgtcattattgttcagttcgaagaattctttgatttccatcttgatttcatgttgacccaatgcttactcaggagcaggttatttaatttccatgtatttgcacggttttgaaggttccttttggagttgatttccagttttatttaactgtggtctcagagagttcttgatataatttcaattttcttaaatttattgaggctcgttttatggcctatcatatggcctgtcttggagaaagttccatacactgttgaatagaatgtgtattcagtggttgttggataagatgttctatatatttgttaagtccatttgttcgaaggtatagtttaaatccattatttctttgttgactttctgtcttgatgacctgtctagtgctgtcagtggagtattgaagtcccccactattattgtgttgccatctatctcatttcttaggtctagtaatacttgttttataaatttgggagctcaagttttgggtggatatatgtttaggattgtgatattttcctgttggacaagggcttttaccattatctaatgtacccctttgtctcttttaactgctgttgctttaaagtttgttttgtctgatataagaatagctacccctccttgcttttggtgtccatttgcatgaggtatttcataaaggcacccctgtactttatgagagtatgtgttaggtgagtctcctgaaggcagcagatggttggtgagttgttatccattttgcagttctgtatcttttaagtggagcatttaagctatttacactcagtgttagtattgagatgtgaggtactgttgcattcatcatgctatttgttgcctgtgtactttggtttttttgttttttgtttttgccttttaacttatatttttgttttataggtcctttgtgatttatgctttttaaagaggttctgttttgatgtgtttccaggatttgtttcaggatatagggctccttttagtagtccttgtggtggtggcttggtagtggcaaattctctcagcatttgtttgtctgaaaaagactgtatctttcctttatatatgatgcttagtttcgctggataccaagttcttggctggtaattgtcttgtttgaggagactgaagataggacccaatcccttctagcttgtagggtttctgctgagaaatctgctgttaatctgataagttttccttgataggttatctggtgcgtctgtctcacaactcttaagattctttcctttgtcttaactttaggtaacctgatgacagtgtgcctaagtgatgatccttttgcaatgaatttcccaggtgttctttgtgcttcttgtatttggatgtctaggtctcttgcaaggccggggaaattttccttagttattcccccaaatacattttccaaactttcagatttctcttcttccttaggaacatcgattattcttaggtttggtcgtttaacataatcccagacttcttggagtctttgttcatattttcttattcctttttctgtctttattggattgggttaatttgaaggccttgtctttgagctctgaatttctttcttctacttgttcaattctattgctgagactttccagagcattttgcatttctgtgagtgtgtccagtgcttcctgaatttttgattgttttttttctttaagcaatctatttccttgaatatttctcccttcacttcttgtatcattttttggatttccttgcattgggctttgcctttctctggtgcctctctgattagcttaatacctaacctcctgaattcttttacaggtaaatcaaggatttcttcttggcttagatccattgctggtgaactagtgtaattttttttgggggggaggtgttaaagagccttgttttgtcatattaccagagttggttttctggttccttctcatttgggtaggctctgtcagagggaaggtctaggcggaagtctgttgttctgattcttttgtctcatggggtgttgcttggatgtagtactctcccccttttcctatggacgtggcttcctatgagccaaactgcagtgattgttgtctctcttctgggtctagccacccagcaagtctacccagctccaagctggtaccagggattgtctgcagagtcctgtgatgtgaactcctgatctcaggtgatccacctgcctcagccatccaaagtgctgggattacaggcatgagccactgcacctggcctcagttctttaactttatgctctttcacttaatataatatttttgaggttcactgtgttgtagcatgcatcagtacttcattcctttttatgactgaatactcttccatggtacggctagaccaaattttgtttacttgttcattaattgatgggcacttggttttttcattagttgatgggcacttgtttttctttcccattttcatctattatgaataatgtggctctgaacattcatatataaagctttgtgtgtacatatatttttccattttcttgcaaagatttctataaatagaataactgggtcatatgatgagtttatgtttaacttttaaagaaattgccaaactattttccaaaataaccataccatttctattatgtatgagaatttcagttttctatgtctttatcaacacacttatacattgttggtgtgagtgtaaattagttcaaccattgtggttgaacttacctatgtaacatgtaccattagctatgaacaaaccttcacatgtacccctgaacctaaaattaaaagttttttaaaaatcacgcatgggtgttagattttgtcaattgacttttgttcatctatgaagataattatgtggtttttattctttatattattaatgtgtgttagatttttgtcaatggatttttattcatctgtgaagatgattatgtggtttttgtcctttatattattaatgtaatatataatgtgattttctggtgttaaaccacttttacgttcctgtgattaatgccacttaattatgtatataattctttttacatattactggattcagtttgctgatatttgttaagaatttttgtttttggtagaagggagattgtactgtaattttcttgtgaaatatttgtcatgcttttttatctgaatagtactagcttcatagaattagttggttagtaaatgttcttttctcatttattttctgaaagagttgtgaagaattggtattattattattttaaatatctgatagaattaactggtgagaccatctggatctgtggtttttttttttttgaggtgtgatttttaataactaactcattagaaattatttagattttctgtttctttttgagtcatctttagtagtttggtatttctaggaatttttccatttcatctaagttatctaatttgttgtcatacaattgttcataatagttcctcataattattttcatttctttagtgtcagtagtgatgtgttccctttttcatccctggttttggtaatttgtgtctttcctctttttttcttggttagtttagatgaaggtttgtgaattttgttgatcttttcaaagaaccaactttgggtgtcactgattttttttattattatttttctgtgttctagtcaattaacctgtgctctaatatttattatttcctttcttctgcttgctgcaggcttactcttcctaatttcttcatgtggaagcctaggttattgatttgagacccttttttgtttttgatacaggtttctaaaataaatttttctccaagcattgctttagttgagccctatacattttgatttgttgtgttttcattttcattcaacttcaaatattttctcatttcccatttgatttcttcttgatccctgagttacttggaagtgtggtgtttaattttgaaatatttaaggatttccctggtttcttttctgttgttgatttataatttaattcagttctggttgaacaacatactttgtatgatttctgtcattttaaatgtattgagatttgttttgtgacttggtatttaattcgttcttggaaatgattagcactgagaaagaatttgtatttttacagttactgggttgaatgttttctataatcagttagcttgagttggttgatcatgttgttcaagtcttctgtatccttgatgattttctgcttagttgttctatcagttattgggtgggactagacatctccaactattatttttatttttatttattttatttcaataggcttttggggaacaggtggtgtttggttacatggataagttcttcagaggtgatttctgagattttggtgtacccatcacccaagtagtgtacactatacccaatgtgtagtcttttatcccttactcccctccctctcttccccccaagtccccaaaatccattgtatcattctcatgcctttgcgtcctcatagcttagctcccacctttaagtgagaacatgtgatgtttgggtttcctttcctgagttacttcacttagaataatggtctccaactgcaccctggttgctgcaaatgctattatttcattccttttaatggctgagtagtattccatggtgtatatatgtgtgtgtgcgcgcgtttgtgtatatatatatatagagagagagagagggcgcattttctttatttacttattgattgatgggcatttgggctggttccatatttctgcaattgtgaattgtgctgctataaacatgagtgtgcaagtgcctttttcatataatgacttcttttcctctgggtagatacccagtagtgggtttgctggataatggtagatctactttttagttctttaagtaatctccacactgttttccatagtggttgtcctagttcacattcccaccatcagtgtagaagtgttcccttttcaccatatccacaccaacatctatctttttattttttaattatggccattcttgcaggagtaaggtggtaccacattgtggttttaattttgcatttccctgatcattagtgatgttgagcatttttttcatatgtttgttggccatttgtatatcttcttttgagaattgtctattcatgtccttaacccactttttgatgggattatttgtttttttcttgctgatttgtttgaggtccttgtagtttctggatatcagtcctttatcagatgcaccatttgcaaagcttttctcccactctgtgggttgtctgtttactatgctgattatttctttcgctgtacagaagctttttagtttaattaagtcccatctatttatctttgcttttctcgcatttgcttttgggttcttggtcatgaagtctttgcctaagcaaatgtgtagaagggtttttccagtgttctaggattttaatggtttcaggtcttagatttaagtctttgatccatcttgagttgatttttatataaggtgagagatgaggatccagtttcattctcctacgcatggctagccaattagcccagcatcatttgttgaataggatgtcctttccccgctttatgttttgctttctttgttcaagatcagttggctataagtagttgggtttatttctgggttctctattctgttacattggtctctttgcctatttttataccagtgccatgctgttttggtgactgtggccttatagtatagtttgaagtcaggtaatgtgatgcctccagatttgttctttttgcttagtcttgctttggctatgtgggctctttttttggttccatatgaattttaagatttgtgtgtgtgtgtggttctgtgaagaatgatggtggtattttgatgggaattatgttgaatttgtagattgcttttggcagtgtgatcatttcacaatattgattctactcatccatgagcatgggaggtgtttccatttgtttgtgtatgatttctttcagcagtgttttgcagttttccttgtagaaatctttcacctccttggttagatatattcctaagtattttattttattgcagctattgtaaaaggggttgagttcttgatttgattctctgctggctcactgttgctgtatagcagtgctactgatttgtgtacattgattttgtaacctgaaactactgaattcatttatcagatctaggagctttttggatgagtttttagggttttctaggtagacagtcatatcatcagtgaacagcaacagtttaacttcctctttaccaatttggatgtcctttatttctttctcttgtttgattgctctggctaggacttccagcactatgttgaatagaagtgatgaaagtgggcatccttgtcttgttccagttcttggggaatgctttcaactttttcctgttcagtataatgccaactgtgggtttctcctagatggcttttattactttaaggcacatcccctctgtgccgattttgctgagggttttaatcataaagggatgctggattttgtcaaatgcttttttggcatccattgaaatgatgaagtgatttttgtttttaattctgtttatgtggtgtatcacatttattgacttgcgtatgttaaaccatccctgcatcactggtatgaaacccacttggtcatggtggatatctttttgatatgctgttgaatttggttagttatattttgttgaggatttctgtgtctgtgttcatcagggatattggtctgtagttttctttttttgttatgtcgtttcctggttttggtattagggttatactggcttcttataatgatttaaggaggattcactctttctctatcttttggaatagtttcaataagattagtaccaattattctttgaatgtctgatataattcagctgtgagtttatctggtcttggacttttttttgttggaaactttttattaccatttcaatcttgctgcttgttattggtctgttcagagtttctatttccctcctggtttgatctaggagggtttgtatatttcccaggaatttatccatcacttctagattttctggtttgtgtgtataaaggtgttcatagtggccttgaatgatcttttgtatttctctagtattttggttttaatatctcccgattcctttttaattgagcttacttggatcttctctcttcttggttagtcttggtaatggtctgtcaattttgtttatcttcaaagaactagctttttgtttcatttatcttttgtattttttgttgttgttgttgtttcagtttcatttaattgtgctctgatcttggttatttcttttctcttgctgagtttaggtttggtttgttcttgtttctctagttcctggaggtttgaccttagatcatctatttatgctctttcagactttttggtgtaggcatttagtagtatgaactttcctcttagcaccttttttgctgtatctcagaggtctgtatatactattattgttcagttcaaagaattttttaatttccatcttgatttcattgatgacctgacaatcattcaggagcagattatttaatttccatgtatttgcctggttttcaaggttccttttggagttgatttccagttttattctactgtggtctgagagtgtacttggtataattttaattttcttaaatttattgagacttgttttgtggcctgtcatatggtttattttggagaatgttccatgtgctgatgaatagaatgtatattctgcagttgttgggtagaacgttctgtaaatatctgttaagtccatgtgttgtagggtatagtttaagtccgttgtttctttgttgactttctgtcttgatgacctgtctcgtgctgtcagtggagtattgaagtacaccactattattgcgttgccgtctatctcatttcttaggtctagtagtaattgttttataaatttgggagctccagtgttaggtgcatatatatttaggattgtgatattttcctgttggactagtgcttttatcattatataatgtccgtctttgctttttaaactattgttgctttaaagtccgttttgtctgatataatagctactcctgctcacttttggtgtccatttgcatggaatacctttttccgcccctttaccttaagtttatgtgagtccttatgtgttagatgagtctctttaagacagcggacttggttggtggattcttttttttgagacagagtttcgctcctgttgcccaggctggagtgcaatggcgcgatcttggctcaccgcaacgtccgtctcccaggttcaagtgattctcctgtgtcagcctcccgagtagctgggactacaggcatccaccaccatgcccagctaatttttgtatttttagtagagacagggtcaccatgttggccaggctggtctcaaactcctgacctcgtgatctgcctgcctcggcctcccaaagtgctgagattacaggtgtgagtcaccgcacctagccctcttacattcagtgttattactgagatgtgagtgaggtactattctattcatcatgctagttgtagcctgaataccttgttttttatttttcattgtgttattgttttataggccctgtgagatttttttctttaaggaggttctattttggtgtatttcaaggttttgtttcaagatttaggactccttctacagttattgtagtgctggcttggtggtggcgaattctctcagcatctgtttatctgaaaagaactttatctttccttcatttatgaagcttagtttcactggatacaaaattcttggctgataattattttttttaaggaggctatcgataggaccccagtcccttctagtttgtagggtttctgctgagaaatctgctgttaatctggtaggttttcctttatagcttacctgatgcttgtgcctcacagctcttaagattctttccttcatcttgactttagataatctgatgactaaatgcataggtgatgatctttttgtgatgaattttctggctgttctttgagcttcttgtatttggatgtctaggtctcttgcaaggccggggaagttttccttgattattccttcaaataagttttccaaacttttagatttatcttcttccttgggaacaccagttattcttaggtttggtcatttagcataatctcaaacttcttggtaccacccagttggtagtttttttatcctcatcctctcccaccctacaccctcaagtaggctccagtgcctattgttcccttctttgtgaccatgtgcactcaatgtttagcttcccttataagtgaaaacatgcagtatttggttttctgtccctgtgttaatttgcttaggataatggcctccagctctatcgatgttgctgcaatggacataatctcattcatttttatggctgcatagtattccatggtgtatatgtactacgttttcttcatccagtccactgttgttgggtatctaggttgattccatgtctttgctattgtgtgtagtggtgcagtgaacataggagggcctgtgtctttatggtagaactgttagtccaaactgtaccattttgtaagccccttgtcatttcatagaccttgatcaaagtgaaacattccttgggggactgggccgtgagaaacatcctgcccgactgcctgactttcttatcacattctgctgggaaaaagtccaaggaacatcactgtcacatcctgccagaacaagggccaaaccacctcatcatgggaacatcttatcaacatcctcccgggcagcaagccataaccctcagacccctccctcccaggcctaaaattgccccagcctgtaagcagaggtgggccctggcattaagctggtgccccgcctctgcaggtcttatgctggacataaaacctgcattgctgtagagccgccaactctctctcagtctttctttaatcctcgccttctcatcaaaacctaagaagaacaattcatattccttcgggttcgtatttagtaatgggattgctggattgaatggtagttctgaggtctttgagaaatctccaaactgctttccacagtggctgaactaatttgcattcccaacagcagtgtgtaagcattcccttttctctgcaacctcaccagcatctgttactttttgactttttaataatagctattctgactggtacaagatggtaccaagcatatgaaaaaatggtcaacatcactaatcattagagaaatgcaaatcgaaaccacaatgagatacaatttcacaccagtcagaatgactatttttatgctttcaacagtttcactctgatgtgtatatatttgaatatttttgtatttattctgcttgagactttttgagcctcttgggtacataaattaatgttttttctaaatcaaacttatgaggttttcagccatggtttcttcttatgttctttttcccctttgtgtctctcttttcctatgaaaactcctatcatccaaaatgttggtacccttggtcatgttacacaggtctccaaagcactgttcatttttcttccttctttttttattttcatcagctggtttatctcagtagatctacaagttttcttattctttcatctgcctgtgcaagtctgctattgaactttttctggtgaatttttcattccagtcattgcactttgcaaatctagaatttctatttggtttcttaaaaaaaaaaatcatttctgtcactttattggtagtctcataagacatcttgttgtacttccctttaaattaaatattttagtttcctttagttctttgaacatatttatattagctgacttaaagtttttgccagtaagttcaacatctgggcttcctcaggaataaattctattgactactttttttcccccatagatgggtcatagttaagtatttctttgtgtgtctcataattattttgtcagaaacattatattttaaatattataatgtgacaacactggtaatcagaccttccctttccctatccctggggtttgttgtttttgttgttgtttgtgaccttcctggactatttctgtagtctttattctgtatcttgtatagacactgaagtctttgtttgattagctgagtcacaaataataatttgacagattttcttaaatgctttaaaccagtatgtctcccatcattttccaacgggtgctgtgtatgttggggcgtgctttccatgccccgggagttcacagctctgccttagccttcacttcctgctttgtgcagagcctcagagtcaagcaaaggttagagagcggagctctgtcaggtctttagtggctgtttgcttagccctgcacatgcacatgaccttctgtatccccagaaatattttagaaattttcaaagccccctaaggacatctcatttctcaaattttccttttaagttttttggccagcctcttgtttgcccctgctaaaattgctgcttctggcagctgcaagattaaccaaatactactgatttttttggacaaactccctgggcatagggcttttcatgctgaatgagctcttgagtcaggtgaagtaaagattagcttgtgaatagggcttttctaggagcaccagacaggtcacatagtgacagttctctggggatgagattttggcccagagctgcttttgtagctaggctgctggcattcacagttactgtggttctgaggctgctggtttccaagactgctatggaactgggaagaggtgcatggaaattgagaatgagtaggttaaaacaccagaaacttcaccatttttactaagattcagctacttttcttaaatagatgttcaggattgttgcaaatctttgattaattttttagagttctgcaaaagttgattttgacaattttgccagtgttctaattgctttgtgatgaaatgaatttttagaaatccctcatccaccattccagaagtgcctctcaatctgcctgtgcttttaatccctatgcatattgcctctctatttgatatctaaataatggcctataaatatttattggcagccatgaaagtccactgtttgatttcattgagagctgcttgcgaaataaacatgaaatggttatttatgaagctgcttcagctatcatccatcttcctaactgcactgcaagagagttggcacctgctgtttcaggtttgttttatatttgatggctggcttttatgttcctaagtttttgctttaagtttcataggtctacagaataggtattaagaatgttttctgaacactagctctgtgtatatatagcctttgcattctgatagcttatatgtagatagtttattttagttgttccttactttattactttttttaatgtttctatttctccatataaaacttttgaaagaattttatttatatgtacatagtttattaataatagttctttattgcttttttttaaagtttctgtttcctcgtatgaaacttttgaaaacattttacagttttccttggtgtttaaaaagcccatttgttttcagaactgtcaatatttctaccatttagttcaggtattaatgggtattctaatttttttttaaaaagagcaaactttgtttcttatttaagtttttataactgaccaaaagtgctttttctttttttttttttctttttttttttttttttgagacggagtctcactctgtcactgaggcaggagtgcagtggcacgatagctcggctcactgcaagctctgcctcctgggttcacgccatgcttctgcctcagcctcccgagtagctgggactacaggcgccccaaaagtgctttttctattttgatgttacatttttcatgtaaatttttgatgctgtgataaaatgtatgcatattttgaatgtgattcattatgtactatattttcagctatatggtatatgatgagataaggaatattcacagcatatataggtaatagtcactgtatctatatctgtattttacttcttcaacttttctatagttctcttaagccaggagtattcacggtatgtatatgtaatattacttaatgttacatattattattattatttttttttagttcttcaacttttctgtagttctcctaagccagccttgagatatgcagctgtgaggaccttgaacaaggtaggtgtttctttgctaattattgacttatatcagtatttaattgagaaacattaaatgtgaagcatttggttttctctccaaggttagtatatgtgatttatgggcttcacctctacaacacttcacttgtatttgtggccttgagtatgctcatttttattattatttagctgaagattataactcatttctgacttctaagcattttatattcaagagccacactgtccaatatggtggccattagccaccagtggctatttcaatttaaattaattaaaataaaaaattcaaccctcagtcacatgagtcacacttcttgtactcacagccacatgtggtcagtggctgttggacagtgcagatcttgaacatttctgtcattgaagaaagttctcttgcacagtgctggtctacagcagccctgtccagtagaaacccactgtgaatcacatatgtaatattaaatttcataataaccacattaaaatttttaaggtaaaattaattttaatagtatattttatcataatacatataatatgtcatctcaacatgtaatagatatttttacatatctcaagtttttgacatccagtatatttacatttacagcatactcagtttggattagccacctttcaaatgcctggtagtcacatgttgctgttggctatgttattagacagtatagatttagaggatataatacagaaacacagaataaattaaataagcatagaaaatgtaaatgaaagttaaatgtaatagaagacttgtcataggcaatacataattataaattaattgtgtaaacagtcgaagaaaagagaagtttagagcagccatggaagaaacctttatagaacaacaatttaaatggttttttatttatttattttttttggagacagagtctcactttgtctcccaggctagagtgcagtggcacgatcttggcacactgcaacctccgcctcccaggttcaagcgattctcatgcctcagcctcccaaatagcagggatcacaggcacctgccaccacgtccggctaatttttgtatttttagtagagacagggtttcgccatgttggccaggctgctctcaaactcgtgacctcaggtgatctgcccacctcggcctcccagagtgctgggattgcaggtatgagccaccaagcctggcctaaattgtttttaaagagttgatacaggtctacaatccctcatctctaatcttggggccagatgtgtctcagaatttgcttttagttaaattttagaaaggttatatggtgttatctcttatttactaaccccagtgggcctggggcagcatcccaccattaaaaaacattaatatttttgcacaaaacatatgactatccttgtcaagtggtataaattaagaattaaagagtttcgcattagtttgggtcatgttttgctgttaaatggattttcatcccagtgctctgctttccagagtgttttcagattttccaaattgtgggtaagggattccataccaatattgggatagacaaagaggtgggacaacatcaacaaaaacaaggatgcaggagaatggcagaccatgtagtaaccatagataatgcagtttggctggagtttgcgtcttgaaatgcagcagtattttttaactgataagatattaacagtctttgtcgagcactgactactatgctagatcctgttgtcagtactcctaacatctaatagaatagacgtatatgaacacacgtactataaggaaatacaggccaattataattttttaaaaatggtaatgttagaaaggttagaggaacctaacaaaagagagtacgatgctatactctggccgttgatcatttattaaaagatataccttgttaactggagccattctttttgtttttgaagcaattacttttaacttatcctgtcctctttggattgccacttacctcaattaaaatttaagttctggcctttatcaaaagcaatttgcttaattttttttcttgcccttccacaaggtggcaatgaagcacccctctgctgttactgcctgcaatctggacttagaaaacttaatcacagactcaaacagaagcattgctaccttagccattactacactcctcaaaacaggaagtgagagcagtgtggaccggctcatgaagcagatatcttcttttgtgtctgaaatctcagatgagttcaaggtaagagtttaaacatgatcatattttctcccagtctgttggctgcctatttattttcttaacggtatcatttgagaagcagaagttttaaatttttatgaagtctaatttatcaatttttttctttcatagttattactgttccctaagaaacctttatctacttgttttctcatgctttaggctaaatgctttatggttttagattttacattttaggcaatgatccaacttgaattactgtttgtttggtaagttcagtattttttccatacctatatctactgtattccaccataatttgttggaaagacttccttttccctgttggagtgctttggcacctttgtctacaaagcaaatacccatatattttaggtatatttttgggctttgtattatgttactgaactgtttgtcaatccagtaccagtaccacactaatattgattaatgtagcattatggtacctcttaagtagtgcggtcttccaactttttcttttttaatattctggttcctttgcatttcctatgaaatttaggaccaatttatcaatttctactaaacaagcctgctaggattatgactgggattgtgttgaatctataaatcaatttggggagaactgacatcttaacattatttttctatttcatgaatatggtatatctctccctttagatcttctttaatttctctgagcagtgttttgtagtgtttactctagaggtcttgcaaatctgttgttaaatttatatctaaatattttatgcttttgatattttattaaaatttttattttattgtttactattaatgaaaaacttttaaaaaatacttctccatattaacttggtatcctgtaaccttgctgagtacttttactggttctagtcatcattatacgtattccttgagattatctatataaataattgtgccatttgtgaatagaggcagttttacttctttatatccaatccaaatgcctttcctttgtttttcttgcctaattaaaaaagtacttccagaacagggttgaatagaactggtgagagtatgtcagagatgattttaaaaaaataaataaataaatttcagttaaaagaataaaagtagaaacattttattgcttcattctttttttatactcagtcaagtaatataactaaccctatttactctctacttagtatgcatccagacttttaaaaaacaaactttacccatgtattcaagcagacagttttgtgcatctggtgtagcagttgctgttctagttttttcaaattgcatttgtaggagtgagttttttgctaaagacgtgtatttgttattaagataccttggctttgattttgagtgcctgtggtagtgggatcttcgtatgacctcttgagcagtacacagggtcagtggtctctatgattcctcagtgacttagggtacaggcattagttgaggttgtggtgaagtttagctggggatctggacacatagtcagtcagtctttgggctccagtagtggcagcagtacaccaaatgtgcctatttttaggcccagcttacactggctccagtgtttgtgggtactagagggctatccttgggcctcaaggtggcttgctagaaagagatactgagagcagtgagctcagtgtgtgagtgggttctccggcccctggcagctggggtggtgtgggtgatgggcagtagtgatgttggagcaacctacagggacacaagcagtcttatgttggtgttggcagaagctgcaatgggttgggtaggctgcattttccgcattttctttaggatttttagtcttttgtttccttaatttttttgtatattcaggatattagctctttatctgtgaaagatgttatgaatatcttctcccggtttgtcatttgtcttttgacttttcttatgatgtctttggacatgcaaaagtgttattttttttaggtagtcatatttgccaaccttttattttatttgactttgaattcataattaaaaattatattcccttcaaattttagagtaattcactcatgttctcttctaatacatttatagtttcatattttacatttagatctctggtccattgaatttttttattatatatgctataaacagattcaatcttatccttttccattgactacacagttagttgccccccaaaattctatttaaagccaggtgtggtagctcacacctttaatcccagcactttgggaggccaaggcaggggcatcgcttgagtccaggagttcaagaccagcctgggcaacatagtgagaccctgtctctacaaaaaaatacaaaaattagtcagacatggtggtgcacacctataatcccagttacttgggaggctgaggtgggaggatcacttgagcctgggaggttggggctgcagtgagctgtgatcatattgcactctgtcctgggcaacagagcaagatcttctgtattagtatgttgtcacactactataaagaaacacctgagactgtgtaatttataaagaaaagaggtttaattggctcacagttctgcaggctgaacaggaagcatggcagcatctgcttctggggcagcctcagggagcttttactcacagtggaaggcaaaacaggagcagacgtcttacatggcaggagcatgaccaaggggggtgtggaggagtgttacacacttttaaatgaccagatctcacaagaacttactatcacaagaacagcaccagcagggaaatccgcccccatgatccagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggagtgcaacggcgtgatctctgctcactctgcaacctccccctcccaggttcaagcgattcttctgcctcagcctccccaaagagctgggattacaggcacccgccacccgccaccatgcccagctaattttttatatctttagtggagacgaggtttcaccacgttggccaggctgttctcgagctcctgacctcaggtgatccacccgcctcgacctcccaaagtgctggaattacaggcatgagccaccatgcccagccacatgtttatttttctaatgaactttagtatcaagttgtctagcttcataaaaaaccctgttgacattttctgttgggatcacgttaaattcataagttaggggagaatacatatcctgatgatgttggaacatcctaagaacaaggatgtcttttaatttgttcaaatctgcttttatgcctttcaagaatgttttataaaaaatatttttatattagttttgaatggttttaaaatgcttatttctaaataacttacctttttcattgctattataaatgttttttattccattttatcttctacctggttatcatttatgtatatgaatattactggttttgcatgttaattttatatcctgctaccttggtgaattatcgagttagttttattattcattctctagggttttcatatataccatcatgtcatctaaaaataaagatatttttgtttgttttgtcttctccgattcttgtttctttgttttcccttatctaattgcattggctaatatctccagaataatgctaaataattgtggagatagtggcatccttgcatcacttctgacctcaatgggaatgcctttcagggttccatattaagtaatatgctgtcattaggattgaagtatatatgtttatgttatggacatatccatctgttcctttttttttcaagaatgtttattaggaatggatgttggattttatcaaagccttttcagcattttggatataatcctttgactcatgaatgtgatgttattttatcaattttctaatgctgaaccatctttacattcttgataaaacccatttcatcatggtgcattatttctttaaggtagtgttagaatctattaactaatatatttcttagaatttttacatcggtatttataaatgattttagtctgtaatttttctttctgtacatatataccatctttattaggcttaagtatcattgcttcatacaaacattatggagattttctttcattttctatgctctgaaactgtatatatggatttggggttatccgattgttggtagacaattctaaattctccatgagtctcttctcatttctgcacatcttgcaagttaggcgctaactgccctctgtttcctgctaccataactgtattccctttctataatacaagacatcttctagccttagaagatagagatcatgtctccctctaaaggaaagggaagatttccttgcagccccaggaaatactaatagtatttagagcaaaaagccctctggagcaaaaagtaaacatgtttatggtccaatataataatgttttccttcggaaaaaaggacaggcatacttactccccactgtaaaatgttcaggttccatccttagggttcttattcagtaatgcagcctactgcaagaccaggtattatctggctctctttgcattgcactttgggaattggggctcaggagacccaccccaaaatgctcacactctggctactgctactgctgtgagtagttaactgtctttcatcgctgagccaggagtctcttgttttctaccagcatccatgaaattgtgacaggttaacttgttagccacaagcagggtaaaatctcacgttcttcacacatcttgacactggtctttatttttattttattttattttatttattttttgagacagagtctctctctgtcacccaggctggagtgcagtggtgcgatctcaactgactgcaacctccgcctcccaggttcaaccaattctcatgtctcaggctctccgagtagctgggactgcaggcccacgccaccacacctggctaatatttgtatttttttagtagaaacggtatttcaccatattggtcaggctggtctcgaactcctgacctttggtgatccacccaccttagcctcccacagtgctgggattacaggcattagccaccgtgcctggctgacactggtctttaaaattgtggtaaaattcccctagaaaccattttgtgaagtagttccttgatagctttctctattcttctatggaagtcagtctgttcaagctttttatctttatggttcactttaaaatctttgatgtgatcatttgtctgagacagagggaagggatctgttgaatgaactttatttttacattgctttgtattttcctttgtggtctccttggttatcttccatgaagaacaattattgtcattttaggcaactacaggatcttcttagcttgtagtaagtaggaaagtatgtttagtagccataattataaagatgaatgtcttttctctgtttgctttttataggtggtagttgtacagtcataaaaatgaatattctttttgtttttctacaggtggtggttgtacaggcaattagtgctctctgtcagaaataccctcgaaagcacagtgtcatgatgactttcctctccaacatgctccgagatgatgtaggtagactactttttaatcataggaagttgctgtcttaaattcttaggattgccatgaaataccatagtgttttaagatttccttatcatctcagtatgcctctcaagtagtacactaagtctggttactgtcttattactaaacatgccattgctttgctttccccacttggagaaaaaacacttttgcttctttcataaaaggtgggaaatgaaatttgaatattataagcataaaccttggagtgtaagcatttctccaaaatgtgtccctagaatgaatggcagttttatcttcttttttgccagggaggctttgagtacaagcgggccattgtggactgtataatcagcattgtggaagagaaccctgagagtaaagaagcaggcctagcccacctttgtgaattcattgaggactgtgaacacactgttctggctactaagattctacacttgttgggcaaagagggccctagaacgcctgtcccctccaaatatatccgttttatttttaatagggttgtcctggagaatgaggctgtcagagctggtgagtcattgggacactgatattgacgatgctgatcttttgaaatacttaagagagtgataatgaaattggaaaatgaagttgcaggatttattggatggtgggattttagagcatgcttagggcccagatatctttctttgtactcaatttccaccctcatttttgccttagattagacaaataacccttcgctttcagtaagataggaatactatgatggctcatccgttttttcagttatagccgtaagcatgaatgtttgtagaatttgtttatgtgtttctatatatatatttttaagcgacttttcctccctaatctttctttcccttagcatatgaatagatccaaatctctcccattaaagatgtaaactgtctatgagcttttcactagctactgactctatactttccttcccctcggagataaacttgaagtagccgttattagctgcctgcatgaattcattatccatttttctctttaactcagaataatgtagctctcccttaaaaatcctcaagtaattttattgaaaattacttataaactagttgtaaaatcaagttagatactttaatgttcttacctttgtttacactcagtccacttgatgtgctattgactgaacacttcgtgaaaccccatagccttggtttccacaatagcctacatgtttccatcactcctcactcttatttacagagctcctctttccagcaccattccttaaaatattagttctctgtaagattttgacttctcaacatctacattcctcttggtgatcattttcagagctctgctaataggctgtgacattccagtcatgtctctttcctgaacttgtttgtccaaataacttaaagcacttcaaactcaacctgaaattcaaactaacctcacattcatcatccactcagttatcaagatagaatcttgttctgctgccttacagcccctatctgttactttagcaaagcgctttcaattgtgtctccttaatatttcttcattctcttctattttcttggtgctgattgaggctgtcatccgtttcagatccctagctatctgactgcttctagactcacatatatcctgcctattctttacactctgctaaaaaaaaaagaaaaggcgggggggactttcaaatgtacaaatttatctcatatttaatatcctttaataataatgttgagattaaaccataccctaattttgttttattgccagtctctcccttgtctcttcttgctctccaacatgggtcctttgctcagccttgcccaactgtccagtaatacaccacactttcttctctgggcaggggccattcgaacgtgttattttctctgcctctaatactcttatcctgcctttttcctctggctaacagtacttggtcttcagattttagctcaagtaatatgtattaactctttgtcttagttttccaccaccaattcggatttagttcctttctgtgtattcacatagcatcctggatatatttcttccatggacttacctatgatgtcttgtaattgtctctctacatacctatctttcccactagagtgtagctccttgagatcagggacatgtcttttatctgtcccagtacctagcacaattcctgacaaaagtttggtgaacaatgaatctttgttgaatgagaggaattttaataatagaatttctttttatgcttggggctggttgtttgagattagagcttaatgacatcagtgtgatatataaggggttgtggtggggtggagatatagctcctacagaaaatctatatgaatctttttcctcaatttttggaagattttcctattcagagctctcttgggcttgcagaattctatttatgcttaacagtatcaaagaaataagatcaagaaacactcaataaaacaagggagtttatctccactgaacatggggacacttttctaattttttttcaaatggttattggttaactctgagaaaccaatatttatgtaccataattgtatgcttcattatagctgctgtgagtgctttggctaaatttggggctcagaatgagagtcttctcccaagcatccttgtactcttacagaggtaagttaaataatgtcttttctaaaaaaaaataagaattctatatggttaaacagtgaaatcctcattctaccatagggcggatgcactctaagccctaagagtagagttattggagcaagtcaggggcaaatggcaattcctttctctttttagtaattatgtatacctcccaatcaatttgatgtgctattgactgatcacttcatgaaagcccctagccttggtttacacaatagcctacatgtttccatcactcctcactcttatttatagagcttctcttcccagccccattccctaaaatattagttctccatagggttttatttgctaggtacatgtcacatttgattttggctttctctcacatgattttgagaaagtgacttaaatacatttgcctcaatttgtacaacaggggcttacttaaaaaaactgttaggtaattcactatgcagagttaaaaataatagtttttcattgtcttcatgactctatttgatgaggaaaagacttgctttagcaaactgtgattgcatcttataattgaagcagataaattacaagccaaaggttggctagtttacgtaaaacaaattgtcatttgagcaaaaacagtggctggattttgaatttatcttttcagtatccttggagagtataatactcccatttcctaattacagagaagtctaagtcttcaacagggtcatgtagttacagatggaagaaaagactccagactgctatttcatgttcttgtgctcctcgttattttaatgcctacttatgtagtgcttgtgattcacagtagcagtatttctttagtaattcagagcagtacccaagatttgtgaagactttaggagccactgttggctattgttgagcacttttttaaaggtagtatcagatgacgacctgagctgtgtcctttagatttggtagtagagctattggaagtctttggggtactgtgacatgactattctgtttcccctggacaggtgtatgatggatactgatgacgaggtacgagacagagctaccttctatctgaatgtgctgcagcagaggcagatggcactaaatgccacatatatctttaatggtcagtgaaagccaaggatgtacacttttgttcctcaaatggtgtcttggaagcatattttatgatttgcatatgagctaacttcactaggcaaatgcttggtttttgtctttgagtgcacttccatttctagagaaacctgtgtttataggatattttctaatttggtaatgataattcctatgcagcaatctataagaatatagattgggcccttacattttttaggaacgttgctcacttattcctggttctccttgaactccctcttggatgggtttacatttttcccgttttcttatgctatcattgttcccatatagctaagttgctttcttttctgggaggtacatacattttgttgaaaatgtgtatgctatgctcccatgtttccttgaatgaaataagtcagtttataagtttataaggtaatttcaagaatatcctttatttttatatttaggttataaagcttttggttatatttttctcttccttcagaaagcttagataaatattacaaacctgggcctatttggattcgaggattggcaagaggttataatgctgagatttctctatgtttcacaggtttgacggtctctgtaccagggatggaaaaagccttacaccagtacacgttggagccttcagaaaaaccgtttgacatgaaatcaattcctcttgctatggctcctgtctttgaacagaaagcaggttcactctattcgtttttctgtgtataagtagttttgcaaaactaaaaaatattagcatattttctctaatactcatttaattgtcactcttttttttttttttttttttttgagatagagtctcactcccgtcgcacaggctggagcacagtggcgcgatctctagtcactgcaacctctacctcccgggttcaagcgagtctccttcctcagccttccgagtagctgggattacaggcatgcgccaccacacctggctaatttttctatttttagtagagactggatttcaccatgttggccaggttggtcttgaactcctgacctcaggtgatccacccacctcggcctcccacagtgctaggattacaggcgggagccaccgtgctcagccgattgtcaccccttctaaatcttttagatttaagacatatttttattagagtttaaaaaaaactcctggtttttacataaaagcagtaagatgaaatgcactccaaaatgaagggttttttttaatgcaaagcattacagtatctgaagtcagttgccactgtgcatctcagagcagtaatagtgctgtcgcctcctatttttattttctgaagttgataatctctaagttaattgattttgttattggaggttcgtcttaaaagaatttatgggcgacaatcataaaaaatattcccaaagaatatctaactttaaaacttaaaaacaaaaacaaaagaagtcataaatgtttagtggttagaacacaaaactgggaagaaacaattttatgcttattttcaacattttcagtttttctgttgatataagtaatttttcctattttgatcatgagaagatttttaaaataaattgtttttccttttctgagtaatttttgtacattccagtccatttaaagcaaactctatatttttagggcttactttatgattccacaatatatgttcactaaatacattttaatttgagtgtccccccaccagaagtgatagataacctataagtatgatctagtaatagctcattatatatctgctagaaatgtctgctctcctctctttctgtctgcattgctagcttgatagtagtgggagaagttcacttacttgctcatatctgtctttatagaaatcacacttgtggctactaagccagagaagttggctccttccaggcaagacattttccaaggtatgatgatttgatggttagacgtaataatctttcccctaggcattgtaaatataaaaagtctaccagtcttactcaaattgatcggttctcaatataggaaatcttcgtgtggctgaacaccatagggtatagttgctgaggctacctggagtccatgaactttccagtttgtaattgctaattgggaatgtttttcttttctgtatctcgttggttaacagggaactcattgtaaaataagtatttactttctttttttttttttttgctttttgctttcattaatatataagcttacttacttgaaagatgacttcactaaaacttggggacatattagttgaatgttcaactattagtaaggctatggaaactaaagcattttttttttttgagacagagtctcgctctgtcacccaggctggagtgcagtggcacaataccggctcgctgcaagctctgcctcctaggttcacgccattctcctgcctcagcctcccgagtagctgggactacaggcgcctgccaccacgcctgactaatttttttgtatttttagtagagacggggtttcaccatgttagccaggatggtcttagccaggatggtctcgatctcctgacctcgtgatccgcctgcctcggcctcccaaagtgctgggattacaggcgtgagccactgctcctggccaactaaagcattttttaagcatccagactgaagtctttccctgtcttcttcatagcctacgttcttttttcttgatagaacaattggctgccattcctgagtttctgaatataggacccttgttcaagtcttctgagcctgttcaacttacagaagcagagacagaatattttgttcgatgtatcaagcacatgtttaccaatcacatcgtgttccaggtaagataatgcccttggctgctgtagagatttagtataaactggtatgctttgagacaaatatcctttacctataattctagtttctattatagagaattaatttggcagaatttctggttttcttgcttaacaccagagctatagagatcccttcatgtgatgggtaacttttgatggttaaaatctaaaggacataaaactgaaatgtgtgatgaagttggacaacataaagtataaccaattttctaaaatcagcatttaacatcagggtagattaagtgggctattctgagaacttagatttgacagccatcagacttctgccatcttgtttgagacagcagtctcaggaaagagaaaaaactgatgaataatataaacaaaagacctcaagaataaggctctccctgttgccaaaagaagaatcttaggaggagacctaccctgctctgtagagatagaaggtatagtgggttccagagctgagtagtgggttatgagtaggaaggataacttgttatccttcacagcttttccatttactgacttttcagtttgactgcaccaacactctcaatgaccagctgctggaaaaagtgacagtgcagatggagccatcagattcctatgaagtgctgtcttgtatcccagcccccagccttccttataaccaaccaggaatatgttacactcttgttcgtttgcctgatgatgaccctacagcaggtactaaccctcagaagggaggagatacgtgattcagaatgcatttccttgtgagctcttcaactcttcaaatgctcagtttaagaatgtgatgcttttctagaatttaatgatgagtgtttgtgtgtgtgtgtttgtgtgtgtgtgaatatatatatttataaaatggtttactgctgcagaaatattaattttaaaactaaatctctgagtaaaatttgctgaacacttaatcttaaaagagaaactgagtgtgtatagcagtagcacaaaaaggaactcaagctttctgttggaataatgtgaccacttgtgagagttcatatacctggtctcctgtgaagaatcttgaccctcttctcctcaaagtttctatctagttagatagaacttggttatgtagtagattgttggcattttaaaatacatcatttttgaaggtcctgtagcataaggctggtgtctgagagcatgtctcagcctagtgagtagcttagccaaccatgtgtgtccacattaagaagggcttttaattccctccttgacccatatgcagtctttgcagggtggagaaatagcccctaaaagacagccaactagtgccaatagtagtatttacttatttggagacttgggaaggtgaatgtcaagtatttattctacttgattccccccatcatcattttcctccttgatttcttctcttctcatgttcagtgcacaatattcgtaactgttacccagttttcacagaaataagcacacacatcacatttatgttttgaacaacttttactgctcgtaagtacaggagaaacagaagttaaaaaattaacaaatactgggaaagttacagagttacaataaatcataaaagcactagtaaatagttatccctggtcatcattcagttacatttggggcttaacctgctttcttttagcccctctccaaactcccttcttagatgttggttcctgggagcccctgtccagtcttatctgtgttgggtgatagactaggctactcagactctagcacgaggtagattcacgttggcaccactgctgtgtctgaatcccagattgttccctctggccctgggtggaactctacttctattctttagccaccctggatccataaccccctgagtaggaaggcactttcctatctggcctccaatatttctcctttgagctcgaggctatctggctttaacctttaattacctcctttatccctttgtgaggtttctctagttccatttccttgtaacttcgctttctctcctggtctgtttttctctccagttagatttgtctgaaatatgtccactagccagtaattaagctggctgtactcttaagtaaagctagttttatttacctttttctaaactagtatttgggcccaatcttaatgtagtcctgtggtttctaccattgtctggagagactctgcacttcatcagttcttttccagtagccatccctccatgtttcaaaattcctcctgctattctacctctcaccaatgtcctgttttttaagggatgctattactttgccacttaatttcagagggaagtgaaatgctgaacccattgaagaatcaatcccttgccaattgagaatactagctcttcccacttccccaggttcattttgctaactaataactcaggtggctcacaccccagaaagtattcttaacggaatctaagaagtataattttataataccaaaatacacaaaacaacaatatagaaattacatatagtataggaaaaaaccaacaacaacaacaaaacatttccaccaagagaggaaaaagaggagaggttttcttgcccctcttcactaaggagttttaaaacatagatcttacaaattagcccagagatttcaacatttggtctgctggctatggactcttttgcttgatggtttgtttgatttttgtttataaaagtttggcatttagggaattgtttaaagttttgttagtagtaagtttatatttgacccatcatatacctacttaaaaaacaaactcctttctatttagttttttgtcagaattctcaaatttttaatccatggccaatctaaagtctatgctgtgcaatggaagaagtgaaataccagggcatagatggtaataggtatctttcacccattccttcctttttgcattttcccatcacagatattccaaattttacctgtcacctcaaggtcttaaacatcaatatgtctcatttcagaaaaataatatttttccttataatcgcagtgaaaaaacagaaattcttggtttgatttccttcaacttgaaaacagtatagcataatagaagggaatatgggtttgatagacagatgaggatttgaatgctggccctgctacatactgactgtgtaatcgtggacaaattatttgatctcttaggactgttataggatgaaatgaaatgaaatgaaatgaaatgaaataataggtaagttgcttcacatggtgccagacacatagaaccttttggtgtttaattctagaattatccactttcttcctttatcctctctaaaatcaagtcttccagagttcaaaagacacataccctctaatctcttccagaaagttgttccatcaattattcctttctttgatctatctttaatctttcctactcccctttactttataaatgtataaaaatctaccctatctgaaaaaatttgctttaacccaacatcaatatattaccataacaccttctcgcaaaggttgggcaatttcttgaaagactatggacatcctaagtctctatgtaactagtcctacttattatctttcgtcctcccagaatttgtcctttacctaaaaagttttagaaaagcctttaaggcaacattccttctaagcattcattctctttcagcagctctgtttcccctgaatatttattgcacccgtaacaatatatattatatacacaacattctaccaattattccccatgtttgacctttttaatgcaactaccaacttaactttttattccactacctattcaaaaccattctaatctttatattgcttttatttatcaggttttattgcatcatatttcttgttatctggaaccatttcaacaaatattaataacttattttaaaacagtctttaatagaaaatattcatactaagatcagctgtaacagtacatgtatgtgagtttattttctctgattttcactggaaatattgcctgccatataatgattcataattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatattaacttggcattctgtactaaaaacacaacttcagttaagtaagatttgcctcagagttttttactttaactcacctccactcacccactgggatccatattattaggctcagtgaagctttgcattcttctaagccaagcatttaatctgaattttaactcaaatactaaaaaaagcagtattggtagaacatttgattcagccaccctttccccttcctttatcactagaatttgcttcagtctggctttaaaatcaatattcctgcagtctaacccattgaaagatctgccaggattctcaatctgagatttccttatttacccactcatttgtcacatacccagtctgccattcctcaaactcactgaaatttccctcatttcctttcaagccatctttctaacctatttgataccccttttctaccccatcatcttcaatgtctctaatttttgttgctgacttgacttaaatgatcctatctctacagaatgcaacttaatcatggtgtacccactcatttctgccttttgccttaggggaaaaacaaaacaaaaccctgctctattggtaacgcccagtctttgttcatctgtccttgaaattgattcacaatgtgaatatgtataagcttcctcatgacccacctccagtgttcagaacacttccttcctgttctcttggtgtccaacatacttacctgcatccttagctagtagaactgacattctgaggattgctgatgaagctcatccttcagactccgcttcataaacctatctctatatgggaccgtttattctcctgactctaagcattcatcaagtgtttccctcaaggagctttaaggaagccaccaaattccctaatgacaagttctttctatatagttttcctctttgccattattccatactgtggatcaaggggcaacaatacccaccctaccaactctgacattcctaaatcccaaagtggtttaaactgtatactgtccccttaatttcaatcttgttaaacagagtaatacttccttctcattttggctctgctaattttgttggagaccacattaaacacatagtaacctatgtccaacccccacacttgcaaattttacattgttaattgtttgctttcaaaatcctgaccttcagtgattgccaacactgccttccatatcagttggggttgctttaccatcaccctctataaggtttcttctttttctgttttcctattcaatgaagtagttaccatgacaggtaaagtgttgttaccccactcgcttgtcgtctaggatttaacttctattccctaaaatgctcctacactcagccatgataccgaacataccactgacttgcccctgagatttgccagtgcccccactttgggaactctgcattccaccttcccctattccatgtcagcccttttactgatgctaagccctgcacaaattcataaggttatctcccctcctacctgcctcctgtcccttcttttaccataaacttccgtcatcaaatttacatcccaataactgccttagaatggctgccagactctctcattccatgtggtatgccagtgtaaatttgcacagtctacacacagtgttgcctcccactgtcatcttccagaaactccttttcatcttcaacatccagtcctgcatgccctgccacctccaagtcaatccacagactcaggaatctttcctgaactctgaccccttcctgccctgccccccactgatgacaccactgccagcttccatgtcctcaacctgctgtactgagtccatctgctgtctcagttcacccctaaccgtcctgtattctcagttctgcctctaaggaacagtggtttcctctctctgttgtgtcctctggcctttcatcgtctcgccatgccctttattgacacacggtcctcaatgtttccaaggtgccaacacctctacaccctgtttctgtggcctcatctcacctctccttcattccttccgtgtcttacccacaccatgctttctcctccatgacctgcatcaaacacttcgccccttttgggcaaaaaggaggattctctacgttcacacccacactcttgctcttggcatgcctcccttgctgcagtacattccctgatcctctcaacaagctcacctctgtaagctgctggcctccataacctgctccaactcattcttcttgcccattggggaacacctctcctctgtcctgctctcccatatgctgcaaactcaccctctgctctcccagctcccagctcctgggcccaggttggtcgtttctcctgctttcctcctctactgcatagcacggtactgtcccacctgcaccatgctgcgttctctcagcaccacctgtgattctgccactggcctaattcgtgttctcaggtgtgtcctcccttcttgacctggccccgcacccactgctccaccagatgcagtcctctctgtgtcacacgtactgcactgaatccacacgctctgctgtccaagctcacgtcccagtggcccaggctatgagtcctttccagggccccacaaccctgactcccctaaaccttcctgattcttttctcatcctttctttcacactgtggaaaaacactctggggagcctctgcctctgaatctcctaccttcttcctgtcaccagagtagttttgtctttgtcactcattcgtgtcccactttctgcccatcctcgtccccccggtacgaatgcacccagtctcaacctgactctcctgccctgcctgagacccagctcctctgctcctcctgggtgctcctgtcagtcccaccctcctcccacctcctccctcctccttaaggcccatgtcttcaagacgctctccttccacactgtctccatttccctttgcaccttccctccccgtgacaacagatcccctgctctctgctctcacccgcacagcccacttcctctgtgtcactgggcccctatcttggcctcactcctccacctgagtcctcgagtctcggaccgaggcgctggaaatcccagctccaccaccatggtcccggtgccttttcggctacatccatttgctcgctgtcatccttgtcctggtctgtcgggaactgtgtttccacacctaacagtcttgaccctgatgcctccatcagccccgctgcacgtgcatcttcccctcacattgtacatgtctgtccggctctccatcctcccgcgtccaccagtgattctcacccgaggatgcaggaccccgaggaagcctatcagaagcatcttttgggctgggtttcttcttttgctattatctgtgttccttttagagattgtttttttcccttactttttctgagctgaacactgctcacccctctgatgattggataggcctgcctgggggtccatgtccccagccctccctcgggtgaaacccacccctcaaccccagataagaatcactgctgtggacggccaccttgactccctggcctttactctcctatttctagcatttagtattttggtatttccaggtacacttcctactcataagaccagcatttccctccccctgcccaacagtcctggcactctccacttggaaccacctcattgtctgccccatttaccccttaacacacatcgtgcccaaaagcccagtctgcatgagagagttgcgcttctgacacctccacaccccaccctttatgccctgacccatctaatatgactcccaggcactcagttaatacctttggcctcaatctaattttcgtaggcccttactactgacatttttccttcatcatccctcctcttttcatatcactgaccaggtgcccccagagagacttcccatttggtggtcatcatcctgtttgtttcccagaaaccagccctttaccttaaccttttacccttcctgagctactctgttttttcttcttttgccggactcagatgtcttctctagcctgtattcatcaacctcaacactcaacatgtaattgtccaccagctcagatgaataagatggtgtctcaatgcctacagcttggcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcctgtccttcattccttgcttatcttacccacactatgctttgtcatccatgaactgcgtcacacactttgccccatctggggtaaagtccctggattctctgcatccgctccctccctcttggcgcctggcatgcctcctttactgcagcgcatccctcctgctctcaacaggctctcctctcttagctgctgggctccattgcctgctccgactcattcttcttgcccattagggaacacctctcctctgtcctcctctcccatgtgttgcaaactcatcccctgatgtcccagcagtcagcccctggggcgcaggttggtcgtttctcctgctttcctcctctactgcatagcacggtactgtcccacctgcaccctcctgcattttttcagcacaatctgtgattctcccactggcctaagtcgtgaactcaggtacctcctcccttcttgacctggccccgcacccgctgctccaccagatgcagtcatctctgcatcacacgtactgcactgaatccacctgctctgcccagctatcagtgtccacatcccagtggtccaggctatgggtaccttccagcaccccacaaccctgactccccaaaaccttctcaattccctttgcatcctttctttcacattcttgtgaaaacactctggggaacatgcgcctgtgaatttcctaccttcttcctgtcaccacagcacttttgtcatcagcgctcactcctgtcccgcctccacctacccaccctcatccccctgccccgccagcacaaacgcacccagtctcaacctgactctcccgccctgcctgagacccggctcctccgctcctcctgggtgctcctgtcagtcccaccctcctcctgcctcctccctccttagcaccgatgtcttcaagacgctctccttccacgctgtctccattcccctttgtgcctttcctcccgtgacaacagatcccctgctctctgctctcacccgcacagcccacttcctctgagtcactgggcccttctctgggcctcactcctccacctgagtccttgagtctgggaccgaggcgttggaaaccccagctgcaccaccgtggtcccattgccttttcagctacatccatttgttagctgtcatccttgtcctggtctgtcgggaactgtgttcccacacctgacagtcttgaccctgatggcctccatcagccccactgcacgtgcgtcttcccctcgcactccacgtatctgcccggctctccatcctcccacatccaccagtgattctcacccgaggatgcaggaccccaaggcggcctatcagaagcatcttttgggctcggtttcttcttttgctattgtctatgttccttttagagattgctttttttttcctttactttttctgagctgaacactgctcacccttcagatgattggataggcctgcctgggggtccatgcccccagccctccctcgggtgaaacccaccccccacctcagataagaatcactgatgtggacagccaccttgactccctatggccacctggactccctgcacttcagtctcccgtttgaggcctggagccttctttttttttttttttttttttttttgagagaagagtttcactctgtcgcccaaggctggagtgcagtggtgcgatctcggctcactgcaccctcacctctggacttcaagcaattctcctgcctcagcctcccaagtagctgggattacaggcatccaccaccacgcccagctgatttttttctttttaagtagagacagggtttcgccatgttggccaggctggtctcgaactcctgacctcaagcgatccacccaccttggcctcccaagcctggagccttcttgtgcttgcatttactgttgaagatcattgttttgaagggccagaatgcccctttatacctgtttttgtttgttcgtttttttactacttctttcatgtgctttttatacttcttacttagcattttttgtgtttttcgcattctaactaacctggtagtcttcccatggaagcactttcttttgcacatttccttttcttctgcacatttccttttcttcctctggcatccttccaccccattcttcccatgcctcgtttctctactccacactcgccctccgactcttgaaaaggatttctcttaaagatctacattgaaactttgacccttcagtacatgaaagcgacctatactctaaacccccttcgtatcggcctgatagcttccacacccgtacaatattttctgttcttattttaatatttcctatccttgaagtttacatactgtgacacaggtggcaagattccacctttaggactgcctccagttactccccactcctcttatccccatcatgcattctttttactgtactatagtattttcattatcttcatactgttaatccatgcatctttcctatcttttcattattattcaggatgttttcatctcatttttggattttcttaaagactctcttagtcctacctggaagctcatttggcaatccattctgcacctctttttctcttctttgacactttgaagcccctgtgccactataatctgtttaccactgtctttctggtgcagtgagcagccctttctagatgtggatgtgcacccttcaattccatttcctggttccctttcccctgtctcagctcagttcctctactcatttctgaacttctttcctcctttttggaatcacatttaagtatactactcaatctacggtgcctctccaccttttttgtttttgcctttttctaatattctactctgatgcatatagttgtcttctgacttgcttcttttctacctcaccctttttcccttccgtatctttggtccatctttaatcatataactcttttcttaatttatgctcttgttcttctgacctcattgtttctgggtttccttattgtgaagctgatttgccctgtgtttacttaagttactctgaaatgttgccaaatccatgcagtgctctttttatttagtgtccatcacttgttttcttccttgttccatatgatacgattatagtggcaaatcttattttttagtatgtcatcctcgcatgacttttcccatcctaaggtaaattttaaatgccttttccctttattctgttgtttttctttttctgccttggaagagcacattgttaaccacccatacactgtgtgtcactcctgtgtattcactaagatcttgctgtcaggcacctccttctgttcgccattcactgctcagtccctttcggtatttcttctttccagcatactgtgctgaactgctttagttctctgtttgttccttggtaggatgcctgccacttgccttgttttatgtccacttcactgaatgtgttgctaatctttctgtccgttgcactttttaatgcaaatgtactttcctggacactgtctctcttatgtccaatttttagttatcattttatcttgtccctttctttctcccttgaagaactgcctacacagttttcttcctgactcgacttttcaagtacaagcaattttcattatcctgtgtgcttgaataataatttttagtagcaaacacttacattgcattatcttaaatttgaaaaagctcttatccatctccctttaaaaaaactcaacctattttctcagtcatcactaaaacactatgataaaagaaaacttttaagtatttttcataatatacaccattttaaaggataatgacctaattatttaacatatcatcagttcattagcagacatgtttgtgtgtaatacaaaatggtctcctactataataaagactataattgcatttgccttctatactgcaaggaacaatggaatgttttcaatataaataacaaatgcatatacatttttaaataaaatataaaaacaagaagttttttggaaatatttacttaccacctgatgagttgcttgaattgtcccgctcatattatggagaagatgacaggaataatgcataacacatttaacatccttcagcatagggaatgagcctatcagcacaagaaccacggcaaaaatatgccatctcaagtaggcttgggtgcaagctaaaagtttttgttagcacaagaatgctaactcactgcaccagattttctaagtacatggtgagatgtatatataatgtaaatcttttcatattaacaagtatttaggctgtatgagcagatagctggtgatatctgaattcctcattctggtctcaataatatttgctgtttcataccttgcatattccaaacccagactaagtcatacatttttttcctccaaccaagcatcttctcctctcccttttcctttttcttttttatatacacaggtcttctcagttgcttaactttcagccaatcctaacattatttcttaacttcttggccaatttaacatcatacttactgctatgtccttttgtaactccctttgaatatctgccctgccatatcgtaaatattctacaaatcatttacccactgactctataataagtgaatgctgaattattctctggatgttaaccttatcatgattcccaaccagtcctcaaccagtagcattcatttgttctacaaagaatcccgatctatacctgtcaatcctcatgtttttaaggtttccaccaatggcttcttatcagggtttatcttaattcatctccttctaaccttccctagcaagcagtcacttaagaaataaatttcccactaagacttcaagtgccagcctatccaacttctattctttttcagactcctgatcttttctcattctgtatacggttcttctgcaatctgacagttctgtttctttaatttatacttgatctgtcttattgtttttccacctactcaaaactgctttctaattcatacaacgtcccatttattgacttgctatcctctgtttcttttttctatcatgagctttggcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgtgtattcttagggactcaatgggttcttctggatactcccctccccatgggcactcgctgctcagcccactgccctctgccctgtgccacattctccactgtatttgtctgtgctctcagatctgcctacactttcataggattcttgccactggcctgccctttatgcccatcccatttagcctctctcacctctcaccatactgaccaaacccattacttctaacatttttccaacaaagcttcctgggacagcaaaaccttatgccctggctcttactttgccaccttcttaccttactctctccttgttaatacacaactctgacaaatccccaactctcatttcctaatattcccatttagccctctttaatgcccttccatatctgttgtttttctgcactgcatgttctgccccctacctcattcacacgttctctttccctatttagcatccaacctccatcttttgttctctccttctttgcgatttttgcatataagtctcctcagttgcttctctcacttttggcaagtcctaatatgttttcttaatttctgagtacatccttaatgtccctctcagaacatttttccagatttccctttggaggcttcccctgtatagcctaacctttcatagtgatggatacatattctttttgaggtttcctcccctcatatccccactgtctccctcattcaaaaccagttttctactcttcagataagccttcccttccccttagatagcatctaacctggcttctttattttccatcatgacctttcgcccaagtatggtgccaaatacctccagttagtatcattgacactttttttggtcaatactaagtgatgccttctcgtctggaagcaattttaacttcactattgtacacctttttattttgccttataaaaactatattcagtatccctccttcattcagagactgtgtatgtcagttccatagattcagtactgtcttttggataaacagacccctcacactcaacactcactgttcagactgcacactggatctgagatccacagcttcctgaacagtgacccctcataacctcaattcttacctagccacgttctctccttcctctgtctacttgagtggctgtgactggattaacataaaatcactctaccagagttgctactctccctgtcccagtattcctcatcctgtcatgcttcagtgcccttcctcactggcctgcttactgtgctgcaagttcagcctccagcctcattcatttatcccttcccttttgtaccctccatcacctccattctctccatctctcctctcctttcattcaagtctcttcagttgcttcttttaattttcagctgaccctaacacaacagttgctagcagaggctctttatcagaattgttcctagcctgcctttgtctaaagcagtggttctccaactgcagctggttaaaacaagctgcagggccttaccccaggatgtggtttggatctgtatccctactcaaatctcatgtcgaactgtcatccccagtgttggaggtagggcctagtgggaggtgactgggtcatgaggccagtttctcataaatggtttagcaccatccccttggtgctgttcttgtgatagagttcttacacgacctgactgttttcagtgtgtggtacctcctcccactctctatctttctcctgtgaagtgctggctccccaccattcacctgccgccatgattgtaagtttcctgaggcttcctcagccatgcttcctgtacagcctgtggaaccttgagccaattagacttcttttctttataagttacccagtcccaggtatttctttatagcaatgtgagaacagattaatgcaccctgagtttctgactgactaggtctgggggaggggaaaagaattcatatttctaacagattcctagatagtgccatgtaacacattctaagaagcattgctcttcaacttctccctcaaccaagccctttaattaaaaatctcccactaaggcatcaagagcgagtctactgactcattcctattcaggtctttccttctctcccatatactagtcactgcaatctggccttacacccactgaatttggccagttgggcccattctgagatctggcaggattctccaggcatctttatggcgctgtggtctttcttattaccacgccaccttttcagaatcattatctagtttatttaatgctccccttagctttaacccctcttcatttcttttggcccaaatatgggactgtctctccagtcagtcctgccattcttcaaatgaccttttcatctggagtcaactttaatgttttcttctattccttttctccttgttacctatcttgccctaaagatgtacgctaccttatcttcagcctcccttcttttagctgctgtccatatttcattcagatggactctgtctcctcctgaatggcacttcctagccaaattctctctagtgtctgtctctcatctgtagaaaatcttcacatgacagagtaacttctaagagtaactttaataccgcacttacatgatattcatttgtttctcccctttggtgatttgccctcccttaattatatagagtaaaatttcatctaccatctgtacctggaaacaaagaagtttcacccttgagatgggtttccaacatgatctccagccactcctcttccaatattagtcatccattctacaaactactcaaagatctatcctggtgtctttaagtgctgccctattagggctcatcttaatccatctccttctaatccttctcattaaacttctcacaaaagcttcgcattacttttcaagcacttgttcttcttccattgtatctactgcttttcaaagtctgcaattaagagccaacatttgactgaataaacccacattttttaagggtttacaagatttcccattctgggaaacactttcctcattttacctgtccatgccactccacctacgcttacctactctttgtatagttctccctttacacagtttccagtctctccttatttaatcttacacttatggggccgtatccctccagtcaatacctgccaatcttcaaatgactccgtctcttctgcaggctcttccactattttccccagttgaccctagtagaacaactgttagtcacttgttttttcagctatcatcttgtgtatcattctcatgaatttagtcttttcttcctcgtcacctccacactactctgaaaacacttgcactttcagttcattccagaccttcatagggttcctgccactgcctatggcaagaatccattccatttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatgttggccaggctagtcttgaactcccaacctcaggtgatccacctgcctcagcctcccaaagtgctgggattacaggcgtgagccactgcacccggcccatctatagctttttatcagcattcatcagtttataactttcctatcaagcaagtcctttaattagccattccctcaaaagctttaagagctagtctgctgctgcctcctactgaattccttgctccttaaccctttctgtgtatttcccatgcagccgaccatttagacctagacaggataccccattctaaatctttattccacacctgctctgccagtaggcccttccttatgtaatattttctttcctttgcttccagtctcttatttcatactctcttatgacttttggcccagcaatgctgtcttaccttcctgttgatgtgtgtcattccttagtgaccaactccttttcatctgaggacaactctaatgttgctttccagtaccattcctccttccctttctgaatttgtcctagagaaaaactccctcccaccatttgtacagcattcccacagactcaacacgattttccaggtaggtgtgtattgcttattttggcactcactgcccagctttcctcgatgtcctacacactatgctgcacccattgcttctcagttcagtccagacctgcatagactgctgcagttagcctgtacagatccatctcttttgccttctttctaatcttttgccctagtgacatacccttttctttaattattattctaacaaagctttccggaaatacctcataagtgtctcttactttgtcatggtctcccccaggtggttgagacctggcagctccctcccacctttcccactctgccctttgccacactgcattttctgtaccctggcccaactcacatgtccctctcctgtcttagctgccagcatctatcttttctctaattcgctgggttcttttcatacaaatctccttagtggttgactctcattttcagtgaatcctcacaagacaagcttaatttcagagaacagttttaatgcagatcttcagggcattctttcctgattctctttggtatttgccttgctttgtctgtgtaactctcatatttacattatggcagtgcattcagtattttcttgctatggaaaggcccccgcatcttgcctcctcgccccatttcgtcatcctctccagcagcttcgacagattactgcctagacttccttagatccctgtaacctctcattgtatcaatcaaaccatttaagtaaaaaaattcccaggaacattatctctactaacaccattcctatttacttccttaatctctttctctgtatcaggtccttatatgtaagtgtcttctgtctttacctccacataaaactcagcccctgtgcccagtctgtgatctgccttcatacctgatgttgtctctttgtcctcctcatttgctgtagcctctctgcttaattggaaccacactgggttgctataattaatgtctctcctgactcttcattctaacttgatcatgaccttttcccctaccatattctgtatctctttcatggtttaaaaaaaatgcctcacctgacctgttctggccttgtgttaactttcacttctttccccttctctctgaagaaaatcctatcctaattaaaccacagtcgttcttttctcaacccctaatggcattgaaattgattctgcaggcttgataggttcattctttcctatatgggaaaacccactgccatcgtctgttttcagcatattctgttgaatccatctgctctctgaattcagacccattcttcatagtccccaccagtggcttaaattaggcaccttatctagcttatctctaacctttcaatctcttgactgcctcagctcaccagagcctgttggaaaatcatttgaaatacaaggtattttacaatttattcctaaacaaattatcttctcagcacctaggcattagcatgcctcttactgtttccagctgcccggtggactttctggcctctttccttttgcctgtttgtacatcttcctctgcttgccaaagctcttttgcatcttttgagagccagttaaactattatatcgtttcacattttttacagttttcccaggctatttgttaatcccgcaccctcacatggcactctcttaaaacttaaaggatctatggcattgagttgtaaagtcatagatagatcacacacacacacagcccacacacttatttaactcctagacagctcctagagacagagatcatgtctcagtcatctttttatccaagtgtctggcacataagcttatacctttacgtgtaatgtcaacatgtattgacagtcactacatgtgtggatggatgaatggatggaatttaaagtcaagactgagcagatgaaagtcttattacccaatctgtcgtatatggtcttcacatctgagcctgttctttcctctccttgcctatcccccaaataattttttaactctcccaatatctaatattttttgtacctataagctttttccagaccatagacaagatcctaaatgccttttcttcatccctgcttgctaaatcccctccttcaaacatttcagaaaatactgtctttactttttataaagacttcactttccaaaaatgtacccccacctccatttcttattacttaacaccacttgtgtgaaaacatacaactgcccacttgcttttccatttaagacactgactttaccaatagtagaaactcattactgacctactcactttaggctgaaggttgacagataaagcaagttctctctggtgatctgtggacccgccatcagtccacaatctaaagatagtattgagatgctgatgagattggtcaatgttaatctgatgatctgtatgctctttaccacaggttttttttttgtttttttttttggtcaggtcctacagcagtggttctcaaaatatttatttttcaacatttaggcccctttgataggcatggcaaaaagcccccaaaagtacctctctgctgctttcttcataccaatagagaaacagtctgcccatgttatcatttctgtactgctgtaacccacagcgtggaatagactttacattcatgctttgtgagactgccttcctgacccgcttgtaggctgcttttgagaaccactaccccagacaacagggcatgtgtgtttaactggaaaatgtggaacacagtgctgagtacagatggcacttcctaagaaatgatggaaacgtctcccttgcactccccactgatgcaggtttgcctcccttcttctccagttgcaggctcctttagctgcaccatgaagtttacagtccgggactgtgaccctaacactggagttccagatgaggatgggtatgatgatgagtatgtggtgagtcttcccagcatagagactttctttgacaccttcacaacactaagtgacttctgccttgagagaacatttttctaggagcatctgacataaacttaagggatttctattcttctgaaacagatgacaaattaggaggacctggactaaccctcctctgtaactggacagcaccaggccagagagaattgagatttaccacttcatcattaaaacaaactcacccttttttttctttataatagggataattaagagatgaaaataatgacatgattttcattgagatcagttttatttaaaatgatttggggagggggttggttttgttttttggttttttgtttttgcttcagcagctgttagtttatagccagatcatggattaaaaagccttcacagaatggagggaaaactttttttaaaaaatatcaacctcttagtgaatgatcagagggtaccgtgtgcccagaactcagtggtcaagtgtgggtgcaacatgactactctgtacctcagggctacagatgttgatctgaggctcttgccagatgttctgttttcttgctttcctttgctaagggctacaacattagatttatccagactacagaacttaaactattttggtggtagagttttctctaggctccggaggaccatattgactagttcctttatctttgccctataacagaaaggacttttctttactgactgcttattacccactagctggaagatctcgaagtgactgtgtctgaccatattcagaaagtactgaagcctaactttgctgctgcttgggaagaggtgggagatacctttgagaaagaggaaacctttgccctcagttctaccaaaacccttgaaggtgagacccattttgctatcagtatattgcctgataacagtataacacctaacaggcatatttgttactccagaagaactcctttaaaaaaaaaaaaacttcataaatctcttacttaaaaggccagcaccctgtcttcatcatctaattgatcagccattttctagtccagtagtagcctccctctacacatcaccaacaacccccttcaccaacaaacccttccaccccagctcccagcatacactggtgcagagggagatccctgtgctttactttcctaatactgtctcatacatcttctcaacacagaggctgtcaacaatatcatcacatttctgggcatgcagccatgtgagaggtccgataaagtacctgagaacaagaattcccattcgctctatctggcaggtaagaagcttccatcagattttccttccattttcttgcaaagcttaataataggatatagatgggcatcttatgccttgctgttgtcccatcatcccattatatgagtaacaatttgatacccagtcaaaatgaataatttgttttgcatgctattcttggttattcttttaagatgtacatttggcccaaaacaaatctctccaacagataccaaggccaccaccaacattccttttgagtactccaaattggtatttttgaataccttctatgtacctggtttcatgggaatataaaaatatatatatttggaatttatgtttgtttaggattcagtttccacaagtctctggaaaagctaaactaaactaatagaaaggagatgcagggatagcatgataaatttcattatccagtgcttgttttgggttcttaatatggttttccttacttttttctctcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagcaaatgtctatctttgcgcatgggttgttttttttttttttctttttattctacttggtcagctttgggacgatagtgcagctttgggtgatcttgaaaatcaaatactatcctatactccagctgcttaacttcattttattctttaatgtgtacctgaaagctcctggcaatgctggaaaatttttatcccagaggggtgggggggaggggggaggggaagccagagtccacttttgtcacaattcatttttattaatagaaaataaacacttattccagtttcaaagttgttatacttgaagttgctaatttaaaaaaacgaattttaaataatcacttaataatcctgctttgactaagacaatgaaatgtggctttaaaaaaaaagtattcagcaccatttgctcataggtctttcagagtttgttcttaaagtttctggaactttcctgtctgtaaagtaacaggaattactgagctacattggaaagcctctctgggacaggcagtggggagttaagcagtcatcataaaggaatcagtgtacattcagcatggtgacttgactacacaacaatcccttcccctctactgtagctcaagagagacatgcttctaaccactgaggtatgaggagtctcagactgttatttgctgttagaattggtcttcccagctaataacagtacatctctggcacagatgctattggtccttaatgtcctgtgattttaggaaatagtttggatttagttcaatttattcagaaaccaaacgtgtttaattagcttcactactctggcagagtaagggtatgctggtttagtatctttataaaatatatataatgtataggtaaatcatagtcttaaatcatacctaaaatactgtatcatttaaaccaatatctattttaacaaaatgtttataactaaaaacagctgatgaaacactaaatccaaaggtatgacaaagaggactcagctctgtgttgcttaaagaacttttaaaaggcatgtgcccataacgtcattcgaggagagggaaggagccccccttctcctcctccttactatagaattcctgttgggggtgggccagaaattagcacttctaaatatttcagagaagtccaaagtgttaaaaaaagtcttttatgcaaaagaacgtctttctgcatcagtgaatagtaatgctcatcagaatttcctaatagcacaaaaaacaaagccaagtctatacatttgatcagatatcaaagtaatgggaggtggactattatgtcaaccttagtcagagctcctgctggcttcttcctatacactgttcaccaatttgagtaaagtggactttgtgagagaattatgtttgatggccaggacctcttttgggcatttcttcctaagtggaatacacaacagataagggagtaggggaggtaatacagggaagctactctttccagctcagaaggagttgatgaagcccatatatgcattcaagaagcccatgggatcctctagctgtggatagtggctaatgtggtcatccagaatcgacactgtggaccgcggcagcgttttcctagtggaagagaacagcacgcaggtgaacttgaggctggagcgggagggatgtaagccagtgggaagccccagtaaatgaccctgtggacacaccacactggaaggagccaccaaagagcttattcaccttctactctgaaattgtatcttaggcagataaacttgccaattccatttatacaaactagtttttaaatgttcataatccaacaaacaacaacttgaaaatataacacttttgcaacaattgtcaaagcaagatgactttcagctccttagagaaggatgaagcatcaaacaagtggatcacacagcaactcactgcccaagcagagataaccaaggatcttcccttaatcccaggaggagatgagacagggggtattttatttaaaattatatgcaagctgtttactactagcttgtatccagtaggccacaggaaggtatggaacattcttatgtgacataatcaagatttcatattctgataccttccaagtaagtacctagagagaatagcaaccaatgagaaggcacttttccacaatgagctcttctcaatctctccttgccatctgctcagcctaaaccaatgaattggctttacaatcagactaaaacaaacaaacactttgtaggtatatccactttcaacctttgactcacatgagagctttttgtacaccaaggaata

SEQ ID NO: 12686 - DNA, 14992 bp, Human
ataaaataaaaatacaaaaattagccgggcgtggtggtgggcgcctgtaatcccagctactcaggaggctgaggcaggagaatagcttgaacccgggaggtggagggtgcagtgagctgagatcgcgccactgcactccagcctgggggacagagcaggactccgtctcaaataaaataaaagcaataaaagtaaattaaaaaggaagaaagggcataactggtaataacaatataacccatatccttccagaaccccaaactgaattggggaggcttcagtctggaaaacataaagctactctaggtatgcaatgataatataatcgcgagcttacacaaatgctgggagtaaagtccgggaaattgttgccaatgacctcagcccaaagcactgaagtgggtggtggtctcaagagctcatggggaaaaaaccaatgcaaactcaacacttagaaagctaccagcaatttcttggtctacatcagaggcaggtggttctgaaaacagagaacagctttgaatttcatctatatttctggctgagggtgcctcccaagaataatcgcctcgaaaggtaagagtgcctcgtctggtagactgtaatccagggctacacagatgattctgggaaatgcagttcctaccatttcttctgctaagcagagaaagtgatgtctagctgacaactgacaatatggcacatatagatagtagtattttagatatctaaaataacaaaaagtctcacctgagaaatgtccaggcagcctgatatccctaagataacagcaaacactactgagcgctttctagataccggggacacttcgcgggactttttccacctctctatggcagagacagtttttcctattatcatcatgacccacatttcagaggagttggaggcatggaaagaggaaacaacttgcccgttccctctccgtgctataatttgtatacatcatcttttaaaacggacttttcggccaggcgcggtggctcacgcctgtaatcccagcactctgggaggccgaggcgggcagatcacgaggtcagatcaagaccatcctggctaacacggtgaaaccccgtctctactaaaaatacaaaaaattagccgggcgtcgtggcggccgcctgcagtcccagctactcgggaggctgaggcaggagaatcgcttgaacccgggaggcggaggttgcagtgagcagagatcgcgccaccgcactccagcctgggtgacagagcgagactctgtctcaaacaaacaaaaacaacaaaaacacacacacggactttccagagccctgcagttttgcgcttcagggacaacagtgaacatttatcgatcccatggttctcctacaattgccacgtggccagcgtctacacagccccctatcctgcccctgctgtcaaacacagcgtttccagaacgcagtcgtgctgggctccaggtgagctttgggaggagccccggctgagcccctgcactgggccccgcgcttcgggaagcatctcgctcgttcgtctcgcgcgccgcgtgaccggagccctcacgctggcagcgggcaccgcagggccctgagagtcgggcccgctgcgcgcagccaggggccaacgagagccgacgctgggcgggcagcgtccgggagcccctccgaccctgcgctcccctcgtccgcgccctgaccccgcgtctccggccgtccagcccgcgccgcgtcacctcccctcccggagcgaagggccctgctcgcccgaggacggaggcccgcacgggacacggggccccagtttccgccccggaagcccaggacacggctccagtggcggcgcggcccagggcgcaggcgcgggtgtcggtcccaccgcgcgtcgtcctcgccccggccccggccaatcccttcgaatttggccgaggccgggaaatactagctaatcacggcgcgcgctgttgacgccggccaatgggagctccggaaggctgcgtggagacgccagcggcgggcggtggacagtcatggcggcccggcgcggggctctcatagtgctggagggcgtggaccgcgccgggaagagcacgcagagccgcaagctggtggaagcgctgtgcgccgcgggccaccgcgccgaactgctccggttcccgggtgggtgcgcgcggcggggggtgcgccgcggccttcggtgcctctgccttcccaggggctctttgctccgcttcgttgtctgcggctggcgtgctgtgaactgtgcgatttttattttgaaagacgggctttcgctgtgtcgcccaggctggagtgcagtggcgccatctcggcccacggcagcctggacctcccgggtagccgggaacataggcgcgcgccaccgcgcccggtccacgctgcgtgtctttaagtgcggggtatggtgatgactgacgtgtaaacccgcgcgaaaccgtggtgtctcccccaaaagtctcctccagctcttttgtaatccatgtctcgtttttgtgggtttttctggtgttgtgttttgtttgatggctgttcgcgctttcaggggttttatagcatatatttaaaagttttcaagtgaagcattgaccttaatctttggccacccagtccacaaattttataaatgctttctttgaagtctctactttctacccgagttcttttttcctaaagcatttttcatcccagcttgtttgcagattgctgttattgctcagagaaattcctttggcttccgcagaagatccaagcctgtctagagatttagtaaagtaaaattcaacgtgagacttgagtccgggagaaattcagtccaaactatattgtaatatagagggaaagcctgatctcacttgcattttgtgtgtttctctttttttctagaaagatcaactgaaatcggcaaacttctgagttcctacttgcaaaagaaaagtgacgtggaggatcactcggtgcacctgcttttttctgcaaatcgctgggaacaagtgtaaaaaccattgcacactgctccctctgcccttgccactttccttcctcctgagattcagtgaacgcagcactcgattctgaatgacagtgacagtagtgctgggcctgatgttcttctgtttagcagtcctgtgggcagaggtggtgaagcgccctagttcccaaagggcgctaatgaatgctgtttcgtcctcctgctccccacaccccataactaatagacttcagtttttcgggtttttttagacggagttccgctctgtcgccaggcagaggtgtgatctcggctcactgcaacctccgcctcccaggttcaagcgattctcctgcgtcagcctcccgagtagctgggactacaggcgcgccccagcatgctcagctaatttttgcaattttaatttactttatttttaaatttaatttttgtatttttagtagagacagggtttcaccatgttggccaggatggtctctcttgaccttgtgatccactcgcctcggcctcccaaagttctgggattacgcaggtgtgagccaccgtacctggcccttttttttttatttttaagacaaggtattgctctgtggcccaggctggagtgcagtggcacccgatcatggctcactgcagcctcaacttcctaggctcaagcagtcctcccacctcagcatcctgagtagcttagggccataggggcatgctaccaagcccggctaatttttttttttttttttaatgtagagtcaaggtctcaccatatcacgcccaggctggtctcaaacccctggcctcatagacttaatgttttaaagatagctttaggtatatagaaaaactgatcaaaaagtagagtatgtagagcgctccctacatactacccctgccttccccccttccccattatttatgtgctgtgttatgttacatttgttaaaattgataaccaatattgatacattagtaactgagtttatatgaactctcctaccacctttttttgttttacatcattgtagtaggtttcctcttcattcaacacttaatgttgatgtgtgttctttcaatgtttttatttacatttatatacatatgtagaaactactatagttagaattttgttttttaacataaatgaggtcataccatacaaattatttggcagctttctttctaactctgccttacagatttctgcacttacagatcccctaactctgcccttctcattctctttaattgtcgtcgcattgtctctagaaccacggtacgtgtagccagttccctgctggtgaatcttcagtggttcctcatcatccgtgttacatgaaacactgcattactctcctccggcttagctttgtgtcttgcttggaaaggctgtccccactccaagtcttaaatgaaaatgagaccatttttaataatctttttaacacatctagaatttatggaggcaattgttcttctgattttgctttttgtggctttgtagaaaagtgatgaaacacgtatatgcccaatttaaaatgaagaataatcctgattttactttttagataataatcttatcccaggtacccagggctacgtctcttgtgtccatctattctcctacaggttacttgtttccctaatagatatttaagtttcctctatgtctaactgtggcttgatagtttttttttgttgttttgttttggttttttttgagacaagagtctcgttgtgttgctcaggttggagtgcagtggctcagtctcggctcactgcaaccgccgcctcccgggttcaagcatttctcctgcctcagcctcctgagtagctgggattacaggcgcgtacgaccatgcacagctaatttttatgttttagtagagacagggtttcaccatgttggccagggtggtcttgaactcctgacctcaagtgatcctcccacgtcggcctcccacagtgctgggattacaggcatgagccaccatgcccgaccaatagttcatgtcttttttgccctaattaatagtcccttgtttggatgtaccatagttcattacctactaaaggacatctttgttgcttccaagttttggcagttataaatctgttataaacatcctggtgcaggattttgtgtggtcataagctttcacttcttttgggtaaatgccagggagcaccactgctttaatatgtggtaagactattaatttttgtgaagaactgctaaaccatgggtatccagtcttttggcttccctgggccacattggaagaaatgtcttgggccacgcataaaatacactaacaattgctgatgagcttaaaaaaaaaaatctcgtaacgttttgagaaagcttaacaaatttgtgttgggctgcatgcagcctgcgggccttgggttggacaagcttgtggtgaactgtcttccaaagtggctgcagcatcttgcattctcaccagcagtgaacaagggttgctattgctccagatcctcaccagcatttggtgttgtcagtgtttggatgtttgccattctgataggtgtgtgtggcatctcattgttctagtttgcatttccctgctgacatatgatgtggagtatcttttcatatgcttgtttgccatctgtgtatctggtttcgtaagggatctgttgagtgctttggcccactcttttttttgggacagggtctcaaccaggctagagtacagtggcacggtcttggctcactgcagcctctacttcccaggctcaagcgatcctcctgccttagcctcccaagtagctgggactacaggtgcatgccaccatgctaagttttgtatttcttttttgttttcctcgagacagtttcattcttgtcgcccagactggagtgcaatggggcgatcttggctcactgcaacctacgcctcgcaggttcaagcgattctcctgcctcagcctctcaagtagctgtgatcacaggtgcccaccaccacgcccggcctaatttttctattttttagttagtgatggggtttcgtcatgttggccaggctggtcttgaactcctgacctcaggtgatccacctgctttagcctcccaaagtgctgggattacaggcacgagccaccatgcccggccaattttgtattttttgaggaaatgtggtttcaccatgtttcccaggttggactcaaattcctgggctcaagtgatgagcctgcctccgcctcccaaagtgttgggaatataggcatgagccattacgcccagccttggcccactttttaagggggttggttgatttcttatttttgagttttaagaattctttgtatgctttagataacagtcctttataaaatgtgtcttttatacatattttctcctaggctgtggtttgccttttctgttttctcactctctttctctcttttctttttttagacagggtctctgtgtcatgcaggctgagtgcagtgcgcaatcacagcttactgcagcctcgacctcccgggttcaagtgatcttcccacctcagcctcccaagtagctgcaactataggcacgttaacacacctggctaatttttgtaaaattttttgtagcgatggagtctcactattgttgcccaggctggtcttgaactcctggacccaagcagtcctcctgccttggtttcccaaagtgctgtgattagaggcatgagccaccctgcctggccttatttttttttaggagaaatgtcttgctctgttgcccaggctggaatgttgtggcatgatcacagcttactgcagccttaaactcctgggttcaagtgatcctcctgcctcagcctctggagtagctaggactacaggtgcgtgccactatccctggctaatttttacattttttgtagagatggggtctcactattgttactcaggctggtctcaaacacctggcctcaagggatccatcccgccaaatggcttccaaaagtgctgggctcacaggcatgagccaccacgtccggctgtcctttccttctcttgacagtgtctctcacaaagcacaaagttattattttcgtgaagtccatcttaatcaattctctcatgggctgtgcctttggttttgtatctaaacagtctgccaaaccccaggtgatctaagttttctcctgtgttactgtctaggagttgcatagttttgcattttacatttgggtctgtgattcattttgtcttttttttcccccactttttgtggagaacggggtctcactatattgcccaggcaggtctcgagctcctgggctcaagcaatcctcctgcctctgcctccttgaaagctgggattacaggcgtgagccaccgtgccaggcctgtgattcattttgaatttatgttcgtggagggtatacggtctggtctagatttattctctttcatgaggatgtccagttgttccagcagcgtttattgaggaaaatgcctttgcaccattgcatccctctgctgctttgtcagaggccagttgactccttatgtgggtgcccctgtgatttgaaggccccagtgagactggctgagtcgaatgaatcggacttttctttctctgtcttgagcagtgcttctcactagtgtcaggccccgtgtctttgtacatctgtgatcttggcagctgtagggatgatggtggacttgtggtatttggctgagaacatccttgcagtccaggctaggggtcatgagcatggatgagtcacctgctggctgtgcccacgcttcccccgccaccatcctctgctctcttctttgcctgtgctttcttcttcctcgacagggtagagctggcctctctgaccaagacagctgacagtgcatctcctttcccctgccgtgtttctggaacattgaactttaccagttgtgtttgttactatttagtaaggttatcttctccatgttgggttttgctggaggtgtgggtatggcatcttctagagaagatccagacctttttggattaaaagtaaggttacaaatcactgtgctgtacttgttgtcatatgagatttctgagttgtattgttgggataattttctttttctttttttgagatggagtctcgctgtgtcacccaggctggaatgcagtggtgtgatctcggctcactgcaacctccacctcctgggttcaagcaattctcctgcctcagcctcccgagtagctgggattacaggtgcctgccaccatgtccagctaatattttgtattagtagagacagggtttcaccatgttagccaggatggtctcgatctcctgaccttgtgatccgcccgcctcagcctcccaaagcgctgggattataggggtgagccactgcgcacagcctgttgggataatttaagcttgacagttcaaggcctatgaaacaggaccagggctcaggagcatcctctttttcaggccgttaattaaggaaaagttgagccagggcgtgaccctcgtcgtggacagatacgcattttctggtgtggccttcaccggtgccaaggaggtgagtgccacttggcctcctgtcaggcgagcacagatgtgtggacccaggactgcccttgaatgcgagtacgagtgacatgcctcagattactctgcagagtttcgtgattcttatattccttttatctctttgctagattaatttggttttatcaataagaagagcaaacatttatgtagctagagattgtttcacagatagaaccatagttggtatttggattatattttccacacgcttttttttttttttttggggagacagtctctcattctgtcacccaggctggagtgcagtggcacgatctcagctcattgcaacctctgcctcctgagttcaagcgattatcctgcctcagtctcccgagtatctgggattataggcatgcaccaccgtgcccagctaattttcatacttttagtagagacggggttttaccatgttggccaggctggtctcaaactcctgacctcaagtgatccactcatctcagcctcccaaagtgctaggattacaggcatgagccactgcacccagcctccagatgcattttcaaagatggttcatttgtagtacttttttcccccgttttttgaaagagggcgtctccctctgttgcccaggctggagtacagtggaacaagcaaagctcgctataacaactcttgggcccaagtgatcctcccgcttcagcctcccaaagtgctgggattacaggcgcgagccaccgtgcccggccacgccctcactttttaattctgccatttcttcatgtgttagcttgagtccttcccctctgaagtattacgttgtataataaggaggacaagactcatgattcctttgcttcttcctgctgtgcggatcagctgacagagccgcaggctctgtgggaggttctcgtggacgccttccctcagctcattgtgctgttgtgtgatgtgtggcctgcagtcacagcctttctggtcctacctttcctccggaaacaggacagcatttggagggagatgggatgagtaagggagggagagagggtgctggcacagccctggcaagaagggccagtggatgagactaggctggcacataacaggctctaggagtgcctgtcttcttcctgctcttccacgggagaggagaccctggcgtgtgtgtggcagaaaagacactgccaaggacctcgtgcctgtgtccggacccagctgctctgtgctgcaggcgttctaggccgggggtctccaggggttctgtacatagactgtttgctcctggccagcaggcctgtagctgcgctgggagggcctccatggggcctgggctgtgggtggcggggactggcagccgttctatctacctacttttctgtccacttgtctgtttacaaaggaaaaacaaaggtgacactggagaaaccgacacgtttgaggttctaaaaattaaacgagccacaatataaacagtctcacatcttggtacctcaccaaatgtcccctcattttttcctgtttttacgactttcgaaacaaaaacctagactacactaagctttaactgttgggttctttcttggcagaatttttccctagactggtgtaaacagccagacgtgggccttcccaaacccgacctggtcctgttcctccagttacagctggcggatgctgccaagcggggagcgtttggccatgagcgctatgagaacggggctttccaggagcgggcgctccggtgtttccaccagctcatgaaagacacgactttgaactggaaggtgagaatcccagaattgcacactaggaagcgtggagaagtggctcaggatgacaccgtggtggctggcacagtcgtgtcagcaaagctgctgccgtttccgtctggtcctcccagatgtggagccccgggagtagtcgttcaggggttctcggtgccagcaaattcttttttttttgagacagaatcttgctctgggtgccaacccaggctggagtgcaatggcacgatctcagctcactgcaacctccgcttcttgggttcaagtgattctcctgcctcagcctcctgagtagctgggattacaggcacgtgccatcatgcctggctaattttttttgtagagatggggtttctccacgttggtcaggctggtctccaactcctgacctcaggtgatctgcccacctcggcctcccaaagtgctgggattataggcatgagccatcgcgcccggccagtgccagcaaattctaacccgatgagttttgctaaatgttgacatttggcgctttgtctggtgggtcaggtgagagtctgcgcaatcctccacatcctcagcccctcttcagacacgagcgccagcctgttcctgccactgtgtcctctggtgcggcctctcgctgggcatgggccctgcagcagcacctggccatctaagttcaggagggtgctgtgtgctgcctctcccttcagtcctgcctccttcagtctcagcagtcccaggtctggctctgctcccaggacgctggactctcccctcccagtggactcgcaggctggccgcctctgctcctcccgaccgcagcccctacctctctcccagactccagtcgcccgtgcccaccgctgcccacgtggcctctttccaggcggcagccagggcttctggcacgtcgggcgccagcactgtcgcttgtggccacggcccgcggagcttcagtcccttgagctcctcctccagagcagggccgagggtctcgccccagcccgactggctgtgcctgcagatgatgctggtcacgcagcttttcgtttcccggaacgcaggtgggatagcagtgcccttttctggcagtgcggcattctctctggcagtcattccgcccggagaggctcatcttgggcggttctgggcgacagctgtgtggctgcacagtggccagtgagaggcatctgggaaggtggcccttgtgtagggagtcactctccttccgtcacggtcacacctcatgaaatggttagattcttccaagtgccttctacgcccctggcagattttctagaatttgctgtcccagaagcttgagaagggtccggtgccacccgacagcagaagccgggatgccgctgagatgccagcgcttctgagtccctctcactgcctgccttctggtggagagaaggctgtcctgcgggcttatgccctccccacgctcctcgcaccgttcacgccattgtgcagcacagctgttaggaccaaattcatcttccccgcaaggacgagtcaggcccagtgttgcactggtcctgctgtctggcttctgctgcggaacttcctcaccttccaggcagggcccaggagccacaggagcgtgggcagggcagggtctgccctctgtgcttccgactcgccgcttgcgagctggagggacagtcacctcgacctggtgggctgggtgggcctggctgtgctgtgggctgtgcctcactcctgcaagtgggcactcagcggggttggggtcacgaggctgaggtcggcttaaagcaggagtgggcagttggcacatcatgtttctcctgcatcagggctgtggcaggaatgccgggtgactaccgtagacacttgtcaaggttgaggttcagagaaaggtgtggggtatcccggaggtcaccacagtgtgccaggaggttcaggttggccttccagagcccggcctgtgtgaaatccccacgagcacagaggacagaacgaaacatggtgttgttttgaaacagggtgttactgtgtcacccaggctggagtagagtggtgccacattttttgtagagacggggtgtccctgtgtagcccaggctggtcttgaactcctgggtacaagcagtcctccctcgtgggcctcccaaagtgctgggattacaggcgtgggctcccgtgaccagcctggaacgtgctgatgagcctctttttctcctgaaaccccggtgggaacagatggtggatgcttccaaaagcatcgaagctgtccatgaggacatccgcgtgctctctgaggacgccatccgcactgccacagagaagccgctgggggagctatggaagtgacccaaggctgcccactggagacgcctctccctgcagtcccccgagaggtgggagactcgcggaaggccccgtccccagcggagtccagaccccacaacttcaggagctctttcccggcagcagagatctgcaggctgcctcttctgccccggagctggggtgcactggggacccccgtggtggggaccttggcagtgtggacatgagcagagcgatggagcagtctcctgccctctcccctgtcctgatggcactctgttgtattttcttactgaagttcagtgataactctgagcagtttcattgtgatcactgtaaatggtaatcagttggaattctcctaaatgtcttccagacactagtaaaaaaagacctgaaaattgtttgtggaacgcttcacttttcttagactgaggacggagctggctttgaatgggaacctccatcccaggagagaagagccttcattgggcccagtagggccttcctggaccctggttcctgcctagttgagggagtcccactgtgggtctgaacagttgcagccatgccctgggctcgctgggtccagccaggctatatccgagtgtcatcacagcttacgtcctgaactcacctaagttaactctgctattttcattgcaaccctggagcttaacttctcatcctatcctttattttttatttttttggaaacagggtctcactgtcgcccaggctggagtgcagtggcacgatcgtggctcactgcagccttgacctcctgggctcaggtgatcctcctacttcagcctcctgagtagctaggcctacaggccttcactgtgcctgggtaatttttttgtggagacaggatttcgctatgttgccagccaggcttgtcttaaactcctgggctcaagtgatctacctgccttggcctccccaaagtgctgggagtacaggcatgagccaccatgccgagcccattgcatccccttttaagtgacacttagaaggaatgatttgacactcctggcagaatctgtcccacagagcacactccgcatagacagcagcatacagtgtgctggagtagaaggcaggcagggtcccccatctgtgggggcagcagctgtgggtctcagcacccttctgtggccaagagacaaacccaggcaaaacaaaaggatttcactcttgggtaagcattgccaggggctgtgggatgggcctgggtgaggaaccttcagatgagactttcctggactatccaggtgggcccagtgtcatcacaggggcctttttttgttgtcttaagactgggtctcactctgtcatccaggctggagtgcagtggtgcaatcttgactcactgcagcctctctttcctgggctcaagtgatccaccttagcctcccaaagtgctgggattacaggctggcgccaccatgcctggcccatcacgggtccgcataacagggaggcaggcggtccgagtcaggaaatgagatgccaacagcaaaagctggagagatgccatgttgctggctgtgtggttggaggaaagagccatgagccaagcagtttctggcatccagaagctagaaaggcacagcaacgttctcccctagagcccacagcacgacatggctgtctgccctccgggtctggaagaggctgtgctgttccaggcactgaatgtgatcatcttttagagcagccacaagaagcgaatacgagcatcggagaggccacaagtcctcagccacctcaccggggacccagcagggccccctccggtctggctttgggcccttcacacctataccagggctgcccacagggatgcactggccagagtgagcaatgtcctcaccaagccccctgctgtgccccaggcatggcctcccacaggccaggacagtcactgcgcacttggggaaggctttgctatgattcaaatcgaggcaaaccctgcaactccaggcacttcctgtgacttcctcctgctgaagatgggaaccgccattttactttcctaaaatcctattttccttgcactttttccttctagggttgtatgaggtggctgatgccacggctggtagagagccaggctgcaggcaggacaggccccctgccagggctggggacacacctgctcagggccccacagcccgccacgcaggcagccacatcctttacgtgtgaacgggctgaaacattcacttattttttttctggaactcacattcaattagaacttaaggaaaaaatagacacaaggtttgttttctactgaaacttattatttgccattaagaattgcaaactatactactaagaatgaacaac

SEQ ID NO: 12687 - DNA, 5743 bp, Human
atgaaaccattacgctaagtgaaagcagccagacacacacggcctcacatttggtcgtataattccatctataggaaatctccagaacaggctaacctctatggacagaaagcagatggactaggggttgccagggactatcgggaacgtgtgtatgggcgggggcagggggtgtgtgtgggagggtgtgggggctggtagtggtggtgtggaaggaggcgtgcggcaagtgactgcttataggtacaggggtttcggtttcttttcggggtgttgaaaacgttttggaactaggtggtcgtgatggatgtgcaacattgtgaaggcgtggtacccgtcctcccctcgcccacccctttgtctttcccacggtgttcccatccagtagaaagggaaagttcccactggcaaagagagggtcaccagcgcgattccccctgccccgccccaccccacccccacggccctccagccacttctaggcccaggcctgctccctcgaggccaatgggaaagtgatgaggtcacctgacggacgtgtgtcccttgtgaggggccgtcaccacatgcgtgcccgtcgccggatgtgcgtgcccattggtctcggctccctagccaatgaggggctgggccctggtcgctaggatacacagtactggacgcggtaactgtcctcttgagagccatcttgcctagctgggccaagccgagatagcacactcaacgcccagcatgccgaggaggaggagacgccgagggtcctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtcctggagctggcgggcaacgaggcccagaacagcggagagcggaacatcactcccctgctgctggacatggtggttcacaacgacaggctactgagcacccttttcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaagccatctgcccgcttcagtcactttgccttggggtgggggtgggggggcggtgagatgggttggggggttgtgagacctccacagctggagggatggagaggtggtgggggtctggggttgggtgggagccagggatggcacagaggagcagtctctccgggtgacagtgcaggggagtggccctgggtgggaaggggacacccccgctggttctgagcaagtcagggcctgcccgggaaagtcctcagcatgatggtgttcgttggggcgggtgggcctcaagaccatgactgcagtgttgcgacaggacggacttctaaggcaaccggggtggggacggagaggtggacccggtgcttggcaaggggccctggaccggaagacggaggactgagtagtcggggcggggggggggggggacaacagtccagaaatgcgcagacatggaattagggtcacgagtttcctttgggtcatgttcagatggagaggctgtgggatgcctttagcaacctagaccacttgcattgcagccgagctagcagcagctggtgccccgccaggccccgcgtaccttcccagggtcttggatccgcatccccgagaccctcgatttgcatacgccgctcacagcccggccaggccccgcctccgatcccgctctttgcacctcatcagggcaaggggcaggctcgggctggggagccggcgcgggcacggcggcagcccgccgagggggacgcagggcacgtcgccccgccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctcatgtgtggttttggtgtccgtcgtctataaaatgtgactctcttacctacttgtcaggaggccagcagcagaaccagatagctgtttgggctccaggatgtattcgttcctttgaaatttgcgctatgcctcctatgtgggcaacgaacctgcagagatcatctatgatgtgctccgtactcgggtgactgcaatgcagatacatccagtgcagcgggtctggtgccgatgcatcgatttgcattggaattcacggttctggttccattcgcagaggtatatgcagtctggatcacaacagcttttatttgtaatagggatttttttttttttttttttttccccccccgagatggagtctcactctgtcgcccaggcaggagcgcagtggcgtgatctcggctcactgcaacctccgcctcctgggttcaagcgattctcctacctcaacctccagggtgcctgggattacaggcgtgcaccaccacgctgggctaatttttgtatttttaatagagatggggtctcaccatgttggccaagctggtctccaactcctgacctcaaatgatccaccctcctcggcctcccaaagtgctgggattacaggcatgagccaccacgcctggcctgtaatagggattttgctgcaacttttagttaagtaggtgaaatcagagtgcgtggccctttggtgttgtgcgatcacgtgactgcaaggcagcctccgtgttcccccaaagcaggatggcgttccgtttgagaacacttaagtttccaaggctttctggctcaaatggagcatgccccccaactacgctgttttcttatttattgcgtctttttaatccttttgatggtgacaacaagaactcttcagaatatagcctctttctcaaactttcaaccctggggaaatgcatcctttgggccgaagttgcacacaatcctgatcttcggggctgagatgtaaggacacagtttggagtaggtgtttttgttttgcgtctttttgcaggggagaggtgtggagggttgtcactgtgagttgagtgcctccaaatgggtgggacttgtagggtgttcttttctgcttctatttctatttcgacagtgtggaagtaatgggaagcacaggagaggcccattccaccatcattcctctttctctcacttggctgccaggaagggtcctacggagccctgaacgcctagcccaaattattgtaaaagcggttgaagggctcatgctcctttgctctttggctctttcctggtatgctcctcttaacccgggctgcagacctggccggctggcttcttgtcaggttcaggagttacggagcatgactggtgaccagtttgggatttgggcttcaggagaagcctccttaggcctctggtccaaactccttgcgtcagggaggtgaggggaaggataaccagacggtcaggtagtgggtatctgagcataattctaggaaacactaaaactcctcgttttccatttgccgtgggctcattcatgtatctccctcagaagcttaagagcagtgataactgggccgaggccagatttcagcagttttgagaattccctcgtaatgtatcacatcagtatcaaaagtcaacactgatttctagcatgccaaaagcaaatactttcagaggacatgattagtttgctttttaacttgaaaacaattccaaattcacacttaaaacagtgtaaaccgtcggaaatggtggcagcgaagcagtgaacccttaaaggctgttggggttccccttctccccattgtgaggtactcccaaaaggataaatgttgcttatgaaagaatattttatacgtgaatagtacaaagacaaagacgtttgagaaccgctacgccggaggaaggtggtcaagactgaaattagcgtgttaggcaagatctggttcctaggtgctgaggattctggtgccaaggattaatgttaaccgtgcaggcatctctac

SEQ ID NO: 12688 - DNA, 43375 bp, Human
ttttgtggttgcatttgaagttcactatctcttgaccacacaaccctagcccttctactcccaccctgctgtctcaggttaatctcaggcaatggtgtaaagaaggccaagtttgtttccctggagtcccacgggctctagcaataatgcttcccttttctcatgagtgccccgccacccaccccccttcaccatcactacacacaaatgccctgcagtgggtggaatgtagttacttcaggttgtgcctgatttgtctctcaagcaaaactccagcaggccattccctcagggccctgctctcagatctggaactgatagactaattggggctaatgtgataatgggaaataatgaaatttgttgtttttatcagtgtgtatatggggcggggtttacatttgcattttcacagggcccttggcaagttcacagggttgaacagttgggaagggtgggaatgtctggggcaggttagggaggcagagggatttattagaactcccctaaactgcactgaccaaagcctcaagcccttcttcaagacctgcccagcttccaagaccttcccaagtccacccttgttttcccactgagtcttttacactttcagaaacctctgaatttgtgtagaaactagaaaaaataagtaagaaaagactaatactactgcacactcactgttcccccttaatataataaccagtttttattctattcagtcagcctttgaccataagcagaccttttttttttctttttaacacaagtaacttcttggttttgatcacaaaatctttatctctgccaaatctcaacttcccttccctctcccacaaaagggaggcccgttgagtcaaagaaatctgcttagacactttgctcatgccaggccagtgtcctggaaggttcaacagagaaagttaatggttgggggatggtatttttctttgctaggagcagtcattcacccgtatgggagaaggtacatttgtgacccagtgaagcaggtacaggtaactccccatatgtcccttggcccaagggaatagaggttgcctgggtatttgaatccgtagatcctccctaatattccaccttcttcttgtccaaactgtgcttttttatttccagtttcagcattttggtcttctcatctctaactcttatagggagtgtcaataaaccttttaaaaaagatcatgtaagtgtcaagaggaagtgaagaacctagataatccaccaaccggataatcagctcttgcatatttgagagttgactgcttgacctaagcatctcctcataaggtaccctccctcccaggaccttccctttcaaacctctcaaggctcttacctggggccaggggagataggcttttcaaagtccattgaattgccaagagtctctgtcaagaaggcagtcatggtgcctggagagggaacttgctgggagccccttcagagcctggtacttatagagctagggaaaagatcttgatgccaaagcagggtggactaaatacagactaataaatgagacaggtgctcaagagggcccctccataccatcatctcctccagatttggacttctactcactttgcttttacattccctcttcccgatggtgtctttggtgagcagggtgcttttcacctgaaacagcctctgagctgaaaagaacagtcaccaccaaatcaattcctcatccattaacaggttgtctctctgttcttgagacacaggcattacctggttagacctgttttgtttgaacactaacgtgtgagttggccaaatgcaaatgagccaatgtttgtaatcctttattttatttttttaaagggctgggtagccaatcagaagagggggaagtgacttagggaattcccggttggtggcttattgcttaacatcctacaaaatgatttaaaattattgttatatgcatttatcttcactctgatgagggctcagacttgataacgcccgtggtgccccatccctataggagctggtgagattgcagcctgctgcctcccctccatcagccacagctattggatttcccacccagaatctttaggtaaatgaggtaagtcctgatttttaaaacttcttttgaatctggaatccaaacacctgagtggaaagagaagcctgctttaaactggacagatgaaactagaacagactcttggagacggctggcaggaagtgaagctcaccttacctgggcttacctcactgggtcaaatcagaattttattttggagggcaggttggctactttggatattatctgtgaatttcctgcattgtctggacttctaatctctgtgaatttaaaagccccctcgtttccctatgcctgggtggcaaaaccattcccctgggttgaattcttctggaacaaataggcagctagagataggtggctctgatatagctcagagaagaagtggttggctaagtagctgttagggctcagagtacacggtctcgctttctagagatgtcttctgctggtaatttttctgacttatgagctacatggaaaggccaatttgtttttaatatgttccaggactggaaaatggctagaaataggcaagaacatacacaatcacactggaaaaagtggccaggcagccaaggcaggcagaggtattggggagagctgaatatctacaaaaacaaaaattcagaaaaaacaaaaatcaattttggcaaagggcttcactgtataacaaggggacaaactaaccctttgtttacaaactaaccctttgtttactccattttgtccagaaaatacaacaatcagttttggcaaagggcttcactgtgtaacaaggggacaaactaaccctttgtttactccattttgggagactatgatcagacaggcagttgtgactcagcagcaacaaatgccttctgagacagggattcttttgattttgcttggacattgtggagaagtgttagccccaatgtggactgatctgggaacagtgggaaattaacttcttgttggtaaatatcaggctgaggtgagaaagcgacattttcaccgtccatctttgctgatttaccatgctcccaggatggtgggagtgtgtgtttttaagatggagagtgtatgcttctgggttcaagttcacaggtgtctctgctggttatctgcactcaccttggtaacagggagaaagtgagtgaatggattccaagaacttactgatggaagtctaattcaggagttggttctgcagccatggaggtaaagatgtgttgatagtctttcaatgtgtaaaagggcaattagagattctgtgtgactgtgtgttaattccactggggtcaggggaaaaatttatttctaacagaaaagaagaagatacgttattaggaagaatttcatggctaggagatactatcagaaaaggctcttaagagattttaaggatgactttaatagccgcatttgaagtttgcagaggatccacttttcctctttttgtgacctaaaattctgggatgatgaaataactcaccaattccatcttcttataatatggagtcatgtagacaacaccattttcacacaaatggctaatggtatttaaaaaccatgatggaatgtgaattgggagtcatttggaggtctgtagttgaacttgaaaaaataataaatgtaatggagacaatatttcaccgtgtttccaaaatattttacagaggcattttaaatgaaagtcactttgagggaacagctgtgctgtaagttctcttacatgaccgcgcaagatggtagccttcatcaagacctctcaaggtagtgtgggtagggtgacgtgtttgattcaggcctcgtttgttatgaaaaggctcaaattcaattgtatttgttatttttttggttaaaaagcacctatttgttcaattcaaacaatcctttttggtttttttttgagatgaagtctccgtcgcccagcctggagtgcagtggcatgatcttggctgactgcaacctccgcctcccaggttcaagtgattctcccaactcagccccccgagtagctgggattacatgtgctcgccactatgcccagttaagttttgtatttttagtagagacggggttttgccatgtcagccaggctggttttgaactcctgacctcaggtgatccacctgcctcagcctcccaaagtgctgggattataggcttcagccaccgtgcccagccatattgttttcatttttaatctattagtctatcgtgatctcccagtggaagtatctttggcctttgtggacgtcaggaaagccctacattcccactcgcgattccatgtttatgggtaccctaaatgctcccattaattgaccaactttaccctgatcttctttcaatatctttctgactccttgaaggtatgagacaaaatggaaactgagaggttaaaaggtttactaggttgcattcaattagcgaattggaaactggaaggagctcctatcgggtctcaggtcagaacgtgagtgcttttggccaaagttcacttctgaggaagtagaatttcgctttctggaatcttgcgatattttatttcctctatatctttcccatgcccccgacccacccaatctccacaaatttggggatttgagcactgggttgtgatcgttagaccatcttgcttttctgaaagcccagggcaagacccctgcttcatgtcacagtatcaaacacagacatagaagcttgtacaaattattgagaagttattgtcttttctcccttcctccatatggagtcatctctatgccctttcatacagatgtgatttacgaagacctctgggttaggggtggggtggtgagcaagaatcccgtggcagaatctgctaacacacttgagaagcaatgttgtggttttaaggaactcaatctaaagcttgaacctgattttcagggataccattttgctgccgtttcagcccatttctcttgttaagatcgctctctggtagagttgacgtgacactcatttctgttgtgggtggggccctggttgggaggcattggctccactgcagcctgggtgtctagagaccacattctcaccctgcctttgttactgggaaaccgaacgcggcgctgtggctttcagcttgggtaagccgggtctgcggcggggattgccatctgaagacagaggcaggagggcagccacaccttgcccaggttctcttaaatctcttgctctataactgaaaggagggcatagataattaactttatttgacatttttcatatctaatttttaagaatatgattttaaaataatagatttgttctaaagagcaaacaatcttgctgttattaaaaacgtgtttacttaaattgaacggggtttcaaagggccaagctactaagctgtgcaggaaacaaacagtgcagtgaggagaatggctcctcaccacagctattcttagggtgggacatagtttcaagccaaatgacattgatgtccggaaaccaggatgtgctgaagtagaaatttccagggatccctcagagttatttgctaaaatgtttattattcttcagaggggggtggaaatatttctttaagagtcttccttgaagaattttgaactccagctttggagtgatgggagcacagtgcagggaaggcgggatgtgaggtggtgtgctggacggcagtctagggacctggtctagcactggcagagctgtgtgtcccagagcacacattcccctttgccaggctttagtttcctcctctaggcaaaagggtttgaacctgaccatctttaagatccattttaaccctcagattctgtggctgtggtgattgggggtggtgggagtacctgggggtcagcaggataagcacgaatctgtgagagctgagaacaggtgggagaagccttctaaggatgaggcaggaaagattagcaagagcccttaaatggattctttagggccttcagaattttggctaaaggctatactagtggaggtactaagacctgacacctggagcctttattaaggatgttagaatccactcccatgacaacatcccagctttgccaatttgcctcatgtgtctcaagctggtgggaatgtagaagtggatgaaacagactgttttgtgatggcagggaacagcctatgcacaggggcaggtgctctactggtgtcttctataaaacgccaaagcagcccgccagaaaatggacatttaggcactcgtggtgtctactgagtttgtatggtactgatgagcttgcttgactgattatccatgacttactgagtagatcgaacgtatgtggactcacttctcctagaggaagaccctgtggctgccccagccactgagcagcctaacctggagaccctgatgtgcccagaaagcgtcaaccttgtatctggagaaaccagaacttgcaacagggccaagcagggtggcccatttaaagaggctcctagggttttaattgaccttgttttaaaagagacaccctgtaaaatactcctatgaaaacttatttcacaagcacctaaccgcattctgtctttggtttgttttacggggccgggccccttgttctggtcaattggtctgcattatctctcctcctccaatctcaccacacaccctggcctctgggaggcttcctcccttctttttttttgtttgttttgtttttttagcatcttagttgttactaggggtacttgcctacttatttaaaatatggccagtataggtgcatacaaaatgtgctttctgattaaaacaaagccaaaaataaaaagaaaccaaaatgcctattatagtagttggatttttagactaacagaccacctcattaaccctgtcattttaccataacaacttatttttatctttgtatgaccttgtctcaatgtcctttttctttgatgttgttgcaattatgaacatcaaatttcatagctgcttttccaccccactttctatcacagaagcacaataaataatcttgggggctgggctcttgttggcccaactgtggcttcaaaacatttcagttgcctgtccagccctttcttagcctgatacaacatcccccaaaagtctgttgagcttttcctggaataagaagagggtcttctactttttgaatagagcaatggagattggagaatatggtcatcttgtggaggttattccaggcttcttcttaggaaccttaaaaaaaatctcctcagaagggctgatgatatattctggacaataaggtgagcagagtctgaaagatgagagcaattttcaatcttgtcatgatttcatctagtcagcctcatttcatctagtcatgaggctgactaatgataagacttgctttgtctttgcagtgtactctagatttgactctaaattcagcctctgtcttgatcatgcccacttagaaaattagagtgcagctagctcaccttttagtcatcttaattccactaggcagaaggctgtgggtcaaggaatgttgatggagtaaaatttgactgcatgtgtatctgaaggggtaggaggctaagagattttatggcttggaagctgctgagatgtggtgtaaagaacactggacttagagtccagacacctgagtttaagctggactctaccactgggtagttgaatgactttgagtgagttatataagctctagcatctaagttttctcatctggaaaatggagttaataacatctactgcattgggctgttgtaaagattaaattaacaaagaatgtgaaagcacctgaacaaaagcttgtgagtaaataattagtaatttgtggaatgaacatcaagggaagtcttcaatttgggtgttttcagtgagtttctgttgggtcagagtgaatggatattaaattctgggattttggtttgtgtgtgtgtgtgtgtgtgtgtgtgtgtgtgtggcgatcaacattggttcttcactgtgaccttaggaaagaaatgcaatagggtttttattgggaaggtgggtagcagggagatgcatgaaccatattaaggggggacctccaaattgaaccttgttttgagtcaactgcaaaccacaaccaaggaggtcctgggagacctggggtgacttggggtgattgggtatgcagcacattcctgttcttgtgtcctgatgcctggcaagtagggacctgcagaaaatactgattctcctccaggcagttcacatgactagcttttaggagtgagtataccgttgcccacccctaaaattcttgatcatgtctccagatgtctactgaccactgatgctgaggtcatgaatcttgggcattctagaggctttgggaaaaaaaattctacttacttcttttgcccagacactctggggtctacctcttggtaaattattcaaatgaggtttctggtcatgcaaatgtggtttctagagcctatttgaattgaacaagtagttcttattattagtaaaacagcaaggatccctaacttggggtccaagggtaaattcagggtttctgtgaacttggatgtaaaaaaaaattgtctttattttcaataatctctaactagaatttaacattttctttcaatatgaatgtaggcaaaactccatggtagtattagctgcaattgtgactatcaccaggataaatcacattttcatgtcttattacacctattacatatatcacaaaaagtgggtatttgatatcaagttagatctgcactaggtagatattcttatttaatgtattaacaaggaagcacatatattgttatcaggttggtgcaaaagtaattgtggttcttgccattaaaaataattacaaaaacagccagtctggccaacatggcgaaaccccatctctactaaaaatacaggtgtggtagcacacacctgtaatcccagctacttgggaggctgaggcaggagaatcatttgaacctgggaagcagaggctgcagtgagccaagatcacaccactgcactctagcctgagcaacagagtgagactctgtctcaaaaaaattaaaaaataaaaaaaaactctgtaattacttttgcaccaacataatatgatatcacacatttattttaaaaagtattttgacattgtcttttaatataaatttttttaaatcttataatattttaatttgtcatgtaaaaatattattttgagaagaggcctgtaggcctcactagattacaaaacagatccatcgtacagatgaaaggttaagaacacctcatttacagcattctctcacacacgactaacgaaatgacttctgaacagcgccagttgatagatgttctctgccaaaaggggaatatgatcttcccatatgttcctgcctatgggtagccttggagttgtgaagggactttggcataatgaagatgataataagaatgataatggtaatttgttgagtgcctgctgtaagccaggtggttacagtcctgttcaatgtcatgtttagtttaatcctcccaatgacctcaggaggtagtgcatggaacaaagacagaagagatcccctgcccacccacggtaatgaaacatgggtacaggtgaaggcaaaagtggggactgaccctttggagatggctgatgtcacgagtgtgcaacctgtgcagttccacggggccccatgcttagaaaggttccatgtttggtttaaggctctgctgttgccatcttaaaattcttcgtaagttttgaacaaagggccctgcatgttccttttacactgagctctgcaaatgatgtagctggtcctgcctctggttatggtgaaatggaatgtatgacaactcctgagactgggagtctgggaagctgctgcggagagccctctcctcattttcatcaggctcagctacgcaacctctggtggaaagctatggcctgttgaggagggaggatgtcgtttttgagttagtgagttttccagttttgtttgagctccaaagctttcctccaaacaactggaaggatggctgaataattggctgaaagggatttaatcccttgaaaaacctttctggtagggagttgctggcaatactggtgggtttttcatgattttattttacagagggcttgctacgtaaaccagtgagccaggagaaacagaataaagtctgttctggaaggaaaaatgagacctggtgtgccacgagtctagtgttctcataggaaggctctaaaaacaaactcagctttcctgctattgaatgattatctctataaaaggaaactttacttcttctaaaggagaggtcgtctaatttgtgagaaaattcagatgttatttgcttcttaagctgcaaggatgctaatgaaataattctcatgaagttctgttggtgttttagggctaagtttttatagactgttccaaaattcaaaacagggatgtggacgtagtgatggtggaagaggggaagacttttcctcgatttctttgcctgagggatggaattcaggctcccccaataacatattcatggtctttctctggtcagtcagtgatgttcataacacaagcaagcctgtcatcaggaccaatctgtgatggctgagacatcaggtgctcttccaaaagagccataattcacccttcatttcccaaggtttttttttcttgctgttattactgctcttttatcatggttaataagtctgaggtggcttcagacagccagtcctaacccctgagtcaatctggggcctctaacaggaagccagactgaagttctgatagatgggtttgagtggctgtgaactgtgtttctgtagcatccagactgatttgcactgaaagggagcttccatattagggtacaaggatgatcaatatgtctcctgtttatatttggtggaaaaagttgtgggaatcgtgcttaaaggatctcaactttgaaattaaaagtataacgtcctaacagacatcctccttctctttagaaacacaaggatccattttcaagtaatttcaaaagaactatgttgctttccccaccccttcccaagtacacttattataatatatccagtccatttgctagctttgtgtctttagaaaagttgcttaacctctctctgtaaaatggtgcttatattagtactaacattcagggttattgtgaggattaaatgaggtaattcatgtaatgactagttctatttctagcacaatttaaaccctcaacaaatatgaactattatcactgtcatagtttttgttgttgttttctaattatataatcttcaagattctgagatgggggctgttgctctttccttgacttgaacatcttggtcttttcctaggaggaaacttgactcttgaaatggtcaaatccattgtcctagttcatcctgacccctccctggctccaatccccaccccttaccgtcctccacccttcctacattcctgcacagttggtcttatttatttttcagtcaactaagggtgttgttaaatcttttatttttctgctgcccgatttggttctaagcactccactccctacgctgctcataacaagaatgcctgggaacgctcagtcagccatatccctcccctgtcggaacacccagttcttaatgctcctggagaggcaacatttctgaggccccactgccataagcccccctcccccatgaagccagtggtctggtagtaatgaacccccaacggcccggagaaaactggggcaaggtgtttgtctggggaaatgttgcatgttgccttgactgtgctttcttctacaaagcttaaaaagagatattatattattttatttttatttttatttttgagatggagtcttacttggttgcccaggctgggtgtgcagtggcacagtcatggctcactgcaacctccacctcctgggttcaagtgattctcctgcctcagcctcccaagtagctgggactacaggcacatgccaccatgcctggctaatttgtatatttttagtagagacggggtttcaccatattaactacattggtcttgaactcctgacctcaagtgatatgcccgcctcggactcccaaagtgctgggattaaaagcatgagccactgcgcccggccaaaaagagatattcaaaagctccctctgactgtgtgtgctgaaggctgagtgctgatgccattgcttaattaatgttgttcatgatctccatttgggcgatttgtttagctccttgtggccctttttggacttagcttatcatgtgacattgacaaattaatgagaagtgagcatgtgatgatgcttggattaggacagaaatcacatctaggacatctcaggccctttccacctgggacctgaggcctcaaatctcttggcaggagatgagtgggtctacacagcccgattttgaggtaggtgtggctagcctcatttatgcgatgggaaaactgtggtccgggaaccaggggttttcaaattatgctttttgcccagggctggatgtaggatgtctgggggagaggcttgactgagatctgggtacactgagcctccactttaggaggtaacctagagactacacctactccctaaactgtattgacttttggaagtcaaccatttagaagagtgtggttttggtttcgatcgtatcccagcagtcttttctctgcccttgttaatctgattcatgatctgaacctgggctggctggaggctggccatgtcactttgcagaccatggacacccctgagtgccctcacagaaccagccaatggaaaagtacaacgtcttctggcttctcagccttgccatctccctctggcctatttgatacccccttttatattgagggagtgaaaatgtagcatccaaactgaaaacgcaggtttttctttggtttttataggaaaaacaaattggcatgaacactcagtcaaaccagctcaggctgtttgggcagatgcctttctttgcttttttctgtttattttcctacaaatcaatgcttaactgcgttgttatcggagcagagcaacaggtgcaaaaaaataactctgctgccaactcaaatgaaaaggtagggcttataccctctgggaggtattcagaagataacagaagcccctgccagcaactgaattaacagctctgtttacggtgggttttatgttaacaacctgctcctgaccctcctacacataaacacaccattgtctcagagagagacattcagccatccagacaacccactgctttattctgccctgagtggagattggttttggctcaggctgctttgtgaaactcagaagcattatcctctctgccaactccacgtcctagtcagagttttctgtgaaggcaagggcatggggttgccggagagaagaggattggtcctgcttttaagcctagctgaaattcttttcaaggttggtcattctcaaatgccagagagggttgcccggctctctctgctcttgccccattccattcacaacaggaggtggggaatgagctcagatgactttggaaggagccactattattttggaagccgtgtccttgtgaatagtccatcagggtagggcagcgtctatgttttgttaactattgtatcgccagcacctagcaaagtgcccagcatctagtagacacttggtaaatatgtatgaattacagagggtctgagacaatattgtaatggccggataagcatttcttggtaatagtttctttctgctgaaagctgagagactaattgtcttctgtatgagggcttaagtccagggtaattaagtaatcttttgaaggactgagatggaggtgggatggggttagggtggcttggccagccttgagatgctcctgatgcaagtaaccatcagagagatcctctgcaagcgctatattctggggccagatttgtctgttcggacttcagaactcatacttttgagtatccaattattgttgaatttgaccatttggtattaatagaactaagcaattccctcaagttggcaaataatataatagtaggttatctgcagatggattagaggttgaattctctacattgaatcttttgtctctaactttataaggacttgcttgcatttatggacatttctttcaaggctggtatctcctggagttgatcatcttgtggtgggaaagggaagggaggcaagtgggtaagtctatatagaccagaaaatctcaatggcgagagtgttcaagacttcgttaagggaggttctcagaaatgcagattttagtttagagatctggggtttcagtagccaaacattgttgactctaacaacatgggggtactgagcattaggacctattttatttcaagttggcaaataatacagtgataggttgtccacagaggcccacagaaaacaagcaaaaccaggaggatgtaaatgtttggaagaagaggagagtcaaagtttcttttgagggctcaaaagcctctgtgatgttttacaatctgaagcttgccctattcttaatcatatctgatgggtttgataaaggccctgggggtcatcttaggcaagcttgtcttttgatcaacttgggtgcctgccactgtcagtatgtgctgcctagcctgggtctgacaccaagactgataaagatcagcatactatgtatatttccaaatggcttacagtcaataaagtgtacctataatggatccagacttggcctcccagtgctgcattattggtcatgaaaacccttgaaaccccagcaataatacctcagatgttgcccctgggaacgtgaaaaatgtctgtttcaaaacacattataaggctatgaaattatctgtgatgtaatcccaagagaatcaaatacattccccaagcttgattcacaattcaattcatttgtaaaaacacaaatgattgtatgtattatattcagttgcctttcacatgtacatggatttttttttctcttatttgggagtagtcctttgaaacgacagtcatattgaaacaggaagtcagtaagctgttgcaacatccttagggcaaatgctgtgaattcacctgctggtaactttgattaaggactgagaatggtgtgggtatcgctgtcatcacaaaagtaattatttaaaaggactaattgctcctttggcttcagaggtaaaaatgcccacatggcagccagttctgtggcagtttggggataatgtggttggatgaataagggagctaggaagaaggctgatggtggccttgactctcaatcccctggggctggggacagggaatgcaggtgcaagccctggttaagatctgctccgtggccctggtggttcccagtgtaccttcacccttgcagcaggagcaaaccatgctgtctggcctgaggtctgattcaggtaaagcataaacaattatggaccagtcgatttcccaaatacaaaattaaaataactttattgagtcatagggggataatttacattatatatgcacgtatgtatttatgcatgcatatgaatatatatacatatatttgtatataagcttgataaaggtgtaaggcagcagacggcacagggagaatgctgtgaccatgtctagaatgggagtcaaagtgagaatgagtcttctctggcaaagcaccctcttctcagcagagagtggcccagttcccaggttttattgcaagacaatctgagtttgaattctcttccagttccaattctttctaaactgtgtgaccttgaacaagtcacctaactcctctgtgcctcagagaggccatctgttaaatgacataatgcctcctagagttgttgtgagcattgattgagataatctgtttaaaccagcagtgcagagctggtacattttaagtgttcagtaagtcctaattactataatatagttattattattatttttaaagtgtttaatcctgagtctcagtagccccatcactgagcaaaagaaagacctccctccagctgagcaggcccaagctggcctgcgttggtctcttctggaaggttcgctctgtatatttaagaagggaggccagtggagcagtccttgggcttgttaggaatcccgaggctgagcagagcctcctgggtcttgggatgtgtggttccagttccctgccagtggcccagggttttttcttgcttttctgtccctattagccctagccccaatccgaaaccttattctttttttttttttttttttgagatggagtttcactctttttgcccaggctggagtacaatggtgtgatctcagctcactgcaacctctacctcccgggttcaagtgattctcctgcctcagcctcccaagtagcaaaccttattctttgcagtatttgagcattctctgtgctaagggactcagaggaaagagaaacctttagccgttctctatcaggagcttgcgttttagacatgctgctcttcctggtctttttttttttttttttttgcacctccaaaccagctatggtatgtgggagtgcaaagcctttgacaacacagagcttaggagcatatgccttaccactgttcttggcagccttggcaatgtgtctagtgagaggaagggggacaggagggatggctttcgtcctttgggtaagaactgtgcccagccagaggggaacatcatggcttctgcaagcagagtccaagccccgctgtttatagttcagccataatggtacgtctacacagcagctctcggaatagggagtggggaggcatgagatctagtcctaggctccactgtgccagtcagccagaactggagaagactgtacagataagagagctttgaagctttgctcgaaatgaacttggctctcaatttcctccttgagagttcaataaaataaaaactacaagtatgattatgattattataaaaaccagcaaacatttatcaaatacttactatgtgtcatgcttttccaagcattttacaggtatcatttcattgttgtctttcgacaacacttttcatgtcatctctactttatagatgaggaaactgaggtcctgagaagttaaataacttgtccaaacttgccccattaggaaattggcaaagccaggatttgatctgtggccatgtaactccagagcctggggctcccaaccatgatcctgcttctgaggagtctactcctaccacaaggatgtccccagtgccagccaacacagtttaaacagagactcatgggcagaccctctaataagcatagacattgactagacacttgctacatatgagacattatgctggggactttacaaataatctcatttagtcctcatattagctccaccttccaaagtggaattttgttatgtggggagactgaggtggtagagaggatagaaattctccaaggtcaacatagcccaccaagccacagtaccaagatttcaaccctggccgtttgaatcatgagcccttattcttttaagagcttccctcaagacatgtggcaccacggccgggcccggtggctcacgcctgtaatcccagcactttgggaggccaaggcaggcagatcacctgaggtcaggagttcgagaccagcctcaacatggagaaacccagtctctactaaaaatacaaaattagccgggcgtggtggtgcatgcctataatcccagctacttgggaggctgaggcaggagaattgcttgaacctgggaggtggaggttgtggtgagccgagattgcgccattgcactccattctgggcaacaagagcgaaacttcatctcaaaaaaaaaaaaaaaaaaaagacatgcggcactactaggctgcttttcaagctcctcacactcttgaatgtgtcctctcaactcagcttttagtgggattcagtctctgtggctaggctttaccttctgctatgcccatatttgccaccgaccagcagccaaaataggagactcttaaactttagggttagaccaagtgctctgttccccctgctccccttcatgggtccaggctgtgcatggtggtcagggtggtgcttttctggaagcaagcccttggcgaagcaagcctggagaagcaggcgcatggggctgggatgtgtctctgtgtggctggcacagaagcagtccaagtgcttggcaactcagggcactgcgggagtttgtgtgtacctgaaactgcccttaaaagaagtgagatgcggaggctggcctatctcccgccatgtctcaggctggtcatttagcacagaacagtgctttcttgctgcaaaaagaatttcagattggccaagccccagtggcccataattttaggggagcttatggcacattgtaggggacttgctgcctaaggctaaataggtcttggcaagaagcctggcatgttgtacttgccagttcttcagtctattgggtagcacacagggctccttctcttcaaataaagagtacgattctgccccacaactgtgagtcttacaaacttctgcccaaagaggtgaagtttgggaaaaatgtcaacctctggacaatcagtagtgtctcaaaatcaaatacacttccctccaattgttcctacctatgaaaaaggatagggaaatatatatgaaaaaaatctcaggataatctacatttcatttcactcctttttttttttttcctttttgagtcagagtctcgctctgttgcccaggctggagtacagtggctcgagctcggctcgctgcaacctctgactcctgggttcaagcgattctcctgcctcaacctcccgagtagctgggattacaggcatgcaccaccacacccagctaatttttgtatttttagtagagacagggtttcaccatgttggccaggctggtctcgaactcctgacctcaagtcatccacccgcctcggcctcccaaagtgctgggattacaggcgtgagccatcgcacccggtcacacttcactctttgagtttgaaataagaggtatagtttttctttgtgtgtgcagtttgtaatagctcaggtaataatttatacaatctccccagaatacataccacctgggaacagacaaaggtggctctgatacccagtgtattctcttaaaccttcacagatcaggcaattactctataggtaccaggcactctgctgtgggctttgaggtgccttgtctcatttaaccctccagcaagcctatgcctattctccgggagaggaaatggcacccaggaaggctaagggacagcctaagtttgtcacgtcagtaagagcaaagcctgagctgtctgcctccacaagcttttaaccagtattctccactgggggtggtttttgcctcagggacatggtgtgtgtggagggggtgctgctggcatctagagggtaggggccaggggtgctgctacacatcttacaatccacaggccagcccccacagaagggattgtccacatttcagtggtggagaggttgagaaactctgcttttaaccactacctagggtggctgaggattcctcctctgcctccccatccgaggttcctgcctccagcagaagatggggagaagtgagttcttttcccagcttgcttttgactcccagggtggagtcattctcacttaggctctgaactggggattcagtcctggaagaaataaaatgtgttagaggaacaccttgagaattaatgtttaaagaagggaaaggaaactgattttgatgggggacatgtttgccaggggctagacaagacacctttagacccattataattatttatctttcaaaacagcccttaggcttaggagaaacaaatactcccccgcaaccccctccagctctcccatttctaaaccagtgagagaaatggaggctcagaaaggttaacgtgctcaaggtcacatggctgaaagatgggacctagagtctaacccaggaatctcagattctgaagtctctacttccacacatttgatggtattttttttttaaggaaaataatgaaagctatgctgaaagcaaagtagggagctgaaataagagcattcaataattcccctactttctaattaaaaggattgctttttataccccagaaagcaattactatatactacagaaagtctacattagcatatgggagtatgggtgagttcgttataataaggtttttttacaattctcaagtcacatttgttatccacgatctcattccatctcaacagtcctgtgaggctgttggggcaagtgtcttcactctacgcctgaaaaactatgcctcagaggagggtaggactcggccaaagcccttctgctacactggccctgggcctcatgtgcccaccctgaggacatctttccctgcagctccctgcccagttggaaatgctgaccttctttgcttacaagcccaggtgagctcaagcgaactctgactcactaagggttaagccacacaaactcttttatgagtggaaaccacttaatgtgccctgtaaaaaagggcccctcaccatgctggctgctttcccttggaaagggagtgccagcagggagcagggctatgcacaggccatctttttgcaggaggatggtgatggggcagctgccaccctgtagtcttaaaggcatctctgggggttgggagaagttctggatgtttccagaaggtcatggtggaaaatgacgtcggccctgaggagaggggcttgtgggcatttggccacaggtggagaactggcccatattgttctgcaacatttattaaattctttttttttttttcactacttgccaagctctctatgtgcatgacctcatttgattcttacagccctttgagtttggtgttgttcccatttatcaggtacagaaagtgaggaacagaatgtttgcggctagacagatttggcactggttcagggtcacccacagtaagcaggggaactggaatctgagcctgcatctctccagctccaaagcctgggtgcacagcctccacgccaccctgctttctgcttgtcaggaagcatagctggcccaggcaggtgctgccactgaaatgaccactttgaaacaaccctgcaggcaaatccttgtgaaagaatttgagagaagcctttccctgcctgtcctccctaagcctggaaggccaatccctccatgcaaatgggctgggctctgagcttcagccctttcagggttaaacagtaacctttccactgcttgtggttgagcaaatgctagcaaggaacaagcccagccttgagcaaacaagacactgggccctgggcccccctccttccaccagccacccggtctggggacttagagattttctttcgtcttgaagttcccaatctgatttcttagctttagggcaattgctctacaaagttggatgggaaaatacccagttattatgaaaaaggaaagaaggtttgacttgaggttgttttctttctctgagggtgagaatcaaagagcttttcagaaaaggaacttatgatcagtatagtcaccatctgtaaattttcaagtggggaaactgaggcccagcatcatttctggttcaggctatccacagagctagtgacgctcctcatgataacacctgacgtgtattcgtgccctactttgtgccaggtgctcgaggtacagaaactcatttaatctccaatcaatgtacagacgaggtatgattagctgcattttgcatatgagaaaactggggttcagagaggttaggtaacttgtctgggtgagtactaaccttagctagtaagtaggaaggcttggaatcgaccccagctcttctggcttcaaagctcctatacatggtgccaggacatataatccagtcctcctatcttcccacccagtggctctttgctgttataatgtccatcatccctaccctgtctttccttctccaccttctacttaggctggattcagtcctaattatttaccaagcaacagtgatgatgaagctaataatcatcatacatgtttgtgtgtagcctagttcaacctttaattactgctctctccccagcacctagaatagtgcccagcccattattgggctgataaatatttgttgaataaatgaatacatgaatatattcgtatgccttttgcagacccctcttctcccccagtaggccttactcagaacaagaggagcggtagctaaattaggggaaggaatgccaagggctgaaaatcctctgggttggcaattgtaatcctgtggacattggtaatacccgaggatgcaaaatttccccaaaacaagcagaaaattttccatgaattgctgctataaagctgaattcctctccccaccccaacattttataaagagcaagtgacttttacagcctctgggtattgcccaatagcgatctggaaacaggctgctcttcgtttaaatgactgaacacacggttggggatctgttctgaaaggtggagggtgcccgcttgggaatagggacattataaatactggacaattgaagacaatatttctgaagtgtaaaatgtttgcattgttataaaataaacccaaacaggcccatggaagaaatctcttctcccaagtcctttactgaaaaaatgatcccacagactgagaaagccactttgacttaggtcagcttggaaacccactaaattctccaggtctctaacaggagaaaaaaaactggttataattgttaccagaaaggaaaaatttttttctttaccagaaatgggcagtgtctgtcagagaaaccaactgattcctgatattatcacaaagccagatacttgaagagctctattaaaatatgactgaggccctttgatgaccagcccagcctgtggcagatacccgcactgaggaaacttgttactgggtgtgcaggtgcgattgcagtccgagctcccacacaggtgctggggctgtgctgccaccagcttggattttcattgtttgaaattgcactttaaatactttaaataaaatctccttggcattttcacttttgtaaaaaaaaaagaaaaaaaaaaaccgcttggatgccagccagcctcgccctgggagcaggtattgcattttcctcccgcttcattcctgatcagagattattcatttatgaatgggtggctgtaaaaacttgcctcatgcatatgaaaattgaacctggaaatttttaattgctgtgagttttgcttttacaaaaaacgctttggcaatgggtggcaggcaatgggtggaaggacaaattctctttattttcttcctaaatttactctgtgatctgcactttccaatgacatttgtccaagaggcactgactgaacaggctgtttgatcccctaacagatcatgattctggaaggaggtggtgtaatgaatctcaaccccggcaacaacctccttcaccagccgccagcctggacagacagctactccacgtgcaatggtaagagggcctgtgggtgttggtgtcactgctgtgctgtgtgggctctttgctttaattcctctcacaacctaatgtttgaaaaatataggctttacagcagaagatgtgggacaagaaggaatggagaaaactcagttttggagttccctaccagcccccagcgttccagacaaaagctcgtttgagatattctattgcctcctcccaaaattcaaggttccagattgacagcctggcagtgaaggggggtagaagagatgcctaaaggaaagactctctgttggagcttttaatagtgttttgctgggatatcaagataggctaggagagaaagggtatgtgtgtgtgtgtgtgtgtgtgtgtgtgtatgtgcgcgtgcatggaggttaggaaggagagggttatagcagttcaatctttcttttttcgtcttccagtggcctctctttgcaaggggagaggagatttgtaaggagaacaggtgttctccctagagctttaatctagaacacgtctattagaagaagaggggacctggtggtggggcgtatagagggtttggtgatcaagcctgtggcttcctgaatcaagttgaatccctgaatcaagttgaatctctgaatcaagttgttgctgaatcgggaaccccataccccaatttagagctctccagtttaggcattcagctgtgcatccaacagcagtgagtttagggagctctgggcctcttctcaatccacacccactgctaatctgcctgccagaggctctgctgttcaagtttgctttgaaatatggagatggtttgttggtgaccagagcttgggaggaggcagaagtgggaggataatgggagagttattctgcagcgagtgctaatccatgtggagctccacctcttttaatttggaatcctagtcaaacatggttgaaagggtgagcaggtgagcttcccttactcggtcacctgtccccccaaactgctgcactttctgggcagttgcattttctgttgtgggcctcaaataccctgtgaggacccagaaagtggattccaaataaaactggaagtctttggcatccccaggaccctggcctctcgatgaaggcagcatttctcctgcttgctctggagaaagctggggaaatgtgttcagcaggaagtagaactggggtgccacttttatttcttaaattccagagacctcaaagaaagctcagccttgattgagactgaagaggaaaaggagatcagttgaatggcagagaggatgtgaactcataggaatttttattgtttctcctgaaacttcaggaatttggtgggttctctgtctgatgcggaatctccccagtcagcttcagacaaaaatccctgattctcccaagtttgaacaagatacactagcagggactatcttttaatctagaccgtatcaagtttgcagatgagattattctagatgtgctgttaggttattaaaagttggtgcctcttgttgtcaaaaccagagctgtactgtcatagcaacacaattattttagaaaaagaaagatgaaagacttggggagccacaaaatatatatcccatccttaaacagctttatttgtgaggcaccaaaaattgggggaaatggaaagatccagcccaaggtctgtgtatttgggactatttccatataattagatttttagattagattgttccattcctcccccaacccctgactattggcttcctctttagagcccacgttgtgggccaggggctgcttttgtttcgccatgaggtacgaggagctaagtgcatactgtgagtggtgggtattactaacggcagtcacctctgtgtgctagataaacttgacctcctgctcttagtgcttctgaggtctggaagccatggatggattctgaatgaatgaggaagaagagggattgggtcagaaacatttccctttcagtctctcctctgagggtgttgtgggctggaccatgggcattatgggagttaaacctttctgaggcctttagctacttgtaattcgatagaccagcaacatcagcatcacatggaagcttgctaggaatgcagaaactcaggccttgccccagacctgttgaatcagaatcggcatttgaacagtattccctggtgattcacgatcacgtttgagaagaactgatctggcgtgaccttgaagaaaaagttagagacagttttcttgcactacattttcttctactggtccacccttgaatttgttggaatatccatgtgtcacgttctgttggatttcccctgcttcagcttggtgggatgcaatagtctttgccccttgcccctttcactcatctttcctgaaagagagttccttcccaacatctatttccaagggaactgtaagctctctcagccctgttacatgccctcagatgctggtttgtcttttccattgccgcagaacttcgggcagactatggaatgtttttttaagtgagcatgagtcacatatacagatggttagcacatattaggttcagcaatatttatccagtttaatgaactgcacttcttcattggtatctgaatgtaccatcttgtgaatgtaccatcttttaaatgtacctcccaactcctcagatgcctaccttatttcttcttcaaaaatacattccattaaataaatatatggtgagcatctactatgacaaagtctctgaggtcattttttaggtgatacaaagacaagtaaaacagtctgtgacctcaagcatacaatttacaaaggagaataagacggcacttagagacctgtacagaaaagcagaacatgacaaagccattagaaataccaagcatgtctcctggagggtaagaggacagtgagcccttgaagcaagttggggggattgggaatgattttacaggatggtcagagttcgaaagatgggtaggaattcaacaggagtgagaggtagaacacaagcttagctgaaagaacagcatagagaaaagacaagttattggttacttgaagaagagttagtgaagagcctcaatgcctagctaggcagctttatacctaatttcagtgggtgatgaggactactaaaggtaactgagtagggaagtgacatcatgatagctataatgactaggctggggcagtgggatatcagtccagttagtagatcaataatctggaccactttgaggaaaagcaaaggcatcgtagagaaaagaaccttaatttcaggccttatttttagttgaaaatggtctgagtttggtggtgtgtgtgtgtgtgtgtgtgtgtgtgtgtgtgtgtgtgtatgtataagagagaaaaaatgagagagagtgagtgagagagaagaggaagagaacgatttgggtatggacaataagctaataaattgctgaaatgatagcaatgctctagctttcatgatattttactttgggggaggtgggggatgagctctgagcacttcagctctcttgtcctcatccagtgtccaggggtaggtagcaggctagggaggacatgaaaatgcacttctgctccatcacccatgctggcacatacacggactgtggttgtgtctctgagatatctggcagccaacagtacatccctgtgtcagatactatggccaggaacagccaggggtcactcatgaggctgcttcctgttttgcagtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggtgactctctctttctgtgtctctccctaccctgctaggagccagctggaagaatagagattctgcagatgacaggattctttgtcagggacaagaaagagtggtctcacctccaaattaccatgtcccaagacagagaaatggaaggaagatgaaaggacaggattgaagcatagggtacctggtgtgcctaatcccttataaatgccagtgtaatttaattctttccttatggtgataattttcaagaagacaaaagctggctaggaattcgtagaatacttactatccttggaaaatgttttctttcctttgcaaacagtccagtcacttgcttgttaaaaagatcatcatggttacaaaaaaaaaaacaaaaaacaaaaaacaaaacaaaacaaaaccccccccccacacacacacaaagaaccttctagacctaggttcttaagatagggtcctaagggtggtaagaagatatatgaaattagaactatgtttgtgttttgggaggggaaaaaactcacaatacttcagcagattcttaaaaggtctgtaacttaaaaaaagggttagaacatatggtctagacacgtgtatggggaatgtttctgtggtggtttctggaatttctgttgccctaatgccccagatgtctctctgaggcttcccctagcacagggatgggccaccattccagatgttgtctttgagtggtagattattcatacacgaacatatcctatactgacatgtaagacctagtagggtggacaactgaccttgcagaatggttttgacactggcataaggttcccctgatagtggctgtaaaaatctagctcttctgagaactatgggcatcctgaaaagtagcaatatttaagaacagggagttggcctgtctgcactggaaaaggcatttatgtcttggtagaacccatgtttgggcaagtaaccgggacttgggcggcatgagctccagggctgtgaaccagagtcataccctggcaacagccatcaacactgaagaggacctggggccttgcagcagagcttgtggctgcggtggccattttagatgatgtcattcagctccctggccatgccctgcttcccacccacctcacattggtggctgctcttttttctttgactagaatcaaaccaaacaaggctctataaataaccctcagggatcttcaaaaagatcagacttacacttgaagaattaaaaatatttacctccaccccccaattaaatccactcctttaaagctttgccctgattgaggtctgaggcagggaggcctgggaggtgctgtggccatcttagaccttctgtctctgacttcccatgacttgtttggtctcatcgcatgctgctgtagcctctgagttcctaatgtccaggcagattgctcactcttttgttgtttgcctttgtgtagaccttctatcaactaacatttattgagtatttacttatactaggcactgtaagtgaattaattcatttaataactttatgacaaagtaaatattgtgcccattttacaggtgggaagactgaatgtcagagaggttaaaggcatggcttctgttcttgagatgtttagaatctgtctggggaagaaaacagactagattcatatgcatttacaaatatatatatatatatataagcatacatatatatgcttttatatatgataatgggagaggagttgcaagcaaacaaggtcatgtgatgtgtactgcttgtacatgtgctgaggcataaataaggaaagagtcaccacattttatccagacatatctcacagattggatgtaatcatgatggcattgattagattttaaatcaaagaagaatcaagctagttaaaaaggtttttccctacattttcattttcatatcatatcttagtatgggaaagcaccttagaagtcatctagtgaccttatctagtttaatcttgttacagatggggaaactgagacccagaaaggtaaagtgcacacaccttcctcatagctagtagttgaaaaactgggcttctgaagttctatttccaccatactgaatgcctttactataccacatcaaataattgcttctaaggtagtgccttagattcccaattttctggggtcagagactgcaggcttgagtttgtagaggctgacagagaaaccacctcccataaacaaacataggtgaccaggcagtaggatggcagaagctctgcaaagatgccagttctgtccttatttaagcatccagttctggctccatctgggccctctctgactatcccaatctgtccttcacaggccagtgcagtagtgacctgttccagtccacacacaatgtcattgtcaagactgaacaaactggtgagtagtagtggacaaagggagccaacctagcctggcaaagctccggggaggacagttgggagagggcaagagagaatgtgggggcaagtttttgcaggaaacacagggaggccttttccctggctgtctctgatgggccacccccaccatgaatctcattcttgcccttgcgaccagtgactgccacctatttccaatttatagacttatggggagccacacttctctgcctcctactcctggttgtggcatcatccagacctcaggccagcagccaaggaaaagcagaatatatggtgggcctccccaccttaaaaagtgtcaggggagtggccaagtttggaaagagaagaggaaggggcaatgtctcctcttctctccctcctcccttgatgggtgtgtgtttcacaaaaagggtgaatatactaacttggtattgtagttaacaaatttttaggggccctggggagcttctgcagagatgtacaaaggtacctgcaacccagctcctgccttaggtgtgtttttatatgaaggacaaaatgctgggctctgagcagagtctacagtcccatagcatctacattcattttcgtttcctttcccctgtcctaaatctctctcctggagactgtcctccaaagtccatgagccatcataaaactgtgcagcaactattgctcctaagtcactccccatgttcatgcctgggagcctgggagccacgtgggccaaccaagctttccatagacctccctgaggatgtgtcccagtcaccaaggacagaatttgacctgcaggtgatttgtgagtcacttggggccaaaattggcccatgcagttatttaccctttcataagtgggctggcctaccattattaaagaaaaaagcaatagctgctaagcatgcaaattaggctttgctagccctgcctttctcttcagaggccaggggatgggccatctggatgttctgtgctttacaggcctggccttgccctagagatggatgcaggacttggtcaggaggatggcaccccctcccctgcttgacctgtcagatagccccaccgaaggagccagggtaatactggagaggtcccaaataacttgataattccttcttgaccatccagacattcttgtgttgccagttcagaaaagctgagtggaagggtggagaagaaggtccaccctaggaggaggggagaagaagctcatagaggggccaacacccccatacctctttggttcagtttgttttcagagacaacaacaggtgtacaaggtgacccaacaaggagagagggtgtaaccccaagagattgggcttggggtgtccaaacatgtagctattagctaaaataccggctaaatccctatgtcgtaaacacgaggacttagccagtaagtcaggttttgtatcatttgtgctataaaaacaaaatgaaactcagtcagtggcttacaccccggccctaaaactcagaacccagcaaggaggggagctgagggtaacctaggtctgcggtgaggagaaagcaggaagtttctggtgaggacgaggtgagagatcttacagcttttggctagccaagaaacaaaatgcttctgttggagaccagcccagatctgggggttgcgtaggagttgagctccatttggggtaggtggaggggagttccctttgaatctgaaatctgaagagtcagtcaaagtgagaggtgtttaccgcagcacacagaagaaagagaaagagagacagagtacaagagcacttcttttctgcgatggggcagtggggcttcactcttaaaaggtgtttgtttgatttagtaacacagtccaccccttctccttggttttgttttgagaattttatgtcatcctttaagctaattggaaaaatcctagagggagggggctgtcacccaacttggatgacaaatctctggatttcagcaaggaagaaactgtgataagattgacaagactcttcctgaaagaaatatcattaaccccccaaggcctcattaattatttattatacatttaaataaattaatccctaacaaggccttcccccccaccacactctagggtaaaaatattctggtgattatgcagtagaatgcagaacaaagccaagccaggttaggaaaattcccaggaaccacttggtctaggacaggttcccattcttgcaacttctctcacttccctaaaaatgcaataggtacagaacacatggatgaggccatttccccgaggatgctgaaaggaaaattagacaacattattataaagtaacgcagctgaagcagaatcatatcccttgtctctgaggaccactcctcaccccccatactttgttgatgaacaatgaattagaaaacgcagcctcttctccctggggaaaatgatcgctgactattctccttctctattttttgtagagccttccatcatgaacacctggaaagacgagaactatttatatgacaccaactatggtagcacagtaggtaactaactccctgacacttaaggccctttacattcttattcagtttgtctaagagccacagtgttctattgtgaggtggggggagggggtgctctaaatgtcctttatcttttcatggccacagatttgttggacagcaaaactttctgccgggctcagatctccatgacaaccaccagtcaccttcctgttggtaagctgtcatcacatctgaggctgggtatgcctaatgcttagggagaatcagtgggaattaccaacactctacatttctgcctttctggagtctttctaattaaagggctaggaaagggatggggttaccattagacgaggtttgcttttgaggcaatatttgtacatcgaagatgacccgtagggatcctctaggcaaaatgttggtctcctacgaaactagtcactctgttgtgacaataaaagttgtttaggcttttctttattttcaatgaaaacttactcttgcaatatagctgctaaaattattcatatttgggtatacttatgggaaataaggctatatttaattttcaacaaactacatttggctttagagaaagaatacctcatagtaaaattcaaaggtccgtgaacctgtagtgatagtttctgggtgaaggggtagccattggaaacttccagaatccccacagttacactattttgtcagtttttaagtctaattccgatgactcatcagtgctctctaatcagtcagagcacctgcattttatgagttacgttcactttagctgcatttggttaagcttggatgcaactggggctatccatgctccttaaccaaggttacactgggtgagaagtttgggatgttgggagtctgggagaggggatttcagattaccacccccacctacaaataggtgcattggcgtgtacagtgtgggaaatggttgaaagaggatcttatggtttcccgtgatctgagtatgaacttgtggatctctttgggtctatgaaatggcacttagacatcagtcacaagtgatagtgcctctctcctggaattaaatttggagcaacttcagaaatgggatttaattgggtctttgtgaaagaaattagtctgcaacccttccttcctctttttttctgtttttgtttttgcttttgagaactgaaataatgaaaggttttggtttgaggttttgtttgggtcaagccccttaaatgagatggggctgggagccaatgtaaatgcttgtggaattgagattaagagctgaggccagcatagctctcgacttctccttcccccagtggtccttagcattatatgtcacttgaagtatttgttaaaattagggaatagatcaaacactggcaaggcttggctgtgtatttgctattctgggggaactgagccaaccggggtaaaatttctgtggcaatcattgccactcagtcaagaccatggggttcagggctgaggaaacctcccaagtcacactctgagttcctctgcgacttcctacagtgtcatctcccacatccttccatccttccatccttccatccttccatccttccacttgggtctttgacttacggcaaaaaattccaactaagaataaagctgaaccaaccacttcctgagcctcaggggctagtaggtcttgaggcacccgggaaacaaaaacatcatagttacagctctgctgccctgagagctgggccatcctcttttctacatcttgacttacaccttctagaatctcaaaatcaataggggccttagaggccagtttctgcttttgcatttgcagtagcaaggaactcgctctctcctgagtccaccgattgtatttttcaatagtccttcttaagatgggctcaggaatcttctctccttacccttctgatccttgtttgctgcagctccccatttctatcctgtgattgtaacccaggctggaaaatgagatcaatcacccaggccctaaagaatcaatgcagtctctggggttggtgtattcattggggtaatagcccttcagtaggatagttaattacagccttatatgggtcagtttctttcagaatagtttatagtctctactgcatggaagcagaaccccggaaaaaccttggtcatttgcctgagtctttatttttcgagctcccatgtaattgaatgcagtgaaatatctttctatgttttaatgctagttaccagctgagctaaggcgaggcccagcgtaaactgatgccctctgtgataaacgcaggtggggaaataggctttgttttgatttctctgtcatctgcccatttcataaaatgcccgctgccggtgtcctgttctgctcgacagtcctccagcctgtcatgccagctcgggcttgatgtgtttatccactgacttgttgagcctaaagctagggtggcacggtctattagaacactgaaatttgtatatcccgtaaagaaatggctcacagctgaatcatatgcaaatgcttctaatctttgcttcttgcgaagcagcttagctgaagtcacgctctctcacttgcatcacaaacctgtggcttgttgctgcccctgcctggactggataggaccttggcctggagtgcctgggagccaagcaagagaaagccaggctggacaacttctccagggcaagccattattttataagaatgaatcacttaaccacatggctaacttcaaaggtcttgacttttatcctagggcagaagaaggacacatattaaagagaggttaaagatcaaaagatatcagtggtaaagcaggccagtgattccacggcttacccctgcacactgcaacaggcagagaggtctggaagaaattaggttcttcttttgcctttgactgcttattcccctttatgatgatggaaagatttttatttggggattaaaaaaagaacgttcctagctgggtggagcctagcttgggtaaacggctgacaactcaaagaatatttcctcatggtttatctagtgtagaggttttagagtccatggactgctgcatgggccacagccccctgaaattgttgacaaaatttcatgtgtacatatatgtgcatttttttctgaggagagggtccaaggttttcgtcttattcacaaaggcacctgaactctgaagtaactgattctagatcaactaggaacccacaaacaataattgaggccaatatactgagagactcttgtatttttctgaattcaactcctggctctgaaataatggccctgcatccctcctggatgtcatttgaaaatgagctttgcttgtggcctgctgggtaaatgccactctttgtctgcagtacaacgtggccctgtcagagtgatgtatcacttggaaaccggggtggatgccagacctgtcgcaatattgtcacatcctgatgggatgttgcaacctcaccctgcaacctacagggagggagagtgaagtctccttgcatttcctgtgaatttgtcctctcggatttcagagaaacccaagtcaggtgcaggccctgctagtgacaatgccaggagagaaattcttaaccaggatgagaggtttcttgtttactgaggtcttattaaatccctctctccatcctgccatgacgtttcgagaaattgctgggaacactgagtcttgattagctgggtgataagatggttgaaagggcccatgaacgttgggaaatatagaattgtcagattgaaattatcttttctactaacaagagcattacagaagtgaacctgattcttggcaagaaaggcttgtgtgaaatctgttatgtgcaaagggagattatgtgccggccaccatttctggaaatgacatagaatcatggttatgagtaaagcttctggattcaaactgtttgtgttcatatcctggctccacattccagctgtgtgactctagtcaagtcatttgacccctctgtttctcagatcctccacagctgaaaactgtggatcatattagtacctgtgtcatagagttattgtgtgaattaaataaagtgattcatttaaagtgcttagtacagtgcctggtacatagtaagtgctcaataaacagtagcttttttttcttaaccaatttaattaggagctaatggctggcagttcatagcttttttgaataataggcttctcctgataattgaatggatgctgtgaaccctctcccttcatatatggtttcagtcagtccaggggcccttgaaggccacactgggtcagtggaccctagtttaggaagggcacatgaaagagatcagttttactggcccaatttcttaaaataattggcttgtatttagggactactttgtattaaaattggctgatttttgagtgtgagagtctttgtaagatctactttggtcctcccaatacacacacacacacacacacacatatacacacacacactcacactcacacacacacggctagatcatttagttttctttctgagaagaatttttatttcccaggtccgcctccatcatctcctctttggtaatagtcgcagaggttgccataatgagtcatttgttaaactaatctgtgtttccatagtccactgtggccctctgtattgagcttgggccactcaatggcgcctttgtcaggctgattaaaatgtaactttgcatgccaaaaaagggcactcctctggcttaaaagtcatcttcctttgttataaatgtttacatttttctattatgctaaaaaaaaaaaaccacaaatttttcaatgatctaaatctttcaatggcttccatctttctcagagtcatgtccttaaaagtcccataagggattaatgatcagaacctcagctcctccctctctgcctcttacagcatgcatataccaaacacacatcaacctcagggcctttgcacttctatgttacacatggaaggctgttgcacaagctctctgcatgaccttttccctcatatcctttaggtcgtggaatcagagaggtctcctatgaccaccttgtatcaaattgcaaattattcccaagtccatacatctatctccatttcttaacctgcatcatttttctccatagcatttatcatctctgttttgtttggttcactagcacatactcaaaggtgccaggcatgcagtaggtgctcagtaaatattgtttaaatgagtggatgcatgaataaaaaagagaattataggaaataggtcaattaaacggctctcatttttctccttagcagagtcacctgatatgaaaaaggagcaagacccccctgccaagtgccacaccaaaaagcacagtaagttggctggctttcagatggcctttggtccttcccatcacatcgggcacatctggaggccactagttttttggcaaatatcgcctctgtctgctgccttcatgtcttcatcccaaacagggtggagtgagaaaatagaggcatcacttgctagcaaagtaagccccctctgcagctgtttctcaaagtggagccccactggacatttcctccctgttctgtcatatgtgctctaaaactgagacacccagtgcctaagaactgcttgcaggcatggggttagcaatttccatctctcccagaagaaaagggtgggaagaggagcgagataagaagaaacagctgagatgtatcatcctttcttttgctaaatgttggcctcctacctttgtggagttaccattccaagaaatgactgttttttcttaagattcaacactgctctttgggagttgggtctccttcagtaataaaatcttatgaacatatacgaaatatcagagacatggaattgtgggtggaacacagaaagaaatcaagatggtataatctaggcctgtaatcccaccactttgggagactgaggtgggtggatcacttgagctcaggagttcaagaccagcttgggaaacatgacgagaccccatctctacaaaaaatacaaaaattagctgggcatggtggcacgtgcctgtagtcccatctacttgggagactgaggcaggaggattgcttgagccagggaggtctaggctgtgatgaactgtaattgcaccactgtactccagcttgggccacagagtgatatcctgtctcagaaaaaaaaaaaaggtataatccagaaattatgaggaattagaatgtctttatctgctctttcacataatcccacaaaaccatattaatgcaacccctcgaaaggtgggtggggtgggggtggggcatcaaaaattcagtgggagtaaagttgaatttggttgataatcttattgcagtagtggcttcattttcaaattgggtcctccagtccctgcgtgaccacccctttccctaccaccctcatctattctgggagtaaacattctagacccttactgatttgcatttggctgaaacacagttgctgggtcaaagcaatttaattggttgagatactggataaaagtggttgagagttgctctctggggaagtaacaggttgaagtgaaccccaagcaatttgtggataataactagaagaaacttccccctggcttaggagacctaagacctattgcttagtcttggctatgtcactagttagctgtgtgatcctgatcaagtcacttaagttctctgtgcctcggtttcctgatttgtaaaataaaatattgtgctagtttattcttaaatacctttttaatgtccaacatctggtgattctgcgatccatcttccctgacaagtaggggagaaatgagtatctcctacttgcaggaagatgacctaactcaatgctctctgccctatctttgctgtgacttagatcattagtaacctgcctttctgcttttcatcagacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgaggtgaggagtttcatgtctctgaaaacaaaaaggctgtacgacccattatttacctagcaaccttcatcggatcagtcaccttatgcaatctcctttgttacagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacagtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacctctgtaaaggtttaacttagtgttgtcaagtaacagttactgaaagagctgagaaaaagaacaatgaacagcaacgatcttgactgtgcaactcagacattcctgcagaaaagacatatgttgctttacaagaaggccaaagaactatggggccttcccagcatttgactgttcattgcatagaatgaattaaatatccagttacttgaatgggtataacgcatgaatatttgtgtgtctgtgtgtgtgtctgagttgtgtgattttattaggggcatctgccaattctctcactgtggttccttctctgactttgcctgttcatcatctaaggaggctagatccttcgctgacttcaccattcctcaaacctgtaagtttctcacttcttccaaattggctttggctctttctgcaacctttccattcaagagcaatctttgctaaggagtaagtgaatgtgaagagtaccaactacaacaattctacagataattagtggattgtgttgtttgttgagagtgaaggtttcttggcatctggtgcctgattaaggcttgagtattaagttctcagcatatctctctattgtcttgacttgagtttgctgcattttctatgtgctgttcgtgacttggagaacttaaagtaatcgagctatgccaacttggggtggtaacagagtacttcccaccacagtgttgaaagggagagcaaagtcttatggataaaccctcctttcttttggggacacatggctctcacttgagaagctcacctgtgctgaatgtccacatggtcactaaacatgttatccttaaaccccccgtatgcctgagttgaaagggctctctcttattaggttttcatgggaacatgaggcagcaaatctattgctaagactttaccaggctcaaatcatctgaggctgatagatatttgacttggtaagacttaagtaaggctctggctcccaggggcataagcaacagtttcttgaatgtgccatctgagaagggagacccaggttgtgagttttcctttgaacacattggtcttttctcaaagttcctgccttgctagactgttagctctttgaggacagggactatgtcttatcaatcactattattttcctgttacctagcatgggacaagtacacaacacatatttgttcaatgaatgaatgaatgtcttctaaaagactcctctgattgggagaccatatctataattgggatgtgaatcatttcttcagtggaataagagcacaacggcacaaccttcaaggacatattatctactatgaacattttactgtgagactctttattttgccttctacttgcgctgaaatgaaaccaaaacaggccgttgggttccacaagtcaatatatgttggatgaggattctgttgccttattgggaactgtgagacttatctggtatgagaagccagtaataaacctttgacctgttttaaccaatgaagattatgaatatgttaatatgatgta

SEQ ID NO: 12689 - DNA, 7409 bp, Human
ttttatggtggggacaggttcctctgggcctaacatgaccactcctacccagttacctggaactcatcctctgggcaccaatatgctgaaaatgaagtttattcagtctcattcatgtttgccacatgtgtccccacataaccatgaaagaggagcagagaggggaagaattctttggggagcatcctctccagttgggacagtcagtgacctctttctcttgcctcaaagaaagtagggcatgcaggaagtgggaggaagctggatgggaagaagaaggaggcaagcgggagcgaggtggtgaccagaggggctgaccccaacttttctcccatctgcttcatcacagagagaagtctcagctgctaccagaacctggtcaggggccagcgcctaccctctgagtagggagaccaccacccatggcccaagctgagggcctgacctggggcaccaggggaggctgggacaagatggaggatggagcccagataggagaggagctggctgagccacagggagaagccagcaggggctgcagctcctgcttctggagcctgagggagagagagagaggacgcctggggcatggtgagtcgggggctctcctcgtgccctggctgcctccatgccaggggcctctgcgagctgaaacatgaaaggtctttggatcagagaggagctgggagcctgcttgccctgcagctggaaagaaacttgaattgttcaagttctctcacttttccctgaagactgattccccattttccccttttgctattatttttaagagccttgctgctctccaggcaaattctcaggttctctgcccgtctgcagcatgtatgcatatgcgtgtgtgtgtgcgtgcgtgtgtgcgcgtgcgtgcgtgggcgtgtgcgcgtgtgtgggcgtgcgcgtgtgcgtgtgcgcgtgtgtgcgtgtgcgcgtacgcgtgtgtgcgtgtatgtgtgtgttgggggaggctgcggtgcctatgactggttgcccccttgaaccccaccagaagccagcccaggcccctctgcgccctcttctgagtctccagggccggttctctcctggcaactccagaaagtgcctcctcacctcaaaagaccaagaaacagggtttctgataaagtgtcccacccagtcccggctggggcagttggttagagaatgaggggacattggggggaagaggagggagaatgaggggatgggaagagaggcgcagagaaaatgagaggtggagagaaagggacagagtgaaagagaaggagaaaggggagaagccgggaagacaatgagaatggaagcgagagatggaagtggaaagaagaactggaagcctagagacagagggagagagggagagagggagggggagagagagagagagagagagagagagagagagagagagagagaacgggaatgagcagctgtgatgtggccagatcagttcatagaaaagaaacacagttcagagcagaagggaggaaagaaaataagaaggaaagaaacagagaatgagatgcagagaggagaggagggagagagagaaggaaaccgaggtgggtagaaaaatgtgacgaaagggaaggacagaaaaaaaaatgagagaagtaagacagaataaaggagaaaaagaagaagggaatcatgaggatggtgagaaaagacaggagagaaagccgggagagaggatagaggggcgttctcgctgcgctgcgtgtcagctctggtaagccgtctagcatgtcattagtggggacctgaggcgccagcgggaaagtcccctccccgtgggctggaggctgagggagggcgggccctgggctgggatccacaggcaggtggccgcccctgggtggggccgcccggccaagccctaggggtataagtgggaggccgggcctgctgagcacctgtcaggggcagctccggggtgcaggtgccaggcaggtggctccggccagcccagccccagcatgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccgggtaaggaggctttgagtgtggggggtgtccccaaggaagactcacttccttcctccccaagaccccattctagaaagttctgactagggctgtgccccccaagactgggggatgctaccaggcaggacagaggggagctcagcagtgaaggagagcatgggcctgggggaagatttgggtttcagccctggctgtgctcctgcccagtcagtgacctctggcaggttagacctcagagcctcagttccctcatcggaaaaccagggatagtgacagcatctgctttgcaggctgcagtggaggtgatgagataatgtacacaaggttttaggtgttatcaagcgcttaatcgcctgcagtaattacgattcatctgcatctccagcacccagcacatagaaagtctttggtgaatgaatgactggaccaaccaaagcccaagggcatcccaagactgccaggaagaggatctgacctgggttaaacagccactaatggcccattttgctgcctgccttgtttctacttaggtaacctcctttaacccgaagacacccctgcagggtagctcttatgaaacccattctacagattaggaaaataacactcagaggtgacacagaatgaagtgatagtggtggagcttgaatttgaactcagttttctctaacatcagaaattgtgagcttttccttttcaacgatgcatttctaaaactcagagacctgcagagaggcatgtattaaatactcatgcatccatttcccagaattaaagtccacttttgttccaccgcaggaagccaaggtatagctcaaaggaaccccaactctgccccatttgagggtggcaaacaccaggcctgtttgtccccagaagagggcaagtgtcctgtccaaggactgccatcaccctcaggctgagagacggtagcaggaagagttcaggccttccctcgggaaggtacctcccagctgcaacgctcctttccatatccagtgtggatcctttctcagtgggcctgaggaagacaggggcaatgggcccacttttcagactagaaaacaggttcttccaaagcccctcagtcagtgaggagcaaagccaggactcaagtctgtcttcagactccaagcctacggctattagggagtcccagagttttcctgagtcttcttttccttcagcattgaaagccctccaacccccaacccccaaatccctcagcatccctgctcccagttcttcatccttcttaaagagacctacattgcaaactccttaatgctcatgcctctcggctgcagtcccaaagggccctgtcatgggctgcttaattaaagatggaggtggtgtggttcatcagttgatggaattcctccatttctcagtccctgcctgtcggtctctgtcttcctgcatctgtcaccttggcttttagtttatgacaataaggaggaacagaagcaaagcattttgtccacctctctatttaccccctttcacttttgtatcaggcaaagggaattactggaccctggaccccaactgtgagaaaatgttcgacaatggaaatttccgcaggaaaaggaagagaaaatcagatgtttcctctagcacagcctccttggccttagagaagacagagagcagtctcccggtggacagccccaagaccacggagcctcaggacatcttggatggagcctcaccagggggcaccaccagctccccagagaagcggccctcccctcccccatcaggcgccccttgccttaacagcttcctttcctctatgacagcctatgtgagcggggggagccccacgagccaccccttggtcacaccaggactgagccctgagcccagtgacaagacggggcagaactcactgaccttcaactccttctccccgctcaccaacctcagcaaccacagcggtgggggtgactgggcgaaccccatgcccaccaacatgctcagctacggaggatctgtgctcagccaattcagccctcacttctacaacagtgtcaacaccagtggtgtcctctaccccagggagggcaccgaggtctaggtacagaacagctcctgagccaggtggacatgccagagagaaaagcagtagaggtcctccatgccagccccacggtggtccatgactgcggaactgcccagacataagcaggagcctccgaggaatccaccctctttctagaacactggttaaggcttctgtttatcacacataggcccacacacagactcaccaactttgcaatagaaatactggtgcctgcagagcagcactaacagtggcaggtgctgtactaggctctgtactggccacacttactattgacagtcaccccgtaaggttcacaaaccaccccattgaacagatgaggaactgaggctcaaggaggttaagtaacatttccagggttatataaactagtaaatggcagagctaagagtcaaatccaggtctatgtgatcctcagagattggaggccaggatggagaattggttgagtagccaaggaaggtcagtgtgaaaagcttgctatggcaaatatagcgaaatctctccactgccttctgtccaccagcatttagtgccagcctaggcacaacttgtcctggtccaagtccttattctgcttgccccaacttacctgcagacactccttttgctaccactcaaggaaggaagtcaccagtggccttagtgcaggaaactcagccctggtggccctgcagaacaatgcatctgacatgtgcgatgcatccccatggagagacagcattgctccccagccctccagaaaccttgagcagatccagggatcagtgagaggagtggtgtgtacccctaaatcctcccaccccagcactgcccatctgtaaaatcttgtaaagcccagtttcctgtgtgcatgtcatggaccagtgagctggagatggctgaatcttccaagagaaacaaggttggataagcgcttccttttttttagcccaggagaggtggatgtttgtctgagaaaacaatggcctcaagggaggggccttgggcccaccctcacagggggtctctgtgtgatctcttgggatttctccttgtttttgtgagtacctgggaagtgttgtttgttttcttattttctttttaattaaaaaacaaacaaacatgtggtgcagaagcgtgggacttctttatgagattttctgtctctcggctgcctggtgtgttcaacaggggggccaactgctgcctggagctgaaggcatttgggacaggaggcagagaaagaatgcatatcaagactcttttcacctcttcactggcgtggagcccagacaaaagcccccaaggaaaagaggggagtctgggaagggtgggtagggtcatggaaggaatccattggtactgaacacacaatatggacttggcgtatcccagtctttacagttcatgcaaacctcctaactgtgctatgatcatttaattctaacaaccccgcgaaaagggggatactagtctcattatacagatgagaaaactgagggtccgagtggttgagagattcgcgtgaagtccacatccagtccacacctagatctgtctgaccctgcagctcatcatgcttcagtgtagtctcagatgcaaccaatgctagaggcagtaacaacagtactacaggctgcgattcactgagggctgtgggcagttcctgggtcaagtgctgtgtaggtgggacattttttatccttacagcagcctataagtgtgtatgctggtgatcccctggggtccctgacacaatgcatgctgcaggacttgttcattgaagctggattttttgttaggagttctctctttgggtgtgcacagagagggcttaaaccaggaatagctggccacttgcatcgctgcctactcaaaccctgggggctctctttccttgtgacagagtgacagagaggagctggtaaataacaacaacaacaatggcaatgattattgatgatgatgatgatgatgatgatgataatgatggtgatgatgatgttgatggtgatgatgatggtaagagcattcatcatgggttgaccatgtgcaaggcactgcattattgcatgtaatcctcaaaataatccagtgcactcaataccattattttcattgtgtaggtaagaaaactgaggcctggggagagtcataccttgatagaaagcagccatagccaggactcaagcagatccattgatgccgtggctaaagtgcttctccacagaatctagcaatggggagcccaggacttaccacaggacagcaaaatcatgacaaccaagagtaaaagaagcagggctgcctgagaacccctcaggccctttccctgggagtccttttctgcagagagacttctggcagattccaggtggcctaggaaagtaaaaggatgggacgtggtgtcagactgtcagactgttacaaaacacaagataggcttgcccctttctgcagagaaaggaagcctacagctcagagggaaggcactccacaaatgtcaccaggacagtgaggtcagagtcagaattaaaatgcaagtccctgaagcccagactaggattttttatcacactaggtccctctgtcaccaaatttgcccaaacaaaccctgaaaccccaccctctccattgatcagctcactgcctgctcttcatctcctactccttcccccaggtgggtctgcaatgggtgagggcctgggccaggaaggaggtgtgaaggggccctgggagagcccaagccaacccagaggggagccag

SEQ ID NO: 12690 - DNA, 45090 bp, Human
tcatcagccttatctggaaacttgttagaaatgcacatttttgggtcccacccaacacctactgaatcgaaaactctagaggcagggcttaccaatccaagttttgttttttggtttttgtttttttttgagacggagtttcactcttgttgcccaggctgaagtacaatggcgtgatctcagctcactgcaacctccccctccccggttcaagctattctcctgccttagcctcctgagtagctgggattacaggtgtctgccacaacacctggctaattttttgtatttttagtagagacgagacttcactatgttggctaggctggtcttgaactcctgacctcaggtgatccacccgccttggcctcccaaagtgctgggattacaggcgtgagccactgcgcccagccaccaatccaagttttaacaagctttccaggtgattctgatggttgctgtttgagaacctctagaagcaaggcatggtataagtgtcagaaattaatctcctcatgagtaaggaccggttatggtccatcccttaagttcccagcctctgcatggcatctagtgtaaagcaggcatcaaaaatttgtgagtttatgggaaagtgatgtttgagctgggtctcttaccccgcctatcactgcaccagaccgaataggagggagaatgggagttcccagaaactttgagactagcaaggaagtggttgtgatacgtctagcaagatatgataagggtctgcaccagcataagaaaccatcagaatggcagtgaatcatgtgagagcagttcagaaggtaaacatgtcaagacgtggtgaacagctgaatagatggaaagaacaagggatagaggaactgtcatttctgacatgaaggtgctgttcgctgagataggaagcacagggcaagtatgtttgtgagtgaaagataaagtgtttggtttggacttcttaaatttgaagtgctggtaggatatccaggtggagctgtccagcaaacacttggaaatgtgagtatgagacatggttggaaacagagatttggaaggatagttgggccgtaagagtggatgagacctttaaggggagagtggaatgagaagagagctgggtttggaaccacagtgaacagttaatgaggcaaaagcaaaaggggccctttagaaagactgaaaaggacttaggcaataggagactgcagaagatgccgcagccaagtagaaggctcagaagggaagtagaggcacagtgacagatgctgcagagaaataattgaaaagtatcctttggatgtcaaccccaaaagtcatttaagtgacgtgatgagggcagaagctgattgacagttcaggcatgaactgtagatgagaaagtggaggcaggtgcttcccaggtccggcggatagagctctgtagctgcacttaagttcaaactgtgacatcttccagggtaggccgcgtctctacttatctgtggtctcagcgtccagcacatggcgtggaagagggggtggcgtcagtgagttcagtgactagggacggagaaagacttcgtggaggcagtcgctttgcagccaaggcttgaaggatgagggtgattgggaggagaggtgggaggcagggcccctgggcgctggagtgccagggggtctgggaatgaagtggggttcccataatgtgtgcgcgcagctcggtgcgacaggcgggggctgtgtgtaggtttggagggacctatttggggaaaagacacagggctgaaggctgctgtggcgggatgtcccttcgccctgccccacttataccactgcgcggttccaaggcacctctactggcgccctcccgccgggctgcatggcgacgggtgaccgccaggggccgctgccttgggtccccggtgcccccgcccctctccattggcctttgttgccgtcggagcgccccgcttgactcgttccggtccgccccctgggcccggcggtcgcgcctgcgcactggcagctggccgggcgctcgcagtgggagctgctgcaggctccgcggcggcggcaacggaggctgcgggggcggcggcgcgagcggccgggcttggtaggggagccgagcccggcccgggatcccgagcagcgagagtgtggggtacctaggcccctcacgctggacttcacagtctccgggccgcctgacctccgcacgggtatatgggatggaagcgggaccctcgggagcaggtaagggtccccaggagggggaacggtgcatgctccaaggactgggggatcccgcatgaaaagcgtggtttccaagtgatggaagcgctcctgagtgaggagaagggctctcccacgatgggggcccagtttgaaggaggctgtgtgcagttccgggggagaaccatgtgaagagagccctgagatgggggctgtttgtccaaggaggctgtatacagtcctgcgggttggaagtaatctgggagaagggcctgcacgcacggaaggactcccagacatccgtggaggcctacggagaggcccggcaggtggcaggggacgggctccaggtgtccaggagaggagggggcgacacagatgggcctggagctaccgcatgccgggggcgggggctccgctgggctggaataggctaatgtctcttgggagaaggcgccagagctggactgtgagctccgccccactgggcctgacgcgagggcgagggtcagggggcggtgggtggggacccagtcccgggattaccccccgtgggtctggggagtcggagcggaggctccagagcatgcgcggaggtggcagctggaaggggctgcccgacgtggtgggggcgtggctgtccgaatacccccacctctccacacccccccgccccgccccgtttggcttggaaaaaggagcgcgctgatggggtgcattctctcttaggttatgctggcagtgtgcaaatggttatggtcccctcccccattttaggggctcttacacttggccctcagtcacagtttgctaagaatgggttgagggaagctgccaaagtgcatttttctgccacaggaaagactgggaccgaagcgatgggttctgggggtgggtcctcctgaagataggccttaggaaaggtattggttacggaggaatcaaggacagggcaggggctacctggaaggagttgtctgcttggtttgcaagtttctgctccaatactgagtagtgatgggggcttttaatccaaagattttccattgaattgtctgttaaggttacactctacatttataacatttattctaatatttcttaatattttcatggctcctatcttccactggatatctttccgttttcctctccccactccccagaaactgtcagggctgtctttagagccaagatctaaaccctacaaacacgttggaggatgggggagtttatagccttcatcctggtgaggcctaggtgatagccttaacttcttatttgcaggcaatgaggaggaaaagacataggaacagaggataaactgaggcaggattgcctcaagaaaactggagtccttaggatgggctgtggggtggtgatacctcttgtgtcttaagtgtcttaccctgtgatgggacgaggagcctggacctgggaatccttcaggtcatctctcaccacttccttacatttggtctggggatgggaatcaaatttccatttaggccatgaacttcattactttcctagtggaattattttgttttttttgtagcagacctaactccctcccaccctcccaaggaaatagctcctacgacctcactcaagttatccatttagtgatctctaagtacttagtgactgttttccctcttaacaaccagccttgtatagactgtgtagtcgtaaggataagcacagggagcaactgacttgagtacttcctctctgtcaggaccctctctccatcccaggaacttctgtttttcaaggctggggactatttccaacaacccatgaactagagtagtggggtaggtcattgaggtccacatggattgctggttgctggtacccattctagactaatgatttttatcctgatgaattcctaataggctctggagtgatgaaaaattgactttttaaaaatttgttacaaaaaataagcttataggaaaggagctagaacctgctgtttggagtcagccaaagccttgggaaaagccgaataggacaggctttgcctcagtaaagggtataattgagattcagtctggaagctgcaaattgagggaccccataactgcctccttcctaggcccggactgttctcttataagaagttagagtggtgtcccaaggtggcctgaggacataatacacaaaactaaagcgttgtgtaaaaaacaacaacaaaaaaccccccaaaaactaaagcattgttgctagcctcactgggcttatgcccaggtctgccttctgtgctcaggtgtgttccaagcacatacagtggactgggtgctccctgagggtagaagcagtgtctggtttatttgtagaactagcaagtgcctagtgtataggccctggcacagaatacatgtttattaattaaatcaaatcacattcaagtgtgaacataaatggttaagcacgtatgtggatatttaataaagtgtatactcacatggaacagatcctttttggagagattggcttgttagtctttgcttgcccaccagctaacctaacctaacctaaccttgaatttgtgtcttttgaataggcagtctggctccttgggaggtgtgtgggcctcagaactgcaagaaaggaatcctgagccagggttttcagctctgttacttttccttctctgggctccttggggatgggggagggggagtgtccttttcagggcccctccctccttgcttttgtctgaagagaagggtcccgcccctttccccctaggcccaagctttgtcctctgtgctggggccctcatctgcatcacaaagtggccgtctgtccctgtctgggtctgtagggaagtgtctccctttctcagactaaaagctggggtaaggggggcggggaggagacagtgctgttgttaggctttcagggggatgtaatgggagagaggttcctgcttcctgctgtctttcctagtttggagatgaagtgggggtgtgggctcccctgttttcccaaagcctctttggagaggaaggtgctctaaggctatgtgtggtatgtagtcgggtttctggggaagagaaggctttgaggctagagtgtctgtcccatcccccatcatttctaactagccccccagctctaggagttatctttctccgaaggccccaaatgattattcagtctgggaggggaagaaggtgaatgaaatataagaacttggggagggaaaggatgtctcttactggctacacccacaaacgtgcatatttgtcttgtgtagtgtttataattgtttctgggcaattgcaggtgttcgtgtgtctgtgtgctgtgtgtgcttgtgtgtttttgtggtgtgtctatggatatgtttgttcattcatttcatatcagtatgttgaatacttcctgtgtgtgtgtcagacactggaaattaaacagtgaccaaggcagatatagtccctgcctttgaagaactcagtctagggcagtgaaggatatgtgtgtaagtgtaaattgccaaggtctaagtgtgtgtttggatgtgtgtgatggggatgtgtgtctgtctgtccgtgagcttgtgtgcaatttctgtccagcactttctgaggtaggcagccaggtgctagtagataggttttcccttccccatgtagctgagttctgaagaccttttccatccaggctgggccttcatttccctgtctgcagagtgggactgggcttggacaggtggttagagggaaacagagcagcttagctctgggaagctgcccctcccatgaatggttctgacctcttcctgacccccagctgagggtatgccccatccccccagcttgtctgactgtgaaagcagaagtctgataatgggaggttctgggctggtttatccctctcttctcccacctgggctagttctctactgccaagaacaatagcagcatattattccctttttttctctcttccccccaagctagaaaataagactggagacagcagccagactggcaaaagagggtaaagtagctggatctggccttaccctatccctttcccaagggcctcctctgtcttgaaattgatctcttctgctgctgtctggaccttctgtgtggaaggatctgtggggcatggagagaatcttgtgttcttcccagagccagtgtctcttctccagcattctaattgccacctcttcttcccaaacccgttagttctttctttattcaagcttttttttttatcattgtctccccagttgctgctttgtttcttcctgcctgagcttccaaccctaacctcttttgccccaccccttgactccagccttctctttctcctggcctttttcttttgtgacctccagctctgtcctcttctccaaccccctttctcttttccttagtctccaaactctgtcctttgagccttttctccttttccctgtctccaactctcgccattcagttgccttaattctgcctcaaacactgaccctgccctctccagcctggccttgtctggatcttattcctgcccacctataaaggaacatcaaggttatgccattttgtattcagcatggtggcgaatggagtgagcatctggctggcagagaatagaaattcttggtctgctagatacctggtggaggcaagtgtcttactctactagaagaaagaaagggttttgttactaggagccagatttagtctctctgcttaacatgcaataggaacttattatatattaacttaatgaattaaaaatagacaataaggataattttcctaactggagagagattaaaaaagaaaaaagagaaaaaacacagatgagcttgagatgtcccctggaagcccttggctgggttgggtagcaggaaagaggcattctctatactctcgtgttcctgttctgggaggccttgttcctcctctgataagagtagttaggagattgccagactttaccctcaccagcctctttgtcttgtagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccggtaagtgatgcacacctaagccaccaaatctgaaagacaccaaccttgaaagaggggccagaaaggtaaaagaaaaaccagtagagggtagtatcaccaaatctaaggaagtttttgaacgggagatgccacgtcgggtaaatgctgaaaaatagtccaattggacttcgctattggaagattattagtggcttttgccagagcaatttcagcagaaagtagttgagctagttaatctaactacattgagttaagaaataagtacagtacctactacatttcaatattagttgaatgaataaagagttttaaagaatgagatatgggtatgtttacagattaaggagaaggagctagtaaagagggagaggttaaaggtatgggacagaggggagaaatgaatgggatgtccttgatgaggcagaaggacagaggggagaaatgaatgggatgtccttgatgaggcagaaggacagaggggagaaatgaatgggatgtccttgatgaggcagaaggacgttgtaggatgcacagttggagggattagccttatttagaggaagtgatatttccttttttttttttttttttttgagagggagtttttctcttgttttgtttttgagagggagttttgctcttgcccaggctggagtgcaatggcgcgatctcaactcactgcaacctctgtctcccagctttaagctattctcctggctcagcctcctaactgggattacaggcatctgccaccatgcctggctaatttttttgtatttttagtagagacggagtttcaccatgttggccaggctggtctctaactcctgaccccaggtgacctgcccactttggcctcgcaaagtgctgggattacaggcgtgagccaccgtgcccggcctctgtgatatttctttaattaattttattatttgaaaactatatgtataatattaaaaaattcaaatattacaaaaagaataatagtgaaaaatgtctccttactatcctggtctctagtcccccagtaccattaattgttacctttttttctttttgagaaagaaaaattagatttttctttctccctctgtcgcccaagctggagtgcagtggcgccatctcagatcactgcaccctctgcctcctaggttcaggcaattctcgtgcctctgcctcccgagtagctgggatgacaggcaaacgattctcctgcctcagcctcctgagtagctgggactataggtgctccccaccatacccagataattttttggtatttttagtagagacagggtttcaccatgttgaccaggctggtctcaaactcctaacctcagatgatctgcctacctaggcctcccaaagtactgggattacaggcgtgagccaccgtgcctgaccaattgttaccattctcttctttttttgagacggagtttcactctgtcatccaggctagagtgcagtggcgtgatctcggctcactgcaacctctgcctcccgggttcaagcgattcttctgcctcagcctccctagtagctgggattacaggcacccaccaccacgcctggctaatttttgtatttttagtagagacagggtttcactatgttggccaggctggtctcaaactcctgacctcaagcagtctgcccgcctcagccttccaaagtgctgggattacaggcatgacccatcatgcccggccaattgttaccattcttgaatatgcttccagatacttttctacatatatacaggcatatatgcacatataacatttttaaacacccaaaacatagggttctttatacattgttctatactttgcatttttccacttaacaatatatttttgaagatattacataccggcacatatggatctgcctcattcttttgcataggttgagtggctgtaatataacttatgtaataaatctattgaggaacatttgagtctaaattctgctactaaaatgaaactgttgaatattattatatatagattcatttttgcactcatatgagtatatttgtaggataaattgctaggagtgggactgttggcctaatacatttcagagttttcagatattgcaacttgtttttaaaggtaagttgtatcaacttatactcccatcaataaggcatcagagtgtgtcttcctatacctgcaccaatctaatatttcagatttttttgatctttggcattctgatcttggtctaattttaaattatatttttctaataagtgaagttgaatatattttcgtatgtttaaaaataatgtatggaaggggcattttgagtataagaagaaaggagaaaaattgatgcacacacatataaatatgtttgtgtatatgtctggaaactcgagggtggccttgcgtactatcctctgcctttttcaatattagagctgcttcctggtaggagacaagtacggggtctggagttagaggctagtggagaaagttctacatagtctacatagtgtaggagggatagaagtaatcagggacatgaaaaagattgctaggcagcactgaagcctaattgggattgaaaccatatgatcacagtgcttctaatgtaccattttgagttatccagtagtagtcaagaactttgatctagaaagtgtgaaggtcagttggtcagataaactggaattttgaaggaataatggacaccctggggtctaagtttcagaggtcaggaagtaagagatggtaatggagaaaaaatagggtggtgagactaagtgcttcagagagatggaagagatgagatttttcttccacagtttattcttattccagttcacatctcttctaccttttttgcttatcagatctgggattagagatctgggattagattggagcagcctagattctgttcctgatttttttgttttgttttgttttaatttattttttattttttattttttttttgagacggagtctcactttatcgtccaggctggagtgcagtggcatgatctcggctcactgcaacctctgcctctcaggctcaagtgatcctcccgcttcagcctcctgagtagctgggactgtaggcacacaccaccttgcctgactaatttttgtattttttgtagagatggagtttctccatgttgcccaggctggtctcaaccttgggagctcaagcaaattgcccgccttggcctcccaaagtgctgggattataggcatgatccactgcacctggccatcctttttttttgttttttgttttttttttgagacagggtctcgctgtgtcccccaggccggagtgcagtggtgtgattatagctcactgtaaccccaaactcccagcctcaggtgatcctcctgcctcagcctcccaaacaactgggattataggcacatgccaccatacccagctaattacaaacattttatttttttgtagaagatacggtctcactctgttgcctagtctagccttgagctcctaggcccaagtgatcctcctgccttggctgcccaagtactgggattacaggtgtgagccaccatacttagccctattcctgattgttgatagaccctggagtcaagcttttctccctttagcctccccctcttctcagaaggcactcacaccactctttcaggtccattacagccttggtgatctgaggaccagcagtgtcacttaggagcatgctagaaatgcagaatttcaggcttcgctctagacctgctgaatcagaagctacattttaataaaatctccaggtgattcataggaatattaaagtttgagaagcactgtcatagagtagatgttaggagtgagtataatagatgggacattgcctggactttgaattacttccaaaacttgaagtggtggtagtctctcagcttccacaggccactcctatcccccacagggaagtggtggaatacatggtccagcatttcaagcctcagatctttggtgatcgcaagcctgtgtatgatggaaagaagaacatttacactgtcacagcactgcccattggcaacgaacgggtaaggttgggagtcaggctaggcctgtgtcaggggtctggggtagaaccaagctcatgtaagcctctttggagatccagagatccttttcatcttttgtgctgagaaagtatgttttagggtgaggggtgggtaggtgctgatgtttatttagtctatcatgtgcctgtccgtgtcctaaacagattgagattagacttaaaatagacctaagggcttcctgctaggctgagaggtagttgagaggaacagaagcactgagccaaggtggctagaacctaaggggctagacttactctggattttcattatgagcccctatcaacttgaaaaacatgttctcagcaaatccatggagttgggggtcattctcgcagagcaatggcaatccttcatccctttctttcaccctcctgaaggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtattgggtgtagttagtatctgggctactagtgttggcagaactgctgtcaggggaggagggggagcacatattaaggtcccacagagtgccattaaaaaaaaaaattatttgaagccctaccacttgccaggcaaatgtgtatttatatttagatggtttaaagccctggccctgaacttcttagatatctttgggcctcatcccatctgtccctgcagggcagagagaaggtagaaacttgtacaaggtcagtcatacaactagtaaagcatcagagctggcattaaagccccggtgtcctgcctttcaggccagggctcctccgtgcccaggatgcctcacagggtgggggcctgtgcccgagggaccagttctctgcctgtccctgccaggtacacccctgtgggccgctccttcttctcaccgcctgagggctactaccacccgctggggggtgggcgcgaggtctggttcggctttcaccagtctgtgcgccctgccatgtggaagatgatgctcaacattgatggtgagtggggagagctatggagccaggggcaccccaagtccagtgaccacactcccagcctcatccctcccagctctgcaaccacactcctagtctaattcctacagccctggcacccccttcccccatcccaatgccctttaaggaagagggtataaattgctgtgcctccatgtattgtggaagacagaacctgagctgagctatctttaccctgtccccacagtctcagccactgccttttataaggcacagccagtgattgagttcatgtgtgaggtgctggacatcaggaacatagatgagcagcccaagcccctcacggactctcagcgcgttcgcttcaccaaggagatcaagggtgaggacccaacaggaggggaagggaaacagcgccactttagccctaagaggaaatccccttggggtatgctcaggggagagaccaagcctgggcacatgagcaacctattttagccctgacaagcagtgtgtgtatctcaggcctgaaggtggaagtcacccactgtggacagatgaagaggaagtaccgcgtgtgtaatgttacccgtcgccctgctagccatcagacgtaagttggcaggggtgctgagtcatactttgttggtggagaagggctgagatttaaaactatctttccctccctccctcccccactggccttgagaatgagccttggggactggccctgtttttgaagataagctgtgggaatttggcatcctttctcaaccttctctgatctgttgatactctccctaccatttttaccttcttgatctcctcgcctctttggttccttacttgagaacaagtgtgttctctgattcctgttagggttaggcaaatgttagaatctctctcaaattattctttctcttgaaaaaagaaagcgaggctcctgggctccttggggaagctgtcattgattccattcccattcttgaccttaggctatactgattattatgagtgtctactctgtgtcaggctttatgctcaacattggaaataaatgagtcagatagtgtcctgacttctgacttttgtggaacttgcctttcaaacctttggcttctctcttggagccctgtatgtcctgttttcccatgagtggcaatgctcaaagaagttggataggatgaagcaaagtctgggacttccttcctgcacatcatattggggccaaatgaaaaaggaaaaaatctgaggcttccatggttgtgggtctagagaagtgggactgaatgctgggttatgacacccccttccttcccttcttctgaacagattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtgagattgccaagtaatggctggggaataggcattgtatatacctgcatgctgatcatcagatgtctgttctttcattttgaagtttggaaaactgacattctgagaaggtatgaggtagttctcctgtgaaatagaggcctcattcttacctgctaagttgtttccttatcccccatcctactctcatgttctttcagggctgccaggcagagacaagctgaatttactgtttaataagtaattagttcgtagaggacagagattttagatacccacactcatgttctcttaatttctcttcccctgttgtttagagctgggatcctaagtgacctgaagatataagtctaccttattcttcacaaactggtgataaatactacctataatgtaaatcatgtttctccaaggattaatgtgttccttttgaaaaagttttagccccaagattgtcatacttttataagtcagtagacctttggaattctgcaactagaggaggaatagtaactaacactaagttatagaatacaaatacagaatcactgggctatattttgtttggtatatactagccaaaatattgaatgagaaactactgcctactgcttcattgtctcgtccaatgctactcaaaaagtgtggtcatgtgtaccaataggataggcattacctgagagcttgcttaaaatgcagatttcagattccacccataccgactgaatcagaatcttttttttttttgagatggagtttcgttcttgttgcccaggctggagtgcaatggcatgatgttggctcactgcaacctctgcctcccgggttcaagtgattctcctgcctcagcctcctgagtagttggaattacaggcatgcgccaccacacccagctaattttgtatttttagtagagacggggtttctccatgttggtcaggctggtctcgaactcctgacctcaggtgatctgcccaccttggcctcccaaagtgctgggattacaggtgtgagccaccgtgcccagccagaatctgtcctttaacaagatccaaagggaatgtacattaacgttggagaagcactgtactagactaccctctttttcttttttgtttttttgagacagagtctcgctggagtgcagtggcaccatctcggctcactgtaacctcctcagcctcccaggttcaagcaattctcatgcctcagcctccagtagctaggattacaggtgtgcgccaccgtgcccagataagttttttttgtatttttagtagagatggggttttgccatgttggccacactgatctcctggcctcaagtgatctgcctgcctcggcctcccaaagtgctggattacgggcatgagctgccacgcctggcctaccctcttacttttatccaacagcagaagtcagatagcccagaccaaagctctagtcttctagtgagcttctaggatttcagaactaacctgagggagttaggctgaagggagaagagatccccaaaaccaagaactctgacttggttaatagctactgatgcacatgaaggcaacatgttctctgaggtataaacagaggtctttagggacaatcttagctaagtagatagtaggtgatatttactgtaagcagagatttgttagcaaattaacattatttctatttaaacagcagtttccaaggggtataatttatgttatgacttagaccttgatttctgttgttgcttatttaacatatatttatcgagctcctactatgtgtcatatactctcaggtgctaggaacatggagattaacaagacagacaaggtcccagctgttatggagcttacattctagaagggggagatagacaataagttgataaacacgtaaagtagtttcagatggtgataagtgctataagaataataaaataggttaaggggatagaagtaagggaggaagagggtagagagctattttagttgttagggaggtcctcttttaggagacatttgagctaagtcccaaattatgacatagaatcaaccttgtaacaacctgagagaagagccttccaggcaggaggaagtacaaaggttctaaagcagaagagaatttggatctttttgagggatagacagaaggctatggtggctagaatgtattgtgtgaggggaaaagcagtaggatatgattctgcagagggtcaaataatatagcctgttgaaaccacgtggcattttattactgttttttggaaaagctttatccaggttggctgtgtggctcatacctgtaatcccagcactttgggaggtcaaggcaggaggattgcttgactgcaggtgtggtgtggtcccagctacttgggaggctgaggtggaagcattgcttgaacccagtgagctgtgattgtgccgctggattctagcctgggcaacagagggagaccctgtctcaaaaaaaaataaaaaaacagctttatcgagatataattcacataccataaaattcaccattttaaaatgattaggtagttttagtatattcacagaattgtacaacagccatcaccactatctgattccagaacatatcactcctgaaagaaagcctgtattcattagcagttatgcaccattcgttctctccccaacagcctgtagtaaccactaatttactttcagtctctgggtatacctattttggacatatcatatatgtgaaataatacaatatgtggccttttttgactggcttctgtcatttagcataatgttttcaaggtttatcctcgttccatcagatggatatgtcatattttgttaattcatttatcagttaatggacatttggattgtttctactttttgggtatcatgaataatgctgctgtgaacattgatgtacacatttttgtgtgaacataagtttttatttctctggagtatacacctaagagtgatataatatataacaatgtttaacatcttttttttttttttgagacggagtatcgctctgttacccaggctggagtgcagtggcacgatctcggctcactgcaagctccgcctcctgggttcacgccattctcctgcctcagcctccggagtagctgggaatgcaggcgccgaccaccacgcctggctaattttttgtatttttagtagagatggggtttcacggtgttagccagaatggtctcgatctcctgactcatgatccgcccgcctcagcctcccaaattgctgggattacaggcgtgagccattgcacctggccaatgtttaacatcgtgatgagctgcctgattgtttcccaaagtagctatgatattttacaatcccatcagcaaagaatgacagttgtaatttctggccaggtaggattttattctaattataatatgaatccattggaaaattttaagtagaagaacaatgtggattattgttctagtttctagttgtgaagattcaattagaaactagaagtagtgcctccagtccacctctgtgtcttccttgaatagttatgtaggtcattgagtgtccacaaaatcatttattcatgttcaaatcacagttcattccttcttccgtctttttcaaattgtggtaaaatatacataatgtaaaatttaccattttaaccatttttaagtatacagttctgtggcattaaatacattcatgcagttgtacaaccatcaccatgaccaatctccagaactttttcatcattccacactgaaactctatacccattaaatggcaactccctccttttaacccctagcaaccaccattctactttctgtctttatgaatttgaccactgtaagtacctcaaataagtggaatcatagtatttgtcctcttttgactggcatatttcacttaacacaatgtcttcaaggttcatccgtgttgtagcatgttaggattcccttcttttttaaggctgaataatagtccgttgtatgtatatatcatgttttgtttattcattcatctatccatggatacttgggttgcttcttccttttggttattgtgaataatgctgctgtgaacagagatgtaaaaatatttgttgaagttcctgttttcattttttttgagtacatacccagaagcagaattgctggtttatatggtaattctgtggttaattttttgagaaattgccataccattttatattcccactggcgttgtacaagtattctaatttcaccacatccctgatttagtcttttgctagtgttaattctgtatctttaaccacctgtagagaatgctacaactttaaggcacctttaagagagcaatctcacaaatttcaataattttggattttcattacgtgaattgactattttgtttattctctggaatatggagtttgaaggcaggtgaccttgggctggttttccttcccattgtttaccatgaactctgggaattaggacgagaactagtatgtaaagaatgttggccctatgggagcaagttcctcatttcatctcatctaaatccttacaacaaactcatgagacagctagtgtatttttttttctcatgtttgagattaaagaagaagattctcagagtggttaagagtcctgtttaaggtaacatcacctagaaatggcaaagctggacttcaaacagaagtatttccagacctactggctctctcaattctagaagcctttctgttcacagcatcctgaatatagtatattggggagtggaagtcttgtatgtcactagacagctttttatgatctctgttgttttctgttgggcccagaacagatgaagtaaatggcaggatgtttctcacaccagcagaggacactgtcagccaacagagacagtgatagctgtaggctgggggctcaggagtttagaaccaaccctagtcctggtgggttgcaggatggagcaacctgtcaccattggacagctgccttagaaatctaatttgtgtatattgagttgttcagtattcagaagagctctatatatggtcctttggtaaataataatctgtgctacaatttattgtttactgtgttccagaactatactcagtcctttaagtgctttatttaatcttgaggcaactcttagattgttactattatccttccttaaaatatgaaggtcaggcatggtggctcactcctgtaatcccagcactttgggaggcggaggtgggtggatcacctgaggtcaggagttcaagaccagcctggccaacatggcaaaaccccatctctattaaaaatacaaaattagccgggcatggtagcacatgactgtaatcccagctacttggaacgctgaggcaggagaatcgcttgaacctgggaggtgaaggttgcagtaagccgagatcgtgccattgcacttcagcctgggcaagaagagcaaaactccctctcaaaaataaacaaataaatacataagtacaaaaattagcgaggcatggtggcgggtgcctgtaatcccagctacttgggaggctaaggcaggagaattgcttaaacccgggaggcagatgtctatgagccgagattgtgccactgcactccagcctgggtaacagagcgagactctatctcaaaaaaataaataaataaataaaatatgagacctgagcccagatctggctctggatcacaagcggttgaattgcccttttttttttttttttgagacagggtctcactctgtcacccaggctggcgttcagtggcgtgatctgggctcactgcaacctccgcctcccggttcaagcgattcttgttcctcagcctcctgagtagctgggattacaggcgcacgccaccatgcctggctaatttttgtatttttagtagagactgggttggccaggctggtcttgaactcctgacctcaagtgatctggccgccttggcctcctaaggtgctgggattgcaggcatgagccaccatgcccggcctgaatcgccttttacaatgcacacgaatattttctaatttacctatcaaatgatactcaggaggagaatacatgtatgcacaacggattttgcagttcccttccccatggctgacagccaaggtatctttccttattgtggggctctgggtacagggtggactgtactcaagccagagctacctgtccttcttgtttcctcaggtctgtaacattgtggctgggcagcgctgtattaaaaagctgaccgacaaccagacctcgaccatgataaaggccacagctagatccgctccagacagacaggaggagatcagtcgcctggtcagtgggcctactcatttgctcagtcattggggccattggtagcataaatgttttaatgccccagcaggaccttccttcaggagaacccaagtctagatttgttgcctaggactgtataaggctgcttttgcttcttgaccgtatagctactttgctttctgtctctttttctctcctgtattactttgctgtgttattccctcacttccctcatcttccactttctctctctttttaggactattccgtaccaaccccagcttctccttagggttctctccttgatacccagagggtgagcagtattgccaagctcctgttctcctgagattgctctcttttgtcctgcagatgaagaatgccagctacaacttagatccctacatccaggaatttgggatcaaagtgaaggatgacatgacggaggtgacagggcgagtgctgccggcgcccatcttgcagtacggcggccgggtgagcagggtcagggccagacaacatctcggggcatatgggggtggttgggttgtatagccaggggcttttgctcccctacccacctgactctactgaggctcacctaggcgccccctctacctatccccagaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagtaaggagggttcgctgtaggggtggaagggtgggaaggaccctggagctgcctgccttcctgtagtccacaggggctgatattgatcagtaatgtgttctgtcttgactctgcctgcattgtgctttctggctcaaacttctaccaattctttttctatccatctgtgatcaggggaagttaataaggagccatatctatgtcaaagatgatgattttagggcatgaatctcctgagagaggcctgaattattgttataattattatcattggtaataaatagtagtagtgatgactgtaatgtttacgccaaaattatacttaagtacctaatttatattctcttatttcatctttacagtgagtaggtggtgatatgtccattttcaggagactgaggctcaaaagaggttaagtaacttgtccaaagtttgcacatcatcaggaaagtgtcagagttggaagcaaatcagatctgagcttcaagacttgtgttcctaattggaaacaaaatagagcagcttgtttagctggttgtcagggcctctgtgccaccgtagctgggagtagatggcaccaatgaggaaagtgttatagccaaatggtttaaagaaaccaggcagtaatggcttaagaagtcaacaacccctcacctggagtcttttttttttttttttttttttttaagacagagtcttgctctgtcacccatgctggagtgcagtggcacgatcttggctcactgcaagctccacctcccgggtttcacgccattctcctgcctcagcctcccgagtagctgggaccacaggcgcccgccaccacgcccagctaattttttgtatttttagtagagatggggtttcagtgtgttagccaggatgatctcgatttcctgacctcgtgatcctcctgcttcggtctcccaaagtgctgggattataggcatgagccactgtgcccggcctttttttttttttaagttttattgagataggtttaaaatgccacaaaactcagttagttgtttcatagatacaacatacagttagttggttactgccatctttcgaagtggttgcttttcatattctctgaatctggagtggggtcaatgcactctagggatgaggaggagttgatggagccgaccattttggctagacaagggtagtggggaagtatgccatgacgaattcagctgaccttggagtcatcatgagaattcgttcttagctggggtgcagtggtgcgtgcctgtagtcctggctactcaggaggctgaggcaggaggatcacttgagcccaggagttttctgggcaatatagatcctataagttctaggctgggcatggtggctcctgcctgtaaacccagcactttgggaggctgaggcgggcggatcacaaggtcagtagtttgagaccagcctggccaatatggtgaaactccgtctctactaaaaatacaaaaattagccgggcgtggtggcgcgtgcctgtagtcccagctgctcaggaggctaaggcaggagaatcgcttgaacccgggaggcagaggttgcagtgagctaaggttgtgccactgccctccaacgtggtaacaaagcgagactccatctcaaaaaaaaaaaaagttctaacagctcctgatggatctggagactatgggacctgcccttgctcttcttcccttacccctcacagatacacaaacaccatcataattgtagttcttgcaaatgggttcttgtctcctttcctgagctctttttttttttttttttttttgaggcggagtctctctctgtcgtccaggtgcagtggcgccatctcggctcactgcaagctccgccttccgggttcacgccagtctcctgcctcagcctcccaagcagctgggaccacaggcacccgccaccacgcctggccaattttttgtatttttagtagagatggggtttcaccatgttaaccaggatggtctcgatctcctgacctcatgatccacccgcctcggccttccaaagtactgggatcacaggcgtgagccatcgtgcctggcctttttctgagttctttagcccccatttaagccaggctgcttggcaacattggaaaggctcccagctttttgcctttgtgccatagtcacttcattgtagttctattctctatgtgctcttgtctttctcccatgtccttcccttgtccatttcttttgggatgatctattgttttggccatttggggtatgggcaccagtaaacccagaaactcaaacttggaagagtttatcagtgacacctagttgtaaggggtaagaatgtggcttatgcatctgggtcagtagtagccagttaaatctgtggttctgactgggctaaaggtaaatatttccaagtcatctatagcagtggctgagattgtccagggagaatgtacatagtaagcagagattgaagatataactcagagaaactggaaaataaatagagcaaagtccctaagtgtggatgaggtgatgggatccagggcactgagaaagggcatcctttccactgagaaagtgggggaaaacatgaaggtgctatggggtttgacaaactagtagttgggggatgatggatgagagagttctagacgcaaccctcaatttttttctggctaaagaggccctattactttagctatatcacctttaagatgggattttaggaccttcctcatcttaaacatctcacaatactttgtggcccccagcattggacacagtattccaagtgtagtctggtagtagagagaagattggaaataacgtctttccttgaagttgagacccactattcatgaaatctggtaacatactggctttttaatagctacattgcagttgtatacagggcagagaaatggaaaacatactattaatggtcaaagccctagctgttatttacatgaaacagtggttaggtcgtgtttttttattctaacattcattttgaaaaatttttttaagataataaatgtagagaataacatgtatccatttttgtcatatttactttatccttttttaaatgtaaatattacagataaatttgatgctccttcatgtcctccaccctagtcccattcctcccttctttttttgacagcctcgctcttgcccaggctggagtgcagtggcgcaatctcggctcactgcagcctctgcctcctgtttcatgtgattctcctgcctcagcctcctgagtagctgggattacaggcactcaccaccatgcccggctaggttttttttgtatttttagtagagacagggtttcatcaggttggccaggctggtctcgaagtcctggcctcaagtgatccgcccaccctggcctcccaaagtgctgagattacaggtgtgagccactgcaccagccctattcctcccttctgatgaggccactgttatgaattattgtaaccaggctactcaatttatatacctatatataaatgattttaaattttgcataatagtatcagactgtttcttttcttgtgtgtttttactaaatatgtgaaaaaatactttctcataaaactatcacattgctttttgtatgctatataataataacatctcctaaacagctgcttccattctcttcttgtacattgtttttaaatttaaatggaagattatcacaaattaaatttcctgctgcttatttcagtttttgagtatctttatgtagcttgatttttttactctactgcatgtgtgtcctctcttgcaactttgtcttcctttccagggtaaagccctaaagccaaaggaagcttaataattggctcttaggtttcaaagaaccagttgggaaggagggaactcatttttactgagcatctcttgtgctcccatcactgttggaacctcatttgctttgagcagaaaggccttacacgtgggcatctgcctatttctttggacatgtaatgaagcacaggaatcagctgcttgagcggggcaaggtgggaaccctgagaattcccatgggtcccttttctgggcttcctcgtctccttgcttgtaccatcgaacacttagcaagtactctcttaccttactcaactataaacatattttttacattagctattattgtgtatcattcatgttagaatctcagtgttagctgggtgcggtggctcatgcctgtaattccagcactttgggaggctgaggtgggaggatcacttgagtccaggaacttgagaccagcttgggcaacatagtgagatcccatctctaccaaaaagaaaaaaaattagccaggcatggtggcattcctctagtcctacctactcaggaggctgagatgggatgattgttttagcctagcagctcgaggcttgagtgagcccagattgtgccattgtactccatcctggttgacagagcaccctgtctcaaggaaaaaaaaaaaaaaaaaccaatctctcagtgcctcttatagtgctaagcacctaagatggatggatttttgtcagaagaattcaagtgagactcactgcctcctttgtgaccatgcgtgtgtacaggaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatggtacagttctcttgggacagtgataatggtgataggactcttctcagcgtagttccctggggtctcctgggaaggactcagtctggattcttggctttgaccagagctgttacttaatgtcagtgctcctcttataggagaaatagcatgcctgagccattgagttatcccagatcctaattacctgcacacactccttcccagcaacatttactggggtcctttgtgtgctggtcctcatgccaggctatgctgggccaggtacagagacgggttggtctagattcctgtccttaggagtgcgttcctgtcctcaggagtgcattgtttatctgaacatcgtgcagcacaaccaagcagaataggtggtcctgttagtatcgtgttgcctggtaattacttggactttttgagaggcttgctatctctcctcttttcctctcattttttagaataagaatgattatataaatttctgtcacagcacttttcttttatgccattttccgtctccatctctcctgcttcaaagcaataagagtttttcttaccttgttcaactaactcctctgtgctcttattcccaacccatcctgctacctttgggactttatacctttcaaccctcaaatatattcagatcccccatcctaatgcacattaccacaatcttaccatctcttttagcttttgtcttcctatttccttcattaaaccttctgaggcctggtacagtggttcacacctgtaatcccagcactttggaatgccaaggtgggaggatcgcttgtgcccagaaattcgaggctagtctgggcaacaaagcaagacctcatctctacaaaaaaataaagttacccagtcatcttgtgcacctgtggtcccagctacttgggagtctgaggctaaaggatttcttgagcccaagaggttgaggctgcagttacccagcttgggtaacatagtgagaccttgtctcaaaacaaaacaaaaaaaactttttgaatgagttctctatattctctatgccctatacctcaccagccacttattctttagcctctttcagccaccttgccttctgtctacctttctcctaaatctcctctgcacaggattgccaatgacttttctcagttgtcctcttgacttctggatattttcttctatctctccttattatttttgtcattaccaggaatccttggtattctacaggttcctattgtctgccttctcattctgcctttacattttattaaaattcccattcatttcagttgcttcaatcatcacctattgctattatatgtgattaaaatcttgattcaatccttgaaccctctgcagctttggtctgtccctttggcctctctccctctcttcaagagtttattgatcacctattatgtatggaacactgtccaacatctggatatattgatgaataaaacagatatagtctctgctcttagaaagtgttttgttggaccatctcttcagtagtttgtcctctctacaaacctttgtctttactacttctgtatttgacatcacagttgcttctaagtaccttcattcaaacttcggagacagtcttgtcttttcgcttcaccttcattgttcttcttcaaatttttctcaagataatatgccctgctcttgatccacacttctcaactgagttctaaccttccttttttttttttttttttttgagacggagtcttgctctgttgcccaggctggagtgcagtggcgtgatctcagctcaccgcaacctccacctcccaggttcaagtgattctcgtgcctcagccttgaaagtagctgggattacggtgcgcactaccatgcctcgctaatttttatatttttagtacagatggagtttcgccatgttggccaggctggtctcaaactcctgacctcaagtgatctgcccgcctcggcctcccaaagtgctgggattacaggcatgagccactgtgccctgccttaagactttcttgaatgggttccaagaaagacttcttgtgactctaatatcaaaaaaaccttcattgattcctattattcactgcatgaagggttttcatggacctgattttagtttaatgttttcagctttatcttgcactgttcacttgccactcatactggaatgattgctggttctggaattgttgaagagagctgaatttgaatttaatcctggctataccagtcaactggcttggacacatatctaacctttctaagcatcatgaattaattatataaaaagcagaatctagcacagtgcctggcatgtagctgacactctgagtgctcatttcttgtctgtggttttcagtctctggtgttgtacacatcatttgcctttgcccggagtatctgcatcctcttcttcttgtcccccaccttgcacttaaaattctctccatcctttaatacccagtttaaatactacttattttttattcttgacatttcacctggagagtgaacttgtctttttctggattcctctagtttatcaggccactgatcagttactaccttacttgatactttgttgtggagtggatctgattctgctctgaaatctttcctctctatatacacacctaaggtaatgcctttcactgatacaatactcagtaattaacttatggagagaagttgtttgatcttcagtccttgtctttcttggacccttgtatggataaggatgctttttaggagaacttccttgaataagtattcatgtttctgatttccctccattaaagggaaaatccaatgttttggcttgggaatggtacagcatgcttcggaaaggcagtacttactcagaattttccctttcctgggctcaattatgttacacttctctctagcctcaaatattttattgggacttcgagtttctttcatttacatgcggttccttgattataccacctggacaatctgactggtactcttttctgctggcttagttcctaggcaatggagtcatttgcctaggaactaagccagcagaaaagagtaccagtcagattcttctaaagacccttcaccatccctcctgggaggctgggtaaaatggcatcctcctagtgatggtcaaagcaaggtcccattggcttttggttgccctgagagcgtagaaggacagtgtcacatttgccctgttctgatcaggtactatacctatcttgtctttagtatatttaattgcttcctctccactaaactgatattattgtttttttaatgtaaactttttattaaattgtatatatagaaatcttacatgtttagctcagtgatatttcataaagtgtcacagcgtaaccagcacccagttcagcagcagaaccttaccacagccccagtcactacaacctcctaccagtggtaaccactattctggcttctaataccataagttagttttgcctatatttaaactttatataaatagaatcatatagtatatactttttttgtttctgacttctttcatgcaacataaagttgtggtttgttatagtttttccatcatatgaatataacaccatttccatctatccattctgttaatacacatatttggattgtttccagtttttgactgttgaaaataatgcttcaggctgggtgcagtgactcgtgcctgtaaacctagcactttgggaggccaaggcaagtggatcacctgagttgaggagtttgataccagcctggccaacatggtgaaacccagtctctactaaaaatacaaaaaattagccaggtgtggtggcgggcgcctgtaatcccagctactcgggaggctgaggccggagaattgcttgaacccaggagatggaggttgcagtgagccaagatcgtgccactgcactccagcctgggcaacagaggaagactctgtctcaaaagaaaaaaaaaataataataatgcttcagtgaacactcttctttgtgtcctttgaacatgtataaccatttttcttgggagtatatctaggagtggattttaagtataccaatttatcctttcaccagcagtgtataagagtgctagatagttcatatccttatcaaacttggtatccgtctcaagaaaaagaaaaatgaaaaagaatcccagggtcatgaagatactatttgaagtgtttttttgaatgattttaaaaaatcattcatatttagaattaatttatctctaaacagagcaaaaactgttgcttttcttttccatggcagtggtgcagagcttagactcttagcttcctacccacacctagattcaacaaatgtacccagggtaaaagcaactgcagaagatagctcacctctgagatttttttttttctccctctctggaattttaccccctctagttcttgttttcttagcattctctgctgcctttaaaaagatgatttttatattttatctggcttttctgagtgttgtctgtagaactggcttgccgctattccatctctcttggaagtagatatgatctttttaaacatgctcaaatctcttccattgaaagcataccaaattcttggtcagtcctacattttcttcctggtaccttaaatcaccacaacaatttttgcctctatacactaatttttttttaatcttaatatcactaactccagaggacatttctggtcctgattttacctcatctcttagacacatttcactttgttgaccacttgctccttcttgaaacactctctttcttcccttggcactcgtgatacaacactatcttagtcttccttctagctttctggatttttttgtcctttgctgactcatcttcttgttctgccaatactgggagttcctcaagattcagatctaggttgtcttctctttttactatgttatcttccttagtgatctcaagatcatgccttcggccgggcgcggtggctcacgcgtgtaatcccagcactttgggaggccgaggcaggcggatcatgaggtcaggagatcgagaccatcctggctaacatggtgaaaccccatctctactaaaaacatacaaaaaattaaccggacatggtggcgggcacctgtagtcccagctactcaggaggctgaggcaggagaatggtgtgaacccgggaggcggagcttgcagtgagccgagatcgtgccactgcactccagcctgggagacagagcgagactctgtctcagaaaaaaaaaaaaaaaaaaaaaaagcatgccttcaactactacctgtacctaattatcacacaaatttgcatctccatttcagactactcttttgagcatcgaaccatgaggcccatttgcttagttgatatcctcactgagatgaccaaaaaactacttcagactcaaaatgtctcacaaataatttatggcctatttttattttattttatttttttatttatttttctgagacggagtcttgctctgtcacccaggctgtagtgcagtgggtgtgatctcgtctcactgtaacctctgcctcccaggttcaagtgattctcctgcctcagcctcccaagtagctgggattacaggcacatgccaccacacccagctaatttttgtatttttagtagatacggggtttcaccatgttggccaggctgttcttgaactcctgacctcgtgatccacccacctgagcctcccaaagtgctgggattacaggcgtaagccaccgtgcccggctggcctatttttattacagaagctggaaacttaaaagttatccataaaaattttcttttcccttactcacacatgtagtctataacttgagtcccttaaatatctgtggaatccatttgtttttctccgtctcaacaactcacccatctttttttttttttcttctggatatggagtctcactctgtcgcccaggctggagtgcagtggcacaatctcggctcactacaagctccacctcccgggttcacgccattctcctgcctcagcctcccaagtagctgggactacaggcgcccgccaccatgcctggctaattttttgtatttttagtagagatggggtttcaccatgttaaccaggatgatctcaatctcctgacctcatgatccacccgcctcggcctcccaaagtgctgggattacaggcgtgagccaccgcgcctggcgttcaccggtcttgttaatctaggctacccttatctcctctggtaggtcagtctaatgaccacattctttccttacaacatgctccccttgctcttctttttagctgctatggcctttctgtttctcaaacacatcttgctgtcttctagcagggtgcatttttgcatgttgttccctctgcctggaatgctctctctcaaactccccctctcctctaagtcctttgctgtcatcagatttcatttcaatcattacctactcaagaatcctttcctgactaggtttttatttcccattttatgctgttattgttccatgaagttttctgttgtgtcatttatcagcgttgtaattttcacgatttttaaaattagtccctatttagtaagcactttgagagtaaggaccttatgtgtttcctgtcattattgtgttccctagcacctcatacactgcctggcatctagtaggcattcagtaaatatttgttgaatgcactaatcatttctctccctgcccttagctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcggtatgaactctgttgtccacttgcccttgtcaaggtaccatgctgggaattgatgaagagataggaccctggccaggcagactgaatcagacataagggggagaagagcagagtgggtactggatggtgccagctagagaagacccagcgcctcaccattttgttttctcttccttgctcagctctgccgtttttcaacagccagtgatattcctgggagcagatgttacacaccccccagcaggggatgggaaaaaaccttctatcacagcagtgagtgatattctgtagctgcctcataaggttctcctcttcgctctgagtcctcaaaactgcccatgatttccttccctcagctctggctcttgagccttcataagatgtccatttagctcgctattcccaattcccattcccttgatatctcataaaggtagctctgtatggtgtcttttttcagggagagtaatgagagtgtagccagagacttgactcattctgcatcactcttgctctgcatttgaatgtctctctttccccatgcctgcttttgggatgtaggggagggactatatcttctctgaaatccctttaaagggagttacttagttgcgaggactatcctttgctctgcccatcctcaccccgatctgtataatagattagatgtttctcttatctctctcctgacttttctgctctttgtctcttaggggcttccaaattgctagggattagaccttctttcccacttatatttcctaaaccctcacatttctgtaagcacactggtcttaacctcagtaagtgcagggaaaccctataatatgcttatccctgttttccttgtggccatccctcctaggctttggctgctgtctcctttgtaaatggcatttcttccatcaaccacaagaacactgttactatggtcatgattcctgggtagattagcatttgaatgggaaaaaggataaacttgggactggatgaggccattgtttgatttagtagtgctaaaccttcacatgctcctctgcaaaggggagagaaatcagtttatcaagtacctactgtgggctacgtcctgtgtaaggtgcttaatatggaccccagtagcgctgcaagcaggtgttcttatcaccatctgagaagaggaaaaaagatcagagagattgagtaacttctgcttgtgtgatagaatagagattgaaaccagggctcactgagtctcaagccctagtcattcagttgtagttttcttgctaagaagcctttccacaaacccatagcctgacagtgaaggtgaaggttctaggagctaatcctttctctctgactgtcaggtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccaggtagggcccacagtaggtggagaaaaccttcacatcatggctggaaagctaggtgctactaccttttctaagctattggcactgagaggtgtgtcacttcttagtgagctttgctaaatggagtagacttgggggcaaggatcgcaactgagggatggagtgtacaagcatctgtagatttttcttctcataatagaagaccctcactgcctatttaagtagttggttcatgttggagactgattgtttagaccagtgattctcaaatgctagcttacattaagatcgcctggagggcttgttaaaacagttttaagggctctacccttagagtttctgattcagtgagtcttggatgagggccaagaatttacaatactgacaagttcttaggcgatgctgatagtctggagactacatttgaggactaatgctgttgaccctccttcataatattcctcctattcattctcactgccagccttcattttttttttttaacttctatcctgaactggtatccttgactaccatttaatagtattataactactgttccaatgaacttcctatgtgccatgaactgtcctaagcacttcactttcttttttttttccctaaatctgagtggaaacatatgttctatttaatgctttacaatagtcctttggaataatagtgtatttccatttaacagatgagaaaacaggcttggaaatgttacatgatctttaatgtcatcaaagataattaggagtggaaccgggattcagacacattggtctgattccatagtttatgctcttaactgttatgcccagtttctttttttcttttttttggggggaacagagtctcgctcttgcccagggtggagcgcagtggtgtgatcttagctcactgcagcttctgcctcccgggctcaagcgattctctttcctcagcctcccaagtagctggggctataggtatgagtcaccacacccagcttatttttgtatttttagtagagatggggtttcactatgtcggccaggctggtctcaaactcctgacctcaaatgatccacccgccttggcctcccaaagtgctggaaatacaggcgtgagccaccgtgcccggccattatgcccaatttctaagtcatccagtattttctaaaataacagacacatttatcatatcacatatctgttcagaaatgtctagtggcttcacatagctttgagttaaaattcaaactgcttagcaaagcaatcagtagttattaagccctactaggttttctatgcttttacttaattgtctatcgtagtcttcttaatagctttgtgaagcaggtcttagtaacattaacagacgtggagaaaatgagacttagtggagttgaataacttgcctgatgtaatacaactagataaagcttggatttaaatctaattgattccaaagtctatccttctctaccatacagttttgaccctctgtatctgacatccacggccacaggcaactattgcctatgattatttacttctagcttttcccttagctagcctgttttcttataatcctgctgctttgcaggactgaattcacctactctctctgcacccattatggaactatatgtctgctcttctctggtggtccacaacctgtctgctcttggagcccaaaggagaactctcattagtcacctgatcctgtgtgaaactaactttgggcattgtgattttagtgatttctctgtgaaccttggttctgtgtcttggtattaggtctctttatacacaggaaccagatgagtgttgtcttctgatgccaagcctcctggccaaggttttataggagcatattaagtgaactgagcataaggctgcttttgacaagaagggcctgtcatctctaattgttgagcatcagcatataaagggagactgagccaaaagttatattacaagtggcaactccttagttcagaagggtatgtgaactcaagaggaactgtgtatttctttgtttccctccccatttttttgtgcctagatactccactatgagctactggccattcgtgatgcctgcatcaaactggaaaaggactaccagcctgggatcacttatattgtggtgcagaaacgccatcacacccgccttttctgtgctgacaagaatgagcgagtgagtgagggactgaggcctcccatcccctccttctgtctcccttatcttaatagagaagaagcccttgagataaaggctggggatttagtccttgtcctatctatcctccctggccccttccctcctcctagctcttgtggtccttcctctgccaccgccttcactagtgtccacctcctcccgtccttcccttatacttcctttccctcctcctagctccctggcctagaccccatatatagaccagctcctagagaaggggaagggaactaccatttattgaactcctcctatgtgccagatactgtacaaggcgtcttcctcacagcaaccctgtgaggtacgtattattattatctccaatttaacctcagaaaggttaaacgacttgctaagatcacacagctaataggacttgaacacaggtctgtgtgactttagaagcatattattttaagattcagtaccctcagggaatagcaactttggctttgttcttgggattttggtgaaatcagagtagaattgagccagggtcctggttagggccaggcaggtcttgggatcttggttgtgtttgtctctatacagattgggaagagtggtaacatcccagctgggaccacagtggacaccaacatcacccacccatttgagtttgacttctatctgtgcagccacgcaggcatccaggtagctgggctttatcttgtggttccaatgggtcaaagatgagttgttcattcatattgcctctagaatgtatcagtcatcactgaatgacatccaaattaggattgctctcttttctgtttgttctgttttgttttgttttgaggcggagtctcactctgtcccccaggctggagtgcagtggcacaatttcagctaactgcaacctccaccttctgggtttaagcagtcttcctgccttcccgcctcagcctcccaagtagctgggattacaagcatgcgccaccatgcccagctaatttttgtatttttagtagagacagggtttcaccattttggccctgctgttcttgaactcctgacctcaagtgatccacccaccttggcctcccaaagtgctgggattacaggcatgagccactgtgcccggccaggactgctgtcgtaataagccctgagtacacttgcaggttgcttataagaagagtgctttatgacattggtagttttgcatctgcctgttcatgggtgaattatctacccagccatattcttaacagtgatcctgttcccctattatcagccatcttctctgcccagcctgggacccctcaccttcctatcttcccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacaggtgaggcctgggatcaggttggcctcctttttgcttcagcctattgtgccagatcttcttaactttccttgggtagaaggaaatgagtgctgtccaatttggtgtcattgggctcgtctgcccaatcctgggttgggtttctctcttaagttggtatgggaattggcatcccagggctgggcgagggaattagcagcagctctcagttcaccaggaaggacttctttcattttttccttttcagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttctatttctaaagtgcggtctttctctttttttttcctaccagcaaaacaaacttttgggactgattacatctctaatagattttaggtgagaataatactgtagattgttatgcaggaatacttcacagagccttcatttattcttcattcaacaaacatgcaaagcactgtgccagcagtattgtggggaggggaggcacaattcaaaatgaggaaaatagtgtccgtctcattaagggaattaagtttggtgggggatatgattagccaaatagtcccctggcataggaggaagataatgagggagtggaataaggctacaacaacgaatatagggaggaagggacagatttgagagacgaggtagaattaataggactcgatggctggtgggaggagaagacaggagtagaggttagctcccaggtttctccttgaccataggagtgtgttgggacattctgccagtcaagatgggggtgacggggagactgtagaaggaaggtggggagtttttgaagaaacagaatgttgtatagactgagttttgaggtgtttgtggggcagtaagggtaaggtgtccagtaaacacaggttggtgctcaggtaagactgtaaaactgcatttatagatacaggagtcttatagatggtagttaaagccataggcatgaatgagatagcttagaaaaagagaagagaaactagtatacagccccctaagaaactcaatttaaaggttcgggggaggaagcagatcttaaggtgacagatcactggtagacagtttgtgggttttttgtttctttgtttagccagtttggtgaggtaggagaagaaatcagagtagaagaaggttcatgaagggagtgattaacaacatgaactgctgcagagagggagttctttttttttctgtgtgttttacctttctactccccatcttttggggatcttgtaactctatgacttacttacgttattctccagtatttcttgaaaatgagcattggaaaaaccaattctaaaatggctaaaactaggactttcaagttcaccacaactaccaccaattaggagataattgtaaaagaataaacaaaacctaattttgttcctagccaatattataaaccatgttccagcatactagataatagtagcatactatatttatttccataatttgtcttctttagagcctatgaactcctaggagcagaagctatattctcttcatttttgtcatctcagggtcatggcatataccaacagatcagtatgtgcaaatataattgaaataggctagtagtctgtggtttatgagtatgggctgggtgggcagtggatcaagaagtgataggagtacacaggatgaactcagaattcctgaatcttcaggtaagcagatacttaactacattatcattgtcttttcccactcaccccaagttggaggttctatggttttgtactttaagctggtggtataattgtcaagcatgtaaattctggcattcttcctggtactgctagagcattgttatttctatgcatgggggtaagaaggctcagagaaggatcctggcggataccccagtgagaaatcgtcagtggcagccagtgtgtacatacgtggacctagcattcctctggaggccaagtgttgtaaattggcctgtggctatcatctggcagactcccttgggaaagagccagccagccccatgcttcttttcagcagcaagggttagggaggttggttgaacttgaagagcagattggacatggagcagattttgaccagttgaaataagacataaatttatgactccgagtgaggcagaaataaagaacttagcagggggaataggaggaggatgattatggcaaattttgctataaactttagttttagaaaagattgatattgaaaagccttcaggatttgcctgtggttgctactcaagttaaaaagactgggagcctgcattgtttggtcctggagc

SEQ ID NO: 12691 - DNA, 25160 bp, Human
caggagtttgagaccagcctggccaacatggtgaaactgctgttgctactaaaaatacaaaaattagccaggtgtgggggcacgtgcctgtaatcccaaatttgggaggctgaggcagtagaactgcttaaacccaggagtcagaggtttcagcgagcagagatagtgccactatactccagcctgggtgacagaacaagactctgtctcaaaaaaaaaaaaagagtttgagaacatagggggacaaaaaaatttaaaaatttgccaggcatggtggcatgtgcctgtggtcccagctactcaggaggctgaggtgcaaggatcacttgagccaggaggttgtggctatagtaagccatgatcatgccactgcactccagcctgggcgacagagtgagacttcgtttcaaaaaaaaaagtcagaacagagaccaattgaatagaaagtaaaaaaaaattaatgaaaccaaaattaattaatgaaatttaatgaaaattaacgagactataaagctggttgagatcaatattcagtgcctcctggatcaggccctgcttgcatcactgggcatacagcagtaaacacaacagacaaaaaacccagtacaatccctcatctgggcctttgcaactgcagttccttctccttgaaatgctcttatcttgtttatctattgcctcattttcctgctttatttttctccaaagtacttaactacctctgactttatttccttttcttactttctatgtttctttctttctgcgtgtctttctttgtttcttcctgtctttccatttctttccttccttgcggtcttatcaatctgtttatttagctccactaaaatgtatgctccacaagggcttaagtttttgtttgttttcttcactgcctttatcactagcacctaaacggagcctggaacgtggtaatgtgtaaagaatatttgtttaacagatgaatccttggtctcatggagctaacattcttttttttaattttcctatttttttactttaattaggaattcaacatagaagagcttacattctctctctttgaatttaagatttgaagaacactgctcagaagacaggatcttagagtcagggaccaagtattaatttcggaaatcaaactctagggctcaaatcgggaactaagaatcaaagatcatatttggaggttagaagtcaggagaagccacagttctaacagaagtctcaggactggagtcaggtttgggtatcagtggatacaatgtggattccaggagctgagaatcatagttcaagaaaagaaggtaagaaatgattgggttaggatcatagctagatagaagattggttttgttaaaagttaggactcgggggttagaggtcaggaagttcagcatcggaagtcagatttaggagtatgaggttaggaagcctcagggatcagagattaatgaggaatgtgacgccgggtcctagggctccgtttggcagcctaaggttcactcacgtgtccccatcctcagtgacgtagccgaagacgaggggagcccacgacagccccgggcccaactccgcgcccaacccaggtcctccgggggccgctgcgtccggacccagggagcccaggccgctgtcgcaccattcatctgcgtcggcagcttttcccaagcacgcgaccccagccatggcccccgccgcctcaggggccccccgcagtcgcccgcctgtagctgggctttgccgggagttctggagcttccgccctgcgggaaattccccaccacgccccctgattcacccaatgataatatgctgaatcgctcacaccccgccctcgtactgcatcctgaccaatcagagtattcgggaggactacaactctctagccgttcccacattttccgggcgccctttaccaacatggctgctgacgccacgccttctgggactcgtagtccggtcctcgcgcgctttcttacctaactggggcgctctgggtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgtgagtcggggatccgggtaggagggtcgggccgcgccggggcctggctgaatgctgcaggccccggggcccaagggtggccgcggtggggcgggaagtagggagcgcttcggggagtgggattctgagggctgttgcttagcgatctgtatcgctaggctggtgggtttctgggtcgcagtgtgttcagggttcgtttaccacatccacttgccaagttgccaatgatcgcgtgtttctcgcaccttggttgctaaggtccctcgctgcaaagaacataagttgccccggtcccgcttgctatgggtacctgattgttagaggcaaccagaggatgctgagggacccctgctgacccctcctatggcttccccttgttccgcgcctctcctaaacctaccgcctccactgcaccactgcacctccctcctaaacctgcctcccagccaaagcgtctcttcccttctcttttcctttctaaacttccctctgccttgtaaatctaaccctccccgcacacacactcacacactgtcgtgtccttcctaactcctcctgagtgttccttcatgccctgaatcccctaggtaggaggaggaggatcgcttgagcccaggaatttgaggctgcagtgagctatgatcgcactattgcactccaacctgggtgacatgagcgagaccctttctctaaaaagtaaaaaagaaagaaagtaagtcagggccagaaacaatggctcatgcttgtaatcccagtactttgggaggccaaggtggttggatcgcttgagcccaggagttcaagaccagcctgggcaaaagcccctactttctccctgtccccctaaatcttcctctccagcctctctgcccctcactaatcacctctcccggcatcactttgcatgtagataagatcttttctccgtcccctccctccctctgctccatttttaccaccatcccatcccagtgtaactaggttggtgggtgttcttgccccctcactgaccatttgaacccctttattccccccttaatcgttctccccactgtaaccacctctgctcccctcccccagcctctcaccctctggagacccaggcagggaaggtgcaggaggctcaggtgagatgggggaaagggtggaggggaggagagagacggacttgttccacatcccacactggggggaggtggcaaaggggaaacagtcaccccagggccctcggctcattgccccaatccctcacaccacccagtgcagctttctggggaaaggcagattctggggattgtcagagaagagtttccagcctcaagtccaggcctgtcctcccaaactttccttcttccttgccactgcctgccatcccttctgaaccacatttgtcctgggactggaagagacaggtatcccatttggtcttggaacgcacagatctcgtggacaagtgatgggaaaaaatgatctcacagcgtgatgacgaaagtaactcagggggccagatgcagtggcttatgcctgtaattccaataactcaggagactgaggcgcgaggatcgcttgagcccaggagtttgaggctgcagtgagctatgattgcatcactgcactccagccggggtgaaagagcaagaccctttctctaaaaagtaaaaaagaaagaaagtaactcagggccagacacagtggctcatgcttgtaatcccagtactttgggaggctgaggtaggaggatcgcttgagcccaggagttccagaccagtcttggcaacatagggaggcccccacctctacaaaatatttaaaaattagccatgtgtagtggtgcatgcctgcattgccagctactcaggaggctgagttgggggaggattgcttaagcccaggaggttaaggccgtagtgtgccttgactgtgccactgcaccccaaccggggcgacagagcaaaacacggtctcaaaaaaaaaaaaaggaagaaaagtaaagaaactcagggtactgtgggagcacagagaaaattttctgggtcaaagaagattctagccaggccattccctggaggaatccacaggctggtctagctgtcagaccaagatacagacacagcataagtgaagagtgacttagaattttcttagacaaggtgagaaatggtgatccacacaacaggtatcgcttgtgcaaagacctggggggcatgaaggggtgtgatgtgttccataattgggtggctggtggtggtcagcttgttatagtcgtggttagcatttactgacggcttactaaagctgggcccactgtttagtgccaaacgtgcctcatctcaatttcatcttcctggcatccctgtgaagagaaacgcctatcacggccattttacagatgcagaatctgaggcagagttgttaagtcacttatcccctgtccctcggctacaggagcagggaagggtttgagtcccccagcactgggcacgccacctgtcagaggctgccaggagaggtggacaggcagtctcataggagcttgaaggcccccgtcagcacctccggctctcccttaggccaagctgcagacacatgctgggcacaggccttccacacagcctcactgtgtacagcctgaaagagtgccagcccacccacacccctgagattgcctttcagacgtggggtggtgcagaagcgggcatcagaatacctcacaaatgcacagtggagctttgctaaggatataagagcctcctgttaggctgtggcaactcactcgcctggctcccaaagcacgaccactgtcagagaaaaaggttgaatgttaaaaaggatcctcagtcccaaagagagagaggcgaggatgtaaaatgcagcattgtccgtcacagggcaaaactggaaacagtccaaatggctgtcagtggatgggttaaatgaactatggttcatccatacaatccaatactatgtagctgctctgaaaaacgaggtgaggccgggcacggtggctcacacctgtaatcccagcactttgggaggcagggggatcacttgagcccaggagttttgagaccagcctgggcaacatagcaagatgccgtctcttttttaaaaaattattttttaaattaggtgggtctgtagcatattgttctgccgaaaactcaagatgttgtattgtactatgacctatttctgtaaaaaatattagttttatgcagagaaaactggagtaatttccattaagcttagctaacagtggttatctttataagggtgggcttgggcaattacaaggtgagtgccgcaagttatatgttgttgaagtatacatgagtataatcaaggtttttgcagaggttgtccaatctctctttctctctgtctctctctctctctcattctcactctctctttctctctctctttttttttgagacggagtctcgctctgtcacccaggctggagtgcagtggggtgatctcgctgactgcaacctccacctcccaggttcaagcgattctcctgcctcagcctcctgaatagctgggactacagacacgtgccaccatgcctggctaattttttgtatttttattagacacggggtttcatcatgttggccaggatggtctcgatctcctgacctcgtgatccacccacctcagcctcccaaagtgttgggattacaggcgtgagccaccgtgctcagcctttctctctctttttaaatagagacagagtctcactgtgttgcccaggctggtcttgaactcctggcatcaagcaaccttcctgcctcagcctcccaaagtggtgggattacaggcatgagccaccacgcccagccggagttgcacagtcttaaaaagcaattttttaaattgtcgtatgttcggaagggagggtcttattcaaaaagacttggacgcagagcagtgagtatccggggaagggagttgtctgaggtggtggcttggtcagaactgcattttggtgaaatccattgcagggcccagccgtggtccagcctgaagcaggcattcattccaaggtagaggagctcctggagctcctgccaggagccagaccctgttctcagtgctgggcacccagacaaagtccctgcccttgtggacatcctggcaattccatagatgtctgggaagactgcagaagccagagagaagggcctttgaagtggagaggggcgagctgacccagacagcctcacatgcagggcagcagggtggatgggaggtggagactgaggctgggaggctgggggaggaggctggggcaggacccccggaggagaggacaggctggaccaggtggagcgccggggagggaaagggggttggtggacagacccttaggaggctcagcgtacatgctctggagctgaagggctgtggcaggagggtgaggagggaggcgggggcaggaaacatctggctgatgggggggacagtacgatcgcattgagatgaggcctgggaggaggatgggcttggaggagatgccagggtccatttgggacatagtaggagtgagaggctggggggcacctagggcaaggtgtccaggaagccagggaaccccggatctgggggcagagagatggtatcatgagtgacgaggcagaggtcattggcatggatgagacaggtaaccccaggaaagtggaaagagaaagcagagaggccctggacagagtcccagagacctgccagtctggagctgggctgaggggaggcttcgaggaaggagacagaggttgctggagaggtgggcagagtgtctgaggcctcgagcagggggcacataggtccttgaagtgagcaccaaggctttgcattggaatcattcccagagtgacttgggacattattcagaggcccccagggctgctgggaagggacagcaggcccacgctccaggggacccgggaacgaagggaagaccccaggctgtgataataacagcaacagccagcgcttaccaagcacttcccccgcccctggtgctgcgcccagcacccaagctccctttccaaggtgagggacaccaagacttagaaaatcaaagtcacgaccaggcacagtggctcacgcctgtaatcccagcactttgggaggccgaggcaggagacttgcttgagcccaggagttcaagaccaccctgggcaacagaggaagacctcgtctctacaaagcaaacaaacaaacaaacaaaaaatgagcctggcatggtggcacgtgcctgtggtcccagctacttgggaggctgaggtgggaggatcccttgagcttgggaggttgaggctgcagcaagctgtgactgcaccagtgcactccagcctgggcaacagagcgagacactgtctcaaaaaagaaaagcaaagcaaagccactcacatgaggtcttgctcctggggacgggcatggccaggactccaaccccggcagcctgtcccagagccctggagctagccccagtgcagtctctccaccaccccgcacttcctcaggccaccttcctgccacagccttttccccaaacctggtatcaccccctctcctccctccctaatcccacctctcgggcctggccactccaccccaccccttccaggactcagattcagactctgagggaggagccgctggtggagaagcagacagtgagtatcttcctggagggacagggagcagggttctggggggcggggggatttcagggcaggggtgtgggtgatacctcctcaactccatcaggagtgacatccaaagtatgtagcagtgggttgggtaccagtgccagagcaggctcctggaggccgctggctgggccgggccttgtgcctttagatgtggggaggccgggaaccccagggctggggccagggtgccggagacatccatgcccctggctgaatgcccgtcctgccgctgtctctcttctttccggtcagtggacttcctgcggaacttattctcccagacgctcagcctgggcagccagaaggagcgtctgctggacgagctgaccttggaaggggtggcccggtacatgcagagcgaacgctgtgagtcccctgtcaggattgggccactttgcctggctcctggccccaagtgacctcccatccccagccacttgaaccatttattgaaaccttttctttataagtagcaagaaacccagctggaactggcttaagccaaaaaggagtgtgttggctctaatccagcttgaagcacggctgggtccaggtgcttccactttgttaaaaatcataactctctctgatgctgcttttcttgttttggggtaaaggtaactcctggcagctgcaaatgcaggttccactagcctaggagctgccaccgagagagcaccttttcccagtagttcaaaccaaacagcagagattggctcccattggtcccggttgagtcaaatgcctgcccccatgcctctgattggccagacctgggtcgcttctccattgctgagtgaattactgcactctgattgaccaggcctgtttcataaaatgaggataatgattatagtatctaactcataaggttattggcggggctaaataaattaatataggaccaggggacagtggctcatgtatgtaatctcagcactttgggaggccatcgtgggaggatcactcaacgccaggcgttcaagaccagcctgggcaacatagtgagacccccccgccatctctacaagaaaaaaaaaatagtcagatatgggggcgttgcctgtagtctcagttactcaggaggctgagaagggaggattgtttgagcccaggaattggaggctgcagtgagctatgatggcaccactgcactgcagcctgggcaacacagtgagactctgactctaaaaaaaaataaagtaataaaatttaaaagataaataaaaatgcaaatgcttagagcagggcctggaacatagcgagagctgtggcagggtgtgccgtggttattactacaggaggcttatttcagatgtggtggataggtgtccacttactgagtcagcatgaaatttatatttctttttctttttttttttttgagatggagtcttgctctgttgcccaggctggagtgcagtggcacaatctcagctcactgcaacctccacctcccgggttccagcaattctcctgcctcagcctcccgagtggctgggattacagacgcacaccaccacgactggctaattttttgtattttagtagagacagggtttcaccatgttgcccaggctggtcttgaacacctgagctcaggcaatccaccctcctcggcctcccaaagtgctaggattagaggcatgaaccacccgtcccggcctgaaatttatatttcttgccacaagttgaggtcaccaaagtctgagaaaccaggcccttggcagtcctcaactagaacaatcgaccctttgtggttcctgagcagccttttgttgaggacatcttctcctgtgtccctgtcctccagctgccactgtctccctcctcaggcagccaggcctgctgccctgagcctccctctcctgcggcaggcgagcagctgtctgcagccatcttttagcctgggcaggccccaaagacaacacaggcagtggctacaaagcatttgttccttgtgtcctcctgcacctggattctggggtaattggctcatgagggtgcccaggaggagatagtaatgaaaaataacaattagttgaggccgggagtggtggttcaggcctataatcccaccattttgggaggctgaaagcaggaggatcgcttgaggccagtaggtcaagactagcctgggcaataagcgagaccccctctctgcaaaaatttaaaggtgaggctccaaccctcacctcactgctctaaaaatttattattattattattttgagacagagtctcactctgttacccaggctggagtgcagtggcgctatcatggctcactgcaacctctgcctcccgggttcaagcgattctcctgcttcagcctcccgagtagctgggattacaggcgcgtgccaccacgcccggctaatttttgtacttttagtagagacggggtttcaccatgttagccaggctggtcttgaactcctgacctcaggtgatctgcccccctcggcctcccaaagtgctgggattacaggagtgagccaccgggcccggccctaaaaatttctttttaaccacttaattgaggcttcactatttgccaggcactgggctcagcactttacaagtgccctattatttgatattcacattatacctgtaagatcattatggaagtgatctgaacagaggaggaaaaggaggcacaaaaaggtcacgactcagtgtagggtcaaacagttgccaagtggcagagccaggatttgaccccaggtcccctgaatccagaccacatgtagccaccactggattcaaccaggcctggcctgatggcatctcagagctgaagctcagggctgaagctgtggcaggctttgtgctctgttcacctttgctgtcctcccttggacagggcatcccagaggcatctgatccacagcatatcacacttgtgcctgtctatcagctgatgggcagatgccagggtactatggcctggtggctactcaccagccaccagctagctatttctgctcagcccagggttcttatcctaaagtggccttttctcaagtccaagttggtgtgatttccaacagtggattctcttttttttttttttttcctttttttgagatggagtctcgctctgtcacccaggctagagtgcaatggcatgatctcggctcactgcaacctccgcctcccgggttcaagtgattctcctgcctcagcctcccaagtagctgagattacaggcacgtgccaccacgcctggctaattttgtattttcagtagagatgaggttttgccatgttggccaggctgggctcaaactcttgacctcagatgacccgcctgcctcagcctcccaaagttctgggattacaggcatgagccactgcacccagcccaacactggattctttatccgctggctggctcttccgcagttgattgtgtgacttcttcccctatctgagccccagttttctcatttataaaatggggatgttaacaccatccccgtctagatgattggaaggcccgtcatgcatctgagatgcttgccccagggcctggcatggagtaaacgatgtcaggggctgtgatgggtggtgctatcgtagggactgagcaaacggtgtcatatggtgcataagttcctctcctccaggtcgcagagtcatctgtttggtgggagctggaatctccacatgtaagtaacccttctcccccagcagctacccccaggaactggggagtccctcccaagggctggggaggagccctatctgagccctgtcctgggagggttagtatggtatagaccaactgctccctgacccccctttcctagccgcaggcatccccgactttcgctctccatccaccggcctctatgacaacctagagaagtaccatcttccctacccagaggccatctttgagatcagctatttcaaggtttgtgctcccccaggaaggggcgtctgtgaggggtggggatggggtcacctggctccaaccctcacgctacctggggcatctggccctctggctgtctctcctacagaaacatccggaacccttcttcgccctcgccaaggaactctatcctgggcagttcaaggtgagatctttgttttgcagggggcgaaacaggaagggttgggggagggcacgcatgagaagccccgccaaggccctgcagacaaatattatgtagccattaagtacatgggtgctgggcccagactgcctcggttcaagtcctggttcctcgtgtcttcatcttacgaccttgagcctccgatttgcctcctgtgaagtgaagctaatggtactgtctgaagagggctgctgcgaggcttagctgactaatgatgccgttgagagcccgggaccctgcagccgggctgcctgggtgcaaatctcagctctgcagcttacccaccgtgtgactttggcaacacaatccccttccctgtccttcagtttcctcatctgtgatctggggatagcagtggtctctccccgacgcggctgctgtgacggttccctgggggtaaaacagtcacagtgcctagaacagttcctggcatgcggcagtggcctgtggctgttccctgcagtcgtcagcagtgctgtcgctcttccctgcagccaaccatctgtcactacttcatgcgcctgctgaaggacaaggggctactcctgcgctgctacacgcaggtaggcggatgcgagcatcctgggaggaggatgggcgggtggaacgggcatggtgtcctcagcagaggagcagagctgcgtgcccaagagctcaggcggggactccagcaatgcggggccagggcttggcctactgcctccttgctgcatgacctgccgtgagtcacgtcttctctgcctcagtttccccttccgtcaaacaggggccagaaaaggtttgccctctcaggtctgccctctcaggtctgcagtgcggtggcagtgacctcctctcagggccatcccatgtgtgatgtggaaggagcctatggctgaagggactctgtgtgcactataggcaccccagatttcacattggttatgagcgagtttccaaagtgacttcatctaacaaaatccatacactatgacacgtgtccaacaagtagatgttgtgccttaaggaaggggcacctttttatagttttttgtgctttgcccaattataaacatgtctcgtacacgtcaggtgcttagccaagggcctctccctggggcattcaagcaaggatggctcacattgttggcttctggtttggagagtctcacacccctaacagtaaaaaaatcttgatgggctgggcacagtggctcacacctgtaatcccagcactttgggaggccaaagcgagagatagctcgagcccaggcgtttgggacccgcctgggcaacatagggagaccctgtctctacaagaaatacaaaaattagctgggcagggtggcgtgtgcctgtagccccagctactcaggaggctgaggtagggggattgcttgagttcaggaagtcaagactgcagtgagctatgatggtgccactgtactgtagcctgggagacctggtttcaaagaaacaaaaaacaaatcaaaacaacaacaaaatgttgctgcctctacctgttttatgaatatgtatagaaatgacatgatgcactacaacagtattaattcaagctctagatcacacctcagaaccccgaattataaaacaggtggccgggcgcggtggctcacgcctgtaatcccagcactttgggacaccgaggtgggcagatcacgaggtcaggagttcaagaccagcctgtccaacatcatgaaatctggtctctactaaaaatacaaaaattagccaggtgtggtggtgcctgtaaccccagctactcgggaggctgaggcaggagaatcgcttgaacctgggaggcagaggttgtagtgagtcaagattgtgccactgcactccagcctgggtgacagagcaagactccatctcaatttaaaaaaacaaacaaacaaacaaaaaagagtggtaacattgaaaataaataagtgttctagtgttttctccctgtacctgcagtttggcacctgcagccccaaaagctaccgccagggggaggaacaactggctttaagttcagatttctcaggtgggcgaggtgttcccacctggggctggtaggaggcagagggcagcggaggcctccttcttccaagaggaggagtcctgtgatccccacactttgggaggccaaagtgggagatcgcttgagcccatgagttcaagaccagcctgggcaacatagggagactccgggctcagaataaaccttctgcccagagagtcaccattattccaggacgtggctcagatatgataacagcttgcttgaagccaagtgctttttgtggttgatgtcatgacactcaccccaagaccccgctggcccttgtttgtcagcttctgtcaaagtaaatgttcactgagttgattccctacagcagggagggagatgatggacaagatggagacaccatatactgagcatataagatggtcatgggtccctggaacacagttaagctggaaggggagtcagaaacggtgtatgtgttcgggaaagggggtgctgttgtaaaccccatctctacgaaaaatacaaaaattagccaggcgtggtggcacatgcctgtagtcctagttactcaggaggctgaggcatgagagttgcttgaacctgggaggtggaggttgccctgagctgagattgccccactgcactccagcctgggtgacagagagagactccgtctcaaaaaaagaaaaaaaatgacacatcacatacaaactattatataaaggccaggcgcggtggctcacgtctgtaatcccagcactttgggaggccaaagtcaacgtcaggagtttaagaccagcctggccaacatggtgaaaccctgtctctactaaaaatacaaaaattagctgggtgtggtggtgcgtgcctgtaatcccagctactcaggatgctgaggcaggagaatcacttaaacctgggaggcagaggttgcagtgagccaagattccgccattgcactccaacctgggcaacagagcaagactccatctcaaaaaaaaaaaaaaaaaaattagccaggcatggtagtgcacacctgtagtcccagctacttgggagcttgagagaggaggattgcttgagcccaggatttcaaggctacagtgagctatgatcaagctactgtactccagcctggaccagtagagcaaaatcctgtcaaaagaaaaaaaaaaaaaaaccatgttgtcaaagaataacagaacgcagaggtatttcggtggttcttttccacgctgttcagttatttgcttactgttcagttatttgcaaattgctcactcacatgtgagggagtcagtgggtagactgagtcaagtaccaaaggcaaaaccaagatttagaatagtgggcaagggaggaaagttacagggcgtgtgggaacagtgacagtgactcttgtctgtaggctttggagataaggtggttgctggtagggagcccagaaggcagttagagcattctttctgcccttgaagggaaacaaacccttcccgttgtttctggagtccctgggaaacgctgtcagtttggccctgggccacacatgcgagccatctctgcgtaacctctgccagtgtcctctgtcagcacctgttttagcggcattcctcacaggcaaacaacagctgctccaaagggggtggttgttttaagaaaaatgagcgcgcacaaatgtctgtgcagaaaagaacattcccacctgtttaatatggaaagtctcactgtcttaaaagaaaacagtggccgggcgcagtggctcacacctgtaatcccagcactttgggaggctgaggtgggcagatcacgaggtcaggagatcgagaccatcctgaccaacatggtgaaaccccgtctctactaaaaatacaaaaattagctaggcatggtggcgcgtgcctgtgttcccagctacctggaaggctgaggcaggagaatcacttgaacctgggaggcggagcttgcagtgagccaagatcgcgccactgcactccagcctggcaacagagcaagactccgtctcaaaaaaaaaaaaaaaaatagccacgcatggtggcgggtgcctgtaatctcagctacttgagaggcggaggcagggagaattgcttgaactcaggaggcagtggttgcagtgagccgagatagcgccattgtactccagcctgggcaacaagagtgaaactccatctgaaaaaaaaaaaaaagaaaagaaaagaaaagaaaacagtggctgggcatggtgtctcacgcctgtaatcccaacgctttgggaggctgaagtgggaggatcacttgagcccaggagttcaagaccagcccgggcaaatagggagaccaccccaccccccatctctacaaaaataattaaaaagataaaaaattagccgggcatggtggcatttgcctgtagtcccagctactcagtgggctgaggtgggaggatggcttgagcccaggaggtgaaggctacagtgagctgtgatcagaccactacactccagcctgagtgacagagcaagaccctgcctccaaaaaaagaaaagaacacaggtgaatatgccatctatgaaacaggccatagtaagaaaggaccctggctactaaaggggaagatagtgattaaagccaaggaagggccaggcatgatgactcacactgtaatcccagcacattgggaggctgaggcagaaggctcgctgaccagcctgggcaacatagtgagaccccatctctacagaaaattttaaaaatcagccagatgtggaggctgaggtgggaggattgcttgagcccaggagttggaggctgcagtgagctatgattgtaccactgcactatagcctgggcgacagagtgagaccttgtctcaaatacataaaaaaacatggctaggcacagtggctcatgtctataatcccagcactttgggaggccgaggcaagcaaatcacgaggtccagagttcgagaccagcctagccaacatggtgaaaccccatctctactaaaaatacaaaaattagccagtcatggtggtgcgtgcctgtaatcccagctacttgggagactgaggcaggaaaatctcttgaacctgggagtcagaggttgcagtgagccgagattgtgccactgcactccagcctgggtgacagagcaagactccatctcaaaaaaaaaacaaacaaacaaacaaacaaaccacacctagtaagccctcctgattcatttatgttaatgcttgcctagagctgccacatgcagctgtgcagggtgcgcactgcacaaggatgccacatctgagggggctccattaataacagagacattgtaaatgtatgttaatttcagcaattaatgacaggtggaaataaagcatctggctctaataaaacaacattttttttctgaaaaatgaaagcaaatggcctgaatttgcagaataaaagccacacaggctgtggagtggctgtgggcctggcctcatagatatttaggtttgggccccttttttttttttttttttttaattttttgtagagacaagcgtcttgatatgttgctcaggcaggtcttgaactcctggcctcaagtgatcctcccacctcagcctcccaaagtgctgggattataggcgtgagccgccatgcccagcctggcccctgcctttaagcagccttgactgtcaccctttaagtggcaccattgggatgaacagaagagtcttcagataaaccctgccacttgcttctcctccctcccttctccacctgtccccaccacctcactgctcctcgtggccctcaactccctactgtgccttctggcctacaaggggtggctcactcctcacccctcttccctccatctctccctctagaacatagataccctggagcgaatagccgggctggaacaggaggacttggtggaggcgcacggcaccttctacacatcacactgcgtcagcgccagctgccggcacgaatacccgctaagctggatgaaaggtgaggctggagggcatcctgagggcaggcctcctctcagcaccaggagcagtgtctccatgcagtgggcacccattctgtcctgctcaattctttggggtttttttgttttgtttgtttgtttttgagacagagtctcactctgtcgcccacgcggggagttcagtgggtgatcatggctcactgcagcccaactgcctgatttcctgtctttggctgtttttaatatatgatagtaggccaggagcagtggctcacacctgtaatcctagcactttgggaggccaaggcgggcagatcacctgaggtcaggagttcaagaccagcctggctaacatggtgaaaccccgtttctactagaaatacaaaaaaaaaaaaattagcctggtgtggtggcatgcgcctgtaatcccagctactcaggaggctgaggcaggagaatcgcttgaacctgggaggcggaggctgcagtgagctgagttcgcaccattgcactccagcttgggcaacaagagcaaaactctgtctcaaaaaaaaaaaaaaaaaaaaaacaagaagtcacttattccactcatggaaagccatttctgacattctttatgctgatttaacaaagcctctggtgtccctgtgagataaggacagctgcagcatttgcagaagggcctctggagtgtggctgttctgataaaatgccagctgagtgcccctgggctgaggattcctgaatagcccaactgcaagcagctgggggcagtgtacaattcacattacccccattatgtgtcattgacagcagcgtcacaggcagcacccacggtgtcatgctgtccatgcagaaatattttaaagaaaattaccgactactgacattgaaacaatgctttataaatgtgtgctgaatgaatgaatgggacagttgagcaaatgacttagaattcagtgggttgcaagtgacagaaatgctttctttctttcttttttttttttttgagatggagtcttgctctgtcacccaggctggagtgcagtggtgcaatctcggctcactgcaacctccgcctcccgggttcaagcaattctccctgcctcggcctcccaagtagctgggattacaggcacgtgctacaacccctggctaatttttatatttttagtagagacggggtttcaccacgttggccaggctggtctcaaactcctgacctcaaacgatccactcgcctcagcctcccaaagtgctgggattacaggcgtgagccaccacacccggccagaaatgctttcaagcttcctaaatcaataagaaataaggccaggcacagtggctcatgcctgtaatcccaacacttttggacgtcgaggtgggtggatcacttgagcccaggagtttgagaacagcctgggcaacatagggagatcccatctctaaaaaaaataaaatgtagccaggtgcgatggtggatgcctgtgagcccagctactcgggaggctaaggcaggaggatcacttgagcctgggaagtcggtggtgcagtaagctatgatcacaccactgcactcaaccatgattgcaccaccacactccagcctgggcaacagagtgagaacctgtctcaaaaaaacaaacaaaccaataaggccgggcgcagtggctcacacctgtaattgcagctctttgagaagccaaagtgggcagatttgcttgagcccaggagtttgagaccagcctgggcaacatggcgaaaccctgtctctacaaaaaatacaaaatttagccgggcgtgctggcatgcacctgtaatcccagctactcaggaggctgaggcaggaggatcacttgaagctgggaggttgaggctacagtaagccatgatcgtgccactgcattccagcccgggcaacagagtgagaccttatctcaaaaaaaaaaagaaagaaaaaaacaaaaaaaatgcaacaacaagaagagaggtcttttctgagcagagtggacacctcaggagacacccatcacactccaactgatggaggtgtgttcatgttaacagtggaagaggggtgggggtgctgcacctccagactccggcccagatcctcttactgccttctctttcttccccttccccatacccagagaagatcttctctgaggtgacgcccaagtgtgaagactgtcagagcctggtgaagcctggtgagcctctggccagggacctgcccaggtggatttgggtgggggtcccctcctccccctgaccccctcccaaaggccacacccgcacacatctggccacctctgtctctctgaacagtgccccagatccatcctggggagaatggggtctgtgcccctggccggtccccactgctcccaactcccactgtggcctccgggtctgccattgctcccacctgtcctctctgcctccccatgtcactgtctctgtccgtccatctgtctccacctcagatatcgtcttttttggtgagagcctcccagcgcgtttcttctcctgtatgcagtcagtaagtggccccccagcctccccgcatccccaaccgccgcctccacctgtgctgggccccatgggggcagcctgggccctgcctcaggaaaggtcacctccccagctatggggggcggcagggaggtttgctgctgggggcgggggagggagcggtggcgcagcctgggcggaggctcccaagctcacgcccctccccgcaggacttcctgaaggtggacctcctcctggtcatgggtacctccttgcaggtgcagccctttgcctccctcatcagcaagtaggttgggggctgtggctgggaggacggctgggcacccagggccaggacagaccctgaccccttagctccccctccccacagggcacccctctccacccctcgcctgctcatcaacaaggagaaagctggccaggtaagagcccttcttcaagcccccgtcgtcacaggctcccccttccctctcacccttttcctcagagggaacccccactgtggaaccccagcactttgcattcctcagctcagaacctggggctctagaatccagaggggtcgggttccaggcctctgggacattcactgcccttttgagcaagtgatagaattccaactcaaaccagctgaagccagataggaaggccgggcttccagggactgaggaggtgggagggggtgcaggggtcaggagagacagtgcggggggcggggttgggtccacgctctgggtctctcaggtctgtttttcctgggcagcctcactctagggcaggtgctccctcctaggtgttcccctcaggggaagtaggcagggtcaccgggcaagcagcgcacgctgtgggcagacactgtcccaagtcttagcctgcgtgaactcactggcgccacaaccccatcgcggttttgtgatcacccctattctacaggaaactaagacacagagaggacaagtcacttgaccaaagtcactgagctggctgggcgcaatggctcacgcctgtaattccagcactttgggaggccgaggcgggtggatcacctgaggtcaggagttcgagaccagcctgaccaacatggtgaaaccccgtctctactaataatacaaaattagccgggcatggtgctgggcacctgtcatccaggctactcgggaggttgaggcgggagaatcacttgaacccaggaggtggaggttgcagtgagccgagatcacatcattgcactccagcctgggcaacaagagtgaaactttgtctcaaaaaaaaccaaaaaaacaacaacaaaaaaaaaacaaagtcacagagctaggatacaaacccaggccacctggctccagggtctgtgctcttagctctcccttccctgctcctgcccctgacccaccccctccctgacagtcggaccctttcctggggatgattatgggcctcggaggaggcatggactttgactccaagaaggcctacaggtgaggccccgccgggggttggggcagcctggaagggacagggtgaggtgggagcgggggcacgaaggcagatgagaggagcaggcaggggcgagcccgcctgggaactctgatctcctgctgcaccgcagggacgtggcctggctgggtgaatgcgaccagggctgcctggcccttgctgagctccttggatggaaggtgaggagctgagcaaccccagcctgtcctgagccccatccctggaccctctccccaccccatgggtcctctgaccccatgatgcacagtgacctttgacttctgtgacctttgctcctgcagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatctaacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaatccggtctggcctcctgtttctttctgtgggcacccagggaaatctctgaagggagggggttagatcttgggccactaaggaaccagaaagtctccgggatccagagtgaggggtaacaagagggtcctcacgggggccctcgtggctctgacccctggactcccagcctgccagtgtcccttcctctaagccccgtcactgaaggcctgaggccccagaaagagggaggaaagttgacttcagataccccagccccgcctcttccccctgcctgctcagcttcctctctccacttcctgctactgcaggcctctcctccgagaacaggtagggcccccaggaaccgagcatctggcatcttcagcccctgctgcctccctttggtatgaggcagctgccctgacccacccctgccacgcactgcccacagcctcctctcctgccacggtacacaagcaggcatctgcttccctctcccctcccctcccctcccttccttcctgctcttgcctgggcagggcacctgcgcctccctgcccacctccctccttcctaataacaccctggccttctggtcaatggcctaatgtatttgtttagctgcctattatccatatgctacacctgccccaaacaagaatggaaggccctgaggggaggagcctgtcctgttcatcaccctctctccagggcagaggcacctaattccagcctgtattcagtaaatactggatggatggaaggaaggaaggaagggagggagggagggagggaggatggatcctcccccgatccaggtctcctgctcctgggactgctgctgggataagtgccaccctaagtgataacctacgtaggactctgtacctggttaggagctggggcctgatgggtggatggagagagagaggaacagatgtgtgataaagcaagatgagtaaaatgttcatggtagaatcttggtagtgggcatagggatgtttcctgtacaattctttcagcttttctctatgtctgaaatttttcataataaaatgctgggggaagagattcagtggcccctccatggtgtgggaagggaggaagaggggatgttattacctttccagatatagggactgcctactctgggccaagaacttttccaggcgctgactgggttttgccaagggctggcccacatttacacagcccccatggctgttaaaaatcttaacatatttcctaccacttcagtaaagagctattgttttgagtcctctccccacaccgcaagacacactggcctctctcctgggatccccagattccccaccatccggtactaaagatttaacccctgccggccgggtgtggtggctcatgcctgtaatctcagcactttgggaggccgaggcggggggatcacttgaggtcaggagtttgagaccagcctgggtaacacgtcaaaaccttgtctctactaaaaaatacaaaaattacccaggcgtggtggtgcacgcctgtaatcccaactactcgggagactgaggcacaagaatcgcttgaacctacgaggcggaggttgcagtgagctgagatcgtgccactgcactgcagtctgggcaatacagtgagactccgtctcaaaaataaaataaagaattaacccctgccacggcaagcggcctctggggtccattctgattggtcagggtctctgccatattgattgtaaatatcttgaacatgacccgagggctagagcagctttgagtcttacctttctccctgccagaggccaggtcatgactcactggcttcctgcaacctgacgatggcccagccagaagacaaggcacctgaagtccccacagagggggtgaggtgaggctactagggctgaggctatgccctccttcccctgcatccagaaaccctttccatccaatacctccctcactacagaatcctgaatcacatctctgagcctctgccctgggcctgccccttcctgt

SEQ ID NO: 12692 - DNA, 37712 bp, Human
gagtgtggtgcctagtcaggaattgggaggagtgtagcaagaaaggaaggacaacaggatttggtcattgattggtcagatggatttcagagggattggtatgaaggaacgcttcaaagattttttttttaatttaagttccaggatacaggtgcagaatgtgtaggtttgttacatacttataggtgagccatggtggtttgctgcaccaatcaacccctcatctaggttttatttatatatttttttgagacggagtttcgctcttgctgcccaggctggtgtgcaatggtgcgatctcggctcaccgcaacctctgcctgctgggttcaagcgattctcctgcctcagccttctgagtagctgggattacaggcatgtgccaccacgcccggctaattttgtatttttagtagagacggggtttctccatgttggtcaggctggtctcgaacttccgacttcaggtgatctgtccgcctcggcctcccaaagtgctgggattacaggcagcagccaccgcgcccagccaggttttaagtcccgcatgcattagctatttgtcctaatgctctccctccccttgacccccacgcaaccaaagatggttttaaggcttctaggactggagatgattactttcagaaatgaatagtggtgaccagatgaaataagacttttggatgtagataggaccttagcgatatatttccagctttttattttttattttaaggatgaagaaacagctttaagttggttgcctaaagtcacgcaggtaattgatgcagtatggccagaacccatactaggcttaagggacagtgtaccataaactcgtagaggtcctttaaacagatagaaacgctgtgctccaggcagatgccataacaaacactggctctagatctaccatgggttatatgggtccttagttaagattagatatggagtcacagtgtgccagaatttcagggagagaggaaagtggaagggctttccactaagccttttgaactactaggtacccctcgttttacatctggttatctcatttaaatctatgacgttttaaaatacttattaccatttaagacatgagaaaaattaagtttagaaacggctagatagctcacgctagaaaggaaggactccaaattttaaccaagggcagatgtgcatggaggccaagtcatttccttcccatgctctcatactgacccaacaaacccattctgcacgtgagaaaactgaggcccggaggagggaattcacacacgtttgaagccaagctggggccagaaagtagatcggctgatctccaaacctccacgtcaaaggtcttcccaggaggacatatgccttcaaggattttacaatgtataccaccctacaagtgatgggagagaggggaaaaaagcaaccgactaaggagaaaagcaaggagcagaaaaaggagcaaaagaggagctgtcagaacggtgtgaggagagtgggaaaggagccgcctccttttgcctctcttcctacttattaacaaaacagaacgactatccaacgtatttcagggagctaagtcttagccagcttcagctgtgttttaacccttagctaaatatagacaaggctaaggcaggccaggtgtacacttcaggaagacgtggaaattcccagggcggaccaaaacttgagctgttccggcggtagtgatttgaggtcagtttgaaagagaagttgagaaagcggccgaggggcgaatttggctgcactacacgctcgccacaaagaggaagggccgccggccgccggggccgagtgcgcttccagcccaggcggagcggtagacgcaacagcctccgcccgccacgtgacccgtagtgttgtggtctggcccgcgtgggtggcgggagcgccgagagggcgggggcggcgatggggcgggtcacgtgatggggtttaaatctcccgcagccggagccgcgggggcgccagtgccgcgcgtcgagcgggagcagaggaggcgagggaggagggccagagaggcagttggaagatggcggacgaggcggccctcgcccttcagcccggcggctccccctcggcggcgggggccgacagggaggccgcgtcgtcccccgccggggagccgctccgcaagaggccgcggagagatggtcccggcctcgagcggagcccgggcgagcccggtggggcggccccagagcgtgaggtgccggcggcggccaggggctgcccgggtgcggcggcggcggcgctgtggcgggaggcggaggcagaggcggcggcggcaggcggggagcaagaggcccaggcgactgcggcggctggggaaggagacaatgggccgggcctgcagggcccatctcgggagccaccgctggccgacaacttgtacgacgaagacgacgacgacgagggcgaggaggaggaagaggcggcggcggcggcgattgggtaccgaggtgcgcagggtgcgggcggccggaactgcgcatctcctcctccctctccccgggctcctactggcctgaggttgagggcggctgggggctcggggcaggctccgcggcgttcccctccccaccccggccctccgttcagccgcgctcctccggggctgcggttcctactgcgcgagctgccagtggattcgctcttttcctccgtccgtggcccgcctgggcggccttgttctttccgcagcagccaggtcgggagactctcgcagtcgctttaaaataagtttctctccccctcttactcttttagcatattgcttttgttagagctttttttttctttttctttattttttattttcattgcttttctcctctaccccccagcacacttaagtctgcaactttttggctgtcccgttggtctgcgttttcaattgctttttgcaaactgacacctgtgcagtttgctttttttggtctatatttttatgactgaaattacaatttttgaaagaggaaagctgtttctatagtcacagcttgcaaaatttaaagaacgtggctgttcctgaagacattaccattctgtaatgcagttaggagtgggtatgggagagagagtacttttagagctgttcatattacttttattctaatcttgctcttgtgcggtaacggtgtttgggctaaacatgctttttttgtatgtatgtagtattgagacacaaacttaacacttctagcataatgaagcagatatgttgcagttgtcatgttcttgaaggtttctttttttttttttttttttttttgagacggagtctcgctctgtcgctaggctggagtgcagtggcgcgatctcggctcagtgcaacctccgcctcccgcgttcaaccgattctccttcagcctgccgagtagctgggactacagacacccgccaccacgcccagctaatttttgtgtttttagcagagacggggtttcaccatgttggccaggatggtcttgatttcttgacttcgtgatccgtccgcctcggccgcccaaagtgctgggattacaggcgtgagccaccgcgcccggtcaggtttcttatttttgatctgaggagtttctatccttgataggtgttcatctttatcaatatttgggtcaggccgggcgcggtggctctttcgtgtaatcctagcactttgggaggccaaagcgggaggatctcttgagcctaggagtttcaggccagcctgggcaacatagcgagacctcctctctactaaaagtaaaaaaagcgggacgtggtgtcgcacacctttagtcccaggtactagagttcgaggttgcagtgagctgtgatcctgccactgcactccagggtgggcaacagagtgagaccccgtctcaaaaaaaaaaaaaaaaaaagtaatatgtgtttttagggactgatttagtaaagagaccctgatttcaagcaacacagttgagtactaatttattatttacctaataataattgtgttattaatactgtttatttaatagaggaaacaatgcagaggtacttgtagtattgtgtaagtttaacgtgcgcattgccaaggttatatttgaatgacgtttttatgtaaatgtccatttattacacgtttcacgaacgctattgtttgtgattgtatgatacattctagctagattattatcttttctttttttttttccttttctttttttttaaaaggtggagtttcgctcttgttacccaagctggagtgcaatggcgtgatctcggctcaccgcaacctccgcttcccgggttcaagccattctcgtgcctcagcctcctgagtagttgggattacaggcatgcgccaccatgcccggctaatttttgtattattagtagagacgagatttctccatgttggtcaggctggtctcgaattctcaacctcaggtgatccgcctgcctcggcctcccaaagctctggaattagaggcgtgagccaccgctcccggctatcttttctgttttttaagtagacttaatttatttttagattttggctgaaactgagtgagcagaattcctaaagatgaagaaactgttccaatgaacagtgcaagctgaccccataggcatgctttacacacgccgtgtaaatgttaaatgctgtactcgatgaaaatgattgctctataaccgttcatacattttaggtgcatgttgttttgatagccttgactgacttggtttcttttgcagataaccttctgttcggtgatgaaattatcactaatggttttcattcctgtgaaagtgatgaggaggatagagcctcacatgcaagctctagtgactggactccaaggccacggataggtatggctcagagctgttaattttagagagtaaatgtacgttttttggtttgtttgttttgagacagagtttcgctcttgttgcggaggctggagtgcaatggcgcgatctcggctcaccgtaccctccgccttccaggttcaagcgattctcctgcctcagcctccccagcagctgggattacatgcatatgccactacgcccggctaattttgaatttttagtagagacggggtttctccatgttggtcaggctggtcttgaactcccgacctcaggtgatccgtccgcctgggcctcccaaagtgctgggattacaggcatgtgccaccttgccccacctcacttgtcccctttttgtgtagtgttcttcatccggttagaatatcttcctccctcacttcatattccttgttttttcactttattgtacacttaccacttcttgaaaagctctgtatcttactttttaaattgtgttgtttcctggtctagaatataagttctacgggagcaggaatttttgactgacttgtatactcctgtcttttcagtgcctaaaaaagtgcctggcacatagtttgtgctcaataaatatttaataaatatgtgaatgaaatgggaaagtatttcgatgtagaaagcattatcagttttttataccaaaggtataaccatcttgaaagtggatctttttatgttctcactcttacaaatggcttgattatttaaacatagtgaagatcagtttctctttggtgtctgtaatttatttatttatttatttttgttttctcaagcctagggagctggtttgagcaatctcagggtaaaagaaaatgattagttctcagaacatcaacattgtatgtattatcttggaagatgggttaagatcaaattgaaaaattaccggaaaaaaattaagatggcagttatgtatagattttcatttctttttcctgtgtggttttaatgataagtagtacaggcttttaggactggtacgatttttctatgtcgtagaacccttttgtaaatacttttggtattatggtgtgtgtttctagatattaaccataagaacttaattctggttgttaattaattagactcttgaaatatatacttacagctgaagggggtcttcccaactcttcattagatcttcctaatctcattgggatatagcattaattctgagtgtaccgagaatgaaataccattaaattgcattttcttactttgcaaaaaaccctcacagaatgctaactcattacttcagaaaataaatgagattttgaattacttgataagttgactttaagccttttcccccttattgtaggtccatatacttttgttcagcaacatcttatgattggcacagatcctcgaacaattcttaaagatttattgccggaaacaatacctccacctgagttggatgatatgacactgtggcagattgttattaatatcctttcagaaccaccaaaaaggaaaaaaagaaaagatattaatacaattgaagatgctgtgaaattactgcaagagtgcaaaaaaattatagttctaactggagctggggtatgtaagactagtacatggggaggtcgtatatgtattttcttatgccttttccaagtaggaaacatttttctggtttagaaggatttatccttacatgataatggatgtttgggaactgccaaaaactgagtgcagcagcagttgctaaattagttcagatttttaaaacctctccagccttaaaaaaatatttgcttctgcttatttatagcacagtgggtaaatggagttaaggcaagatttctacctacattatatcatagctcctaaaggagatgcagggaattgaaactctgcttttgttaagggatgtcagtctgatggagaaattgggtatttgttagatctttatgagaaactggaaacctaattggtattcacaagtgaaaagcttagtgttgggaagagtaacagattcctaccttccctccatattaattaagatgatgtgattgtggcgacttgacattttctatttgatctaccttagggttgcagctaattagttacctaagactattgcatagtgtgtgttttatacagagtatattacatgttagcaaccagagcaactgctgtagtaaaattttgtcctgttttctgccatttcgagttgcgaaagggtgttacataatcttagatgatcatcaggagtatgttttgctcacagataacgatgtagacaagtttgtttaacttaaattgaccttgactccaggtcaaattggagtcaactctggtaagatgatgaaacaataacttctgaaatctctatttgaaatgtcaggatttttttgtacgattagtgggcacgtctcaaagaaatgaagaattgaaatattatacaccttttttttttttcttttttttggatacagggtcttgctgtgttgccctggctggagtgcagtggtgtcatcatggctcactgcagtctcagcctctcctggcctgagtcttgctctgttgcctaggctggagtgcagtggcaggatcttggctcactgcaacctctgcctcctgggttcaagcaattctcttgcctcagcctcctgagtagctgggattacaggcgcacaccaccacacctggctaatttttgtatttttagtagagatggggtttcaccatattggccaggctggtctgaaactcctgaccttgtgatccgcctgccttggcctcccaaagtgccaggattacaggcgtgatccaccgtgcctggctatacattgttttttttaatgaaaatagagaattgttgtagtattgaggtaatagaatcctaactaaaggagcaatttctttggaattacttctctgtaatagaaattcttggctggtggagtggctcatgcatgtaattccagcactttgggaggctaaagtgggaggatcacttgagccctggagtttgagatcaccctgagcaacatagaccctgactctacaaaaaattagcctggtgtgctggtgcgtacttgtagtcccagctgctaaggaggttgaggtgggaggattgcttgagccggaaaggttaaggccataatgagccatgatggcaccactgcactccagcctgggcgtcagagcgaaactgtctaaaaagaaaaaaaacaaaaagccgggcgcggtggctcacacctgtaatcccagcactttgggaggctgaggcctgcggatcacgaggttaggagatcgagaccatcttggctaacatggtgacaccccgtctctactaaaaatacaaaaaatcagccggtcgcggtggcaggcacctgcattcccagctaatcagtaggctaaggcaggagaatggtgtgaacccaggaggcggagcttacagtgagccgagatcgcaccactgcactccagactgggcgacagtgtgagactctgtctcaaaaaaaaaaaaaacaaaaaaaaaaagaaaaaattcttccctacttaaaataatttgttgaaatggtttattttcttctcaagttgcatttgctttaatttgttggctaaatgcttaaaaggcttaaaattggcctgacttaaaaattccttatctgtgttaaagatggaatatgaggtatgtttaattttactcagttatttgggagttttatttctgaaataagggtagggttgtatttttatttcttaaaagaagtttcagactaaaattttctttctcaactcttacctaattatatggtaagagagctagctagttcctataaaggtagaagatttaattttacaaattatgccatgcacattttaggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggtactatgaactcttctggttgtttctttggccttctctcatgaaaaagtattttgttcacatacagccaccttaaggttatcgttcattgtttagtaaagtgaatgctgctactgtggcggagtaagatcactcattatggctagaattcctttattcctagaggaggactattatctacttcattttaggagtgagcttattttcaaagagatagttcatatttttaaaatttgcactgcagcgatggtcgttattctgcctgggcttttttaagaggtttgcacaccatataaaagtaacataacttgtgatttttaatattttattagagattgtaaaggttataacatcactttggtgtttcgtagtcaagttttaacataaggatgtgcctgaaaaatcatttgtaattagagaatgggaagattcttgggttgcatttttgtcagcaaattgcagaggatcattattctgctctagagttgcaccgtccagttcagaagccactagccacatgtggctgttgagtacttgaaatgtattgatatgtgcaataagtgtagaagacatattggattttagagatccagtatggaaaatacaaagtatttcattagttttattcatcaaatattaaacaaatattggtttttatatggaaaaaatacttaaaattaattttgaattcttttgaaatacttttgatattgggttaaataaaatgtattttgggctgtgcgtgttgcctcatgcctgtaatttcagcactttgggaggccaaggtgggaggatcagttgagcccaggagtttgagaccagcctgagcaacataatgagactccatctctacaaaataaataataaaatttgctgagcatggtggtgtgcacctgtagacccatccactcagtagtctgaggtgggaagatcccttgagctcaggagctcaagactgagtgaaccatgatctgccattgcactccaccctgggcaacagagcaagagtgtttccaaaatatatgtatgttttttgaagtttactttttttttttttctttttttgagaagtagtcttcctttgtcccccaggctggagtgcaatggcatgatcttggctcatagcaacctctgcctcccaggttcaagtgattctcctgcctcagcatcctgagtagctgggattacaggcgcccgctaccatgcccagctaatttctgtatttttagtagagacagggtttcaccaggttggccaggctggtgttgaactcctgacttcaggtgatccaccctcctcggcctcccaaggctctgggattataggcgtgagccaccgcgcctggccagttttcaccttaatgtggttactaaacaatttaaagttatatgtatgtctcacattatgtacctattgtacagctctgctttagcatagaaagtttaataatgcattacaccattctcaagagattgagtcattagaaaactgttttctttcctgtatttcagtcttttggaaagaaattacaaaatttgttattgttaaacttggaggtatatatatttgaaagagtcattttattttattttactttaagtgccgggatacatgtgcagaatgcgcagatttgttaacataggtatacatgtgccatggtggtttgctgcatctatcaacctgtcatctaggttgtaagccccacattcattaggtatttgtcctaatgcttttccaccccttgccccccacctcctgacaggcctctgtgtgtggtgttccccaccctgtgtccatgtgttcttattgttcaactctcacttatgagtgaggacatgtggtgtttggttttctgttcttgtgttagtttgctgaggatgatggcttccagcgaaggagtcttgtattagtggctttttccccacctaatcgttagaagttgtgaatagggacttctttaatgaatccagaagttaatgaacctagcttttttttttttttttttggagacggagtctggctctgtttcccaggctggagtgtagtggtgtgatctctgctcaccatacaacctccacttcccgagttcaagagattctcctgcctcagccttccgagttgttgggactacaggcgcgtgctgccatgcctggctaatttttgtatttttggtagagacggggattcactatgttggccaggttggtcttgaactcctgaccttgtggtccgcccatctcagcctcccaaagtgctgggattacaggtgcgaggcaccgcgccccgcgccctgccgatgaacctaaattttaactaaacagtggccttatctactttcagaccatgtggtatatttacatgactacaggagaagctttgctaattcagaataaattatgttacttaaattggcgactgtctttaaaaaaaaagtgattttttggatgcagtagctcgtgcctataatcccagtgctttgggaagctgagataggaagatctcttgaactccggagtttgagaccagcctgcgcaacacagtgagaccctaatcactacacccctccaccccatgtaacttttgttttatccaggttgtggtatattaaatgggcattagtgtaaagtgggaaaattatattaattcttgaatatgattactaaactgaatttgaaaagttttcaggctatcaagagaatttttaacttaaaacttatataatttgaactttttacttcatatatccgtaatgatgatggtcatctatatctagcttttagagcagacaactggttcatacctggattaaataaataatgtaaagttattttttgttaattatggattagtgaagatttactgttttaacctactcctgctagtggcactactgcatggttttgaagaccagtgaagtatgacttaaaggtttcttgaattggagctaggacactggcatttataaaatctccacgtagcgcagacattgacactatcagaagaccagcaagtaactagaagttactttgatcttaaatcaactacaaaaaacttgactcactagttatggagaatacattttttattgttaaactgaaaaaaaattcagtcacttataaggtgtagcctcttctaatcctgtttatataaatttatttattattattattttttgagatggagtcttgctctgttgccaggctgtagtgcattggcgcgatctcggctcactgcatcctccacctcccgggttcaagcaattctcttgcctcagcctcccaagtagctgggactacaggcacgtgccatcacgatcagcacttttagtagagacggggtttcaccatgttggcaaggacgtgtctcgtcgtgacctcgtgatccgcccgtttcagcctcccaaagtgttgggattacaggtgtgagccacaatgtccagctgataaatttaattttgcttttctgagttttcatttatggtaatggttaaatcagctaggctttacagttgttactcacatataattctttgtccatcctttaattctcacattgggaactgactaaaaaaagaaagcttccagtctgggcacagtggctcacacctgtaatcccagcactttgggaggccgaggtgggtggatcacctgaggtcaggagttcaagaccagcctggccaacacagcaataccccgtctctaataaaaaatacaaaaatcagccaggcttgggtggcgggcgcctgtcgtcccagctacgcaggaggctgagacggggagaattgcttgaagccaggaggtggaggttgcagtgagccgaaagcgcttaaggagaaataagtaaggacaaagagtgcaggatagtatcctgacatggaggatggggagggtatgtaaatattgtcgatattttactgaatttctaaatattacaagaatagaatattcataggataacctaagcttttctgtgagtcagtgtactaggcagaaagttcactaaagtggtttatgatttttgctacttatgagaaaacattaaaaatgaagccatgaaaaggaaatattggtgaaatttagatacttcagaaggaaagagagactttcttttttttttggaaagaatttctataccatctattatatcattgattgtatgtgattattgagaattaacttgttttttttttttttgttttttttttttgagacagttttgctcttgtcacccaggctggagtgccgtggtgagatctcggctcactacaaccttcacctcccgagttcaagcaattctgctgcctcagcctactgagtagctgggattacaggtgcccatcaccacgcccagctaatttttctaattttagtagagacgggatttcaccatgttggtcaggctggtctcgaactcctgacctcaggtgatccgcccgcctaggccaaagtgctgggattacaggcgtgagtctcccacgcccagcccttaaatttcatttagactggaaatttcaagtaatggagaggtgtgttaaggaagttattgctctgttagagcagtttcttaaatttggcactattgacattttgggctggatttttctttttgtttctgagatagtttcactctgtcgagccatcacagctcgttgcagccttgaactcctgggctccttgaacaggaggctcctgcctgagcctcctgagtagctgagaccataggcatgtaccatatacctagctaaatgtgtttttgactttcttttttctttgtagagtcaagttctcactatgttgtccaggctggtcttgaaatcctgggttccagcaattctcctgcttagccttacagagtgtcgggattgtaggcataggccactgcacccggccttgggctgatatttatttgctatggggaactttcctgtgcgttgtaggatgtttggcaatgtccctggccggccaggtgcagcggctcacacctgtaatcccagcactttgggaggctgaggtgggcggatcacttgaggctgggagttcagaagagaccagccaacatggtgaaaccctgtctctactaaaaatacaaaaattagccgggtgtggtgacacacatgagaatcacttgaactcaggaggctgagtttgccgtgagctgagatcgcgctgctgtactccagcctgggtgacaaagcaagaatctgtctcaaaaaaaaaaaaaaaaaaaaaaaaaattcgctggtctccacctacgtttgtatccccaccccaagtcctgacaataaaaaatgtcttcaaaatgttccttgcaaaattgctcattgaggctaactgaggtggctcacaactttaatcccagccctttggaaggctgaggctggcagatcacttaagcccaggtgactggccctggccaacttggcaaaaccctgtctctactaagaatacaaaaaatagccagacgtggtggtgcacacccgtaattccagctactcgggaggctgaggcagcagaatcacttgaacctgggaggcggaggttgcagtgagccgagatcgcaccactctactccagcctgattgacagagtgagactccatctcaaaaaaaaaagaaattactctctgagcaccagtgtgttacagtgtgcttagctgtggtaccactttggattctttcacacaagaacagttaaggccagttttaaagctgtggggccatttctgaactgtattttgtttttttttttttggagatgaagtttcactcttgttgctcaggctggagtgcgatggtgtgatctcggctcacttgcaacctccgcctcccaggttcaagcaatctcctgccttagcctcttgagtagacttgattatgggatcttggctcactgcaacctctgcttcccaggttcaaacagttctgccttagcctgctgagtagctgggattacaggtgcccgccaccatgcttggctaattttgtatttttagtagagacggggtttcaccatattggccaggctggtctcgaactcttgaccttgtgattcacccacctctgcctcccaaagtgctggtattacaggcatgagccactgtgcctagccaattttttgaatttttagtagagatggggtttcatcatgttggccacgctggtctcgaactcctgacctcaggtgatccacccaccttggcctcctaaagttctgggattacaggcgtgagccacttcgcccagcctgcactgtgttcttatcctgcataatgacttaaattgataataagttgtggtcatggttctcagaaacctaaaataattcactgatgttaataaaaatgagtggttgtatttagagtcaaggcgaaactgaattaggatgtataaaataactttttttttttttttttttttttaagtaggactgttgttcggctgggcgtggtggctcacgcctgtaatcccagcactttgggaggccacagcgggcggtcaaaagtttgagaccagcctgaccaacatggtgaaaccctgtctctactaaaaatacaaaaattagatggatgtggtggcgcatgctgtaatcccagctactcaggaggctgaagcaggagaatcacttgaacccaggaggcggaggttgcagtgagctgagatggcaccactgcactccagcctgggcgagagagtgagactctgtctcaaaaaaaaaaaaaaagaaaagaaaaaaaaagaaaagggactatactatgttcgaagagtgtagtttctgtcccatactgaattcactgttctttccctagtgattaaaatacaagaaaaggtagagggagaaacacgaactgaattttatgaacttaattccaagaatgtatttttacatttgttcaaaaaattattactttattgataatatgcaaacataccagattatgtattaatagttaaaaatttgagttctagaacaagcttattaaaaatcaacgtcagtaaaaagaaaatagatggtagtcacagtgccattcatctgaaaataatgttttaatactcaacatgtatatggattatatatctatacgtttatagtattgtagctggatttatgttacatttttagcataaaatttggcttttgctgggcccagtggcttgcgactgtagtcccagcaactcaggagggtaaggtgggaggattgcttgaaccaaagagtttgaggctgcagtgagctgtgacctcacctctgcacaccagcctgagtgacagagcaagacccatccctgaaaagaaaaaacttggctgttttactttgctttcaatttgtagtatattctacttaatataataaacttactttctgtgaggtgcttgaatactttttaatggttatttatgaagtggtgaactgtaattctgtatttgtacatttggatgtacaaatagtgttgctacagttgtccttttttggtatgtctccagtgttcttaggataaattcctgaaagtgaatttcagttttgaatttcagagaaacatgtcaaagttcttctttaagcctttaagtctcctgatatgttttgtcgtattgcagcttggaaaggttgaaataaaatcttctattagggctgggtgcagtggctcatgcctgtaatccgagcactttgggatttagctgatttggctgatttatcatgccactgccacctgtatccacccaaaatccacaaaaaccccaggatacattcttagcattaaaaaaaaagttatataaatatatataattatatatatatttgagacagggcctgtctctgatacccagacgtgtgcagtatctttcaaaaatcatatatctatatatagtttgccccttccttcagtctttgctgcccctaatatctgtccttaatggttaccatggtgaaactcttggaaatcattcagggggaaaaaaaatttgtgttgggataggggagggatgtcagcataagtttttaatacttgataaatgattgccaacagaatcaaaaacaccttgttttctatcttttttcaccatataatattcttgagaataatttcgtaacagcacttaacagatataccttatttttcaaagaaggctgtgtagcattctattttaaagttgtttcacagtatatgagtctcctattgataggtatctgcatttttgtctttttgatctagggttgtttttaaggcagtttaaaaactatagtaagtaaaagaggccaggtgcggtggctcacacctgtaaacccagcactttgggaggccgaggcgggtggatcacttgaggtaggagtttgagaccagcctggcaaacatggtgaaacccttctctactaaaaatacaaaaaattagccggccgtggtggcaagcgcctgtagtcccagctgttcggaaggctgagggaggagaatcgcttgaactcgggaggcggagattgcagtgagccaataatatgctgctgtactccagcctgggcaacagagcgagactctatctcaaaaataaatacaattttaaataaaattataaaaataaagcagcacccagctttattttttatttatttatttattttttgagacagagtcgcattctgtcgctcaagttggagtgcagtggtgccatcttggctcactgcaacctctgcctcccgggttcaagtgattctcccgcttcagcctcccaggtagctgagattacaggtgtgtgccaccacgcccagctaatttgtatttttagtagagatgggggtttcaccatgtttgccaggctggtcttgaactcctaacctcaggtgatccgcccaccttggcctcccaaagtgctgggtttataggtgtgagccgccgcgcttggctcaacatcttattgtttgagacagggtctccttctgttatccaagctggagtgtagtagtgtgatcttacagctcactgcagcctccaactcttgggctcaaatgattctcctgtctcagcctcccaagtagctagtactacaggtgtgcaccaccatgccctgctgtttctttgttttttttatatggacagtcttgctatgttgcccaggctggtctcaaactcctgagctcgagtgattctgctgcctcagctactcaaagtgctgggattgtaggcgttaactatcaggttaggcctgttctgtttttattagcgtggatgactgctggttactactggccgtttgtatatccttgaattacctctttgtttttagccatttttctccatttgggtgctttttcacagtgacttctgggaatattatgttcttttcttttgatttacctttcaaattttatttttatggatatataatagttgtacgtgtacattatatattcttgaagagttaggcttattgggattccagcctttagtagtcccatgaaggtgagcaaactgaaatgtacttactagtcttagtcatttggttcgtaatatgtaatagaaatggtgcttatcctaaaagaaaaatagaaaacttgagggtgaaggatcagaaattgaagacagtaaatactgcatagaggtttaaatgctagggtttttaggttttcttttttttttgagatagtcttgctctgacacccaggctggactgcaacctctgttccctggcctcaagcgatcctcccaccttagcctcctgactagctgtgaccacagatgtgcaccaccatgcccggctatttttttttgtatttttggtagagatggggtctcgccatgttgcccagtccagtgctggattttcatatcaaaacagggctctgctacttacttgctcttgtgaccaaaatggcaagttaggtttgttttgtatttgttttcatctgcatcggggtatatgttcacagctggatcagcaaactttctgtagtaaggtagggcctggtagtaaatatgtagtatgctttgcagactgcatagggtctctgtcatatgttctttgttttctttacagccttgaacaaattaaaaaacccagtcttcagccttgtctgtagcataataaagaggaaattaaaagtgcttatgttatacgtggtacatactaaaatttattaagtggcgactggcagtttaactaattgacattctcttgtgttaggttaatacaggggttggcgtactatggcctcagtccaaatgtggcccactccatgtttttgtataggctgtgagctaagcattaagcattaatttattacttaaatcaacaaataaagtttatgtggtgtacaacatgatgttttgatgtgtgtacattatggaatggctaactcaagctaatattcattacttcacatacttttttttggtggtgagaacatttaaaatgtactcttaataattttcaggtatacaatatttgttttgtttttgtttttgttttgagacgaagtctcgctcttgtccccaggctggagtgcagtggcgctatcttggctcactgcaacctccgcctcccaggtacaagcgattctcctgcctcagcctcccaagtagctgggattacaggcgcctgtctccacgcccggctagttattgtatttttagtaaagacagggtttcaccatgttggccaggctggtctcaaactcctgacctcaggtgatccgcctgcctcagcctcccaaagtgctgggattacaggcgtgagccaccgcgcccggctacaatatgttcttaattatagtcagcaatagatctcctgaacttattcttcccagcgtcttcccaatcccacctccaccccctgctaataattaattttaaatgactggggaaaaaattgaaagaactgtttcatgacacttgaacattatataaaattttcatgtcagtgttcataaatacaaacttttattagaacatagccatactatttatatattgaaatacagttgaatttgtcatatgaccaatttattagtattgattaagatgttgagcagtttattcaagtgtggttttgtggaatgaaagagacaggagggattatgaggactctccttagcaggattgatgcatttcactttttttgacaggaaggaaagtttaggttctattttctcagcaactctacttaactgcctccatctgaactatatataggagggggtggatatcagcaaagattaacatcagtaaattttgatgaattctctaaaaattctgatttttaaagagggaattttggctgggcacagtggctcacacctgtaatcctaagcactttgggaggccaaggcaggtggatcacctgaggtctggagtttgagaccagcctggccaacatggtgaaaccctgtctctactaaaaacaaattagctgaatgtggtggcgcgcacctgtagtcccagctccttgggaggctgaggtgggagaattgcctaaacccaggagaggtggaggttgcagtgagccgagattgtgccattgcactccatcctgggtgacagagcgagactctcaaaaaaaaaggtgggtgtgaattttgttatgttgtgcgggctggagtgtagtgcccatccattggcacgatcatagagtactacagctccctaactcccagactcaagtgattctccctcctctgtctccccagtagcaggaactacaggcctgtgccaccatgcccagctttcttagtcttgagggactgcatttacacctatgccttttactctagggtcttttattcatattgctagaaatttggagaagaaagaaaggcataatctctgcagaaaagccattatttctgcagatagttctttttttttttgagatggagtctttctttgtcacccaggctggagtgcagtggtgtgatctaggctcactacaagctccacctcctgggttcacgccattctcctgccttagcctcccgagtagtgggactacaggcacccgccaccatgcccagctaatttttttttgtattttttagtagagacggggtttcaccatcttagccaggatggtctcgatcttctgaccttgtgatccgccgacctcggccacccaaagtgctgggattacaggcatgagccaccacatccggccaatttctgcggatagttctaagctttagttttgaccacgttggttgcctatggccaattcctggattatttgcatgtttccagacacagctatgtgaaagcagggtttgttttaatagtgttttgagcctttgattccagttctgcttccactcttggtctataaggatccctatggcagcaacagaatggcccagccctcatgattggttgcttaaaaaggctttaggatattcaaactgggtggcctgtcttgtttggaataggactaagcatgtcacactttcaccatggaagagttaatccatattctatctgtaagttgtatctccagtcattggttttcaacaagtggtcctatcttaggaggagtggtatattagaacagtccttccagagtaatttttttcattatttcagattttttagttttttttgtttttttgttttttttttttttttaaaggctctcactctgtcacccaggctggagagcagtgatacgatcatagctcactggaacctctacctccctgggctcaggtgatcctcccacctcagccttctgagtttctgggactacaggcatgaaccgtgaggcccagctaatttttgtgatttttgtgttttttgtagagtcagggtttctccatgttgcccaggctggtctcgtactcctggtctcaagtaacctgcccgcctcggccttccaaagtgctgggattagaggtgtgagccaccacacctgtactactacttttagtttgaacactatatttaaatctaataattcagacatggcccatttcatacttgacagaaagtatgagtcaaagactcaaatcattcagattctcacatatgtaaaacgtacgcttggccgggtgcagtggctcacgcctgtaatcccagcactttgtgagaccaaggtgggcggatcacctgaggtcaggagttcaagaccagcctgaccaacatggagaaaccccgtctctactaaaaatacaaaattagctggggtggtggcacatgcctgtaatcccagctattcaggaagctgaggcaggagaatcacttgaacccgggaggtggaggttgtggtgagctgagatcgcgccattgcactccagcctgggcaaaaagagcgaaactctgtctcaaaaaaaaaaaaaaaagcaggcttataaaataaaacaaaaatgtcccttatgatttgtcttaaaggtagttgaattaataagagctaaatctagtgtcccatacatctttgtgtttcttactctaccctttagaaagggtgggggtggacgtggataaggcacacagttaattcagggacggtggagtcttggtacttgctctttttccctgaccttgctttggagttattttattttttaaattctgcatttggcatgctattatcacttgcttactactataggtcctattttatctgttgcctagcatattctcatagtgcctaaaatactctaaaagctatttccagagggagctttaatgagacatacaatgcttaatctctcaaatgtaaatgtactagaacaaagcattctggggaagaaaacagtggttgatttaactgaactcacttttccaaaacagtggcttttgattttctgtaaacattgactttattaagcttttcccttgctactatatgcactctctatttcttaaattgcaaagagttattcatgaaatttgtgataaatatttgaatctaaggcaacgtttttggattctttatacgaggtttttagcagcatgtgtacatgtatgtgatagctgttaacggaattcacttaagttttacttagaagcctgggtagtagaacctagaagttgcagtgggaatttttttttaatttgaaagattaaataggtaaaaagtcatctttaatctctattaaacttttttgtgtaatgtcagaagtgaaagttccccacatctgcttacagcctgtttgtatccttcctgacttgattgattaaatggacatctctatatacatatgcatataatttcaatttttgcttagtaacaaaaacaaaagttacacatactggtgactaatttgcttttttcacgtatgtcatgaaccattttccagggcagttcatctagatctccctcaattctttttaatggctacatattccactattatggatgtaccatatttatacaaccggttccctattgatggacatatggttgtgtctagttttttgctagcattgtgatagattagagcctgtaatgaatggtaaggaagtaagtagatgatagcactactactttgaaggaaaaagtagagaataaacttcctttgccatagtcacttactaaatggaatttaataaaaacactgtcaaaagttgggaggaccaaaattgatactttttctctgatctttttgccatgtgtatatctgaattctttgtttttaaagaagaaacagcattgaagcattatttggggggaaaaacacacacacaaaatccagcaactcagcattcatgagcaactctatactataccagtatgtgcctgtgcagtggaaggaaaacaattttggtaaggattaaaactttagctttaaacttccagcaggttgatattctaatgaatgataaatcaaaaaaaaattttaaatattcttgtattgacagtgcttttttttttaaatcaccctaccttgatatctgtaattttagtttaaactttcccatttttctttaaagaaaaaaatctgaatttgcagccaacaaaaattagatatcctaaggttgtattacttctgacttttattaaaatatcaacatttcttagagatgtttatgggccgactttgtctttttcttcaaggggccaagttcactaattgctgagttttatgcatatgacagcaaccgtccttttgtaggtgtgtgtcgcatccatctagatactttaaaatgctcatctatttcatttttaaaattatgtgtgtgggattatcagtatttttttgttaaacatatgacatctgtagtttatttcactaatgtaaattttttctaccatttgcttgatacaggaaatatatcctggacaattccagccatctctctgtcacaaattcatagccttgtcagataaggaaggaaaactacttcgcaactatacccagaacatagacacgctggaacaggttgcgggaatccaaaggataattcagtgtcatggttagtaaacttcagagtggttttctgtaatttattttagttttataggaagatatttcctataaagctgactgccatcgagaagtggagataaagcattatttaatcatgttatctcatttatcgataacctcagaaaagtagaaaacaaaaataataaaaacagaagtattggccttgacagttaattatagaaaacctcagatattaatttgcttttgatttcaaaagatgctgcagttgcatgcattcaattattttaaataatcttttctggctgagtgcagtggctcacgcctgtaatcctagcactttgggaagccgaggcgggcagatcccatgaagccaagagttcgagaacagcttggccaacatggtgaaatcccaactctactagaaatactaaaattagccgggcatggtggcaggcgcctgtaatcccagctactcaggaggctgaggcacgagaatcacttgaacctgggagttggaggttgcagcgagccaagattgcaccattgcgctccagcctgggagacagtgagactctgtcaaaaaaaaaaaaaaaaaagaaaaagaaattctgaatacaagagtagtattagctgttaatgaagaaatgtgacatctttagtttatgaaactaaaagaactggatagttgagatgtacaggattcagagattcagaaatgtttaaaacaagtatcaacaggccattaggtatctaaagtgtttctaagaactgccgagctaaggtaatagagttggaactgtccaactctgcaggattttagccctggaggagtgagctgttacagttttgttgaaaagagtagctttagaaggcatcattatattagtgtctcagagattgagaatcatattcattctatgtataaatatataaattcttcatcccctagattctcctgtagtatatcacaaaatctgcagtgtgttctgaggtttaaaatcaaagttaaaaacaaaaacaaaaatccttaaaccctcttaacatttgtgatgttaaactttataacgtttgtggtgtgttcaagaaacagaaatacttctttaataaagcatatatatgttgtttgtttttaggttcctttgcaacagcatcttgcctgatttgtaaatacaaagttgactgtgaagctgtacgaggagatatttttaatcaggtaatttgttgcccatattttaggaattgttcatgtctctgaagtatttcttcttttgcctcaaaatccttttttacccctttaaagtatatatggtacagaaagattcaggaagaaaatagttagcattttggaattttggtaaaatacacgagaacctttcaataccttatatagaaaacagccctataaaggctcttcaaattatgaaattggcttcttagtatctaagccgaacataaaatgtcagatcataagcaagttgttgttgtagtagtttttctccttcctctccctttttgtgcctgtcagatttggaccttaaattagttatggtaatctaaaattatttcatacatgttcattgccaaaaaatataggaaaatttggcagaaaataaaaattatccagaaatatgtcctgtgtgcttagcaatatatggaggtaatcatgtcattacgaaagaggaagaatagtatattaaaatggagtcattggtcgggtgcagtggctcatgcttgtaatcccagcactttgggaggacgaggtgggtcgatcatttgaggtcagaagtgagaccagcctggccaacatggcaaaaccccgtctctcttaaaaatacaaaaattagcctggcatggtggcatatgcctttaatctcagctgcttgggaggctgaggcaggagaattatttgaactcgggaggtggaggttgtagtgagctgagatcatgccacttcactccaggctgggcaacagaacaagactccatctcaaataaataaaatggaatcattttatttgacaaatgtctatttttttttgaaaggatcaattcccatttagtgtatatacacacattatgtttttcctcttaatatatgatggactcttcaatgtcaagtgtttttctacatagatattataacaagagcatagtatttcattgtttcatagtatgttaataaactacccatcattgacagttgctgtttatccatagcttttctgttttgttttttttttaataattctgaaatgtattcttagaggtatggaaatgttgactatttctaacttgggcttactctttgcttctctacctcaaccaaaatctgaaaatatgtaggtagttcctcgatgtcctaggtgcccagctgatgaaccgcttgctatcatgaaaccagagattgtgttttttggtgaaaatttaccagaacagtttcatagagccatgaagtatgacaaagatgaagttgacctcctcattgttattgggtcttccctcaaagtaagaccagtagcactaattccaagtaagttggtgatggtttttggagaacatttctatatataatgtcatgggttgtgggtctgtataatagacgctagtaatcttaactctgcttctgtttgaaagagtggtgaagagctaattttagaaattgtttgtttgtttgtttattgagatggagtttccctcttgttgcccaggctggagtgcagtcgcatatcttggctcactgcaacctccgcctcccgggttcaagcgattcttctgcctcagccttctgagtagctgggatcacaggcgtccaccaacatgcctggctagtttttgtatttttagtatagaccgggtttcaccatgttggccaggctggtctcgaactcctcagctcaggtgatccgcctgtctctgccttctaaagtgctgggattataggcatgagcccccatgcctggccagaaattctttatttttagtagagatgaggtcttgttgtgttgcccaggctggattcgaactcctgggctcaagtgatcctcctgcctcagccccttgagtagctaggattacaggcacgagcctccacatctggctgaactgtttttttaggtggcattgttcattgagactggtgaatctgacattttgatggggggtggagggttgtcaaaacgcaagtaatgttggtggctcgtgcctgtaatctcagcactttgggaggccgaggtaggtggatcgcttgagggcagcagtttgagaccagcctggccaacatggtgaaaccctgtctctactaaaaatacaaaaattagctgggcatagtggtgtgcacatgtagtcccagctacttgggaggttggggcatgagaatcgcttgaactcaggaggcagaggttgcaatgagccgagaatgtgccactgcactccagcctgggtgacagagtgggactctgtctcaaaaaatcaaaaacaaacccagaagtaatgctaaactctacttctaatttatgtgaaaaattaagacaaaggtagagttcaacttagactttttggtggaatgtgtttttaatgttgcaagggttagcatcaattaatttatgaaatggtcctttatccttatattttttgattacagttttgatctttcaaatttaattgatttcacatttaataaattcaaatgtatagtttggtagaagtgtaacataccatgtaagatggaatttgggggctcagaatgattggttcattcttgtagtaacagccatgccataacggtgatatgtcgatatagtttacccaaaagggtgtgtatataaaagtgttcacataaaatttaaatccttattactctcaggaaaatttctttgtcatatatattctcatactgtctgtttcctcctctagtttagaatcagaggaggagagagagagatttcagttgcatcagatgtgtcctttcataagtgagggaaagaggagaggaaaaatattaaatccctagccagagaattgaattagaccccacatcagcagtcaaggcagccagagtaaacagttggaagaaacatggagtcaagctcttcaattttgtgtctatcccatatctcgtggctttagcagttaactcagtcttacctaattagctgtgaaattctgttaaagtagaatacaagacaatttgcaattaaatgaaacatgaaaatttaatatacaaatctctttgttcttgagttgctcttcttaaagcaaaatcaaaggcactctgcttaaaagcttttctttttattttttagagacgggtgtcttgctgtagctcaggctagagtgcagtggtgcagtttcagctcactgcagccttcaactcctggggacaagcagtccttccacttcagcttcctgagtagttaggaccagaggcgcacaccatgcttggcaaatttttaaatttttttttgtagaaacgggattcactttgttgcccaggctggtcacaaactcctggcctcaagtgatccttcctcctctgcctctcaaagcattaggattacaggcatgagctaccatgcctggtccttaaaaacttttctttcaaaagctttctgtgggatagtatgatgtgttgcaaagataattaaaaaaagaaacaggtttataatagcgtagaatatgtttatatgactttttccctccccccctcccctccctccctcccttccgtttgtccttccttccattcatccttccttctgttagtccttccttctgtccatccttcccgtccgttcttccttccttccttcgtccatccttctgtctgtccttccttccgttcatctgtccgtccttccttcctcccaccctccctccctccctcctatcctccctccctccctcattgcccaggctggagtgcaatggcatgatctcggctcactgcagtctcccgtgttcaagcagttctcctcccaagtagttgggattagaggcatgcgctaccacacgcccggctaattttgtgtttttagtagagatggggtttcaccatgttggtcgggttggtcttgaactcctgacctcaggtgatccgcctgcctcggcctcccaaagtgctgggattacaggcgtgagccactgtacccagctcaccttctttatatcaggagctacttaagtagaacatttatgtaccaagaactcttctgtgcacttgactaactcatttaatcctcaccacagtcttgtggagaagtactattatcatccccattctgcagacaaggaaatttgaggttcagagtgggaaagtctgggaagattgctcaggggtaaccaggtgataggagcagaacttgagcgttttataaaagacacttaactgcccatctgcttgcttgatgaaatgtaatggcttggttaagtatttagtgcatgggtcttttttgggaatttggagctcaagcccttgttggatttttgcataatgtatctgttgtggttttattagcttacttcctcctccctttttctaactcttatttttcaccctattttaggttccataccccatgaagtgcctcagatattaattaatagagaacctttgcctcatctgcattttgatgtagagcttcttggagactgtgatgtcataattaatgaattgtgtcataggttaggtggtgaatatgccaaactttgctgtaaccctgtaaagctttcagaaattactgaaaaacctccacgaacacaaaaagaattggcttatttgtcagagttgccacccacacctcttcatgtttcagaagactcaagttcaccagaaagaacttcaccaccagattcttcagtgattgtcacacttttagaccaagcagctaagagtaatgatgatttagatgtgtctgaatcaaaaggttgtatggaagaaaaaccacaggaagtacaaacttctaggaatgttgaaagtattgctgaacagatggaaaatccggatttgaagaatgttggttctagtactggggagaaaaatgaaagaacttcagtggctggaacagtgagaaaatgctggcctaatagagtggcaaaggagcagattagtaggcggcttgatggtaagaaaggcagtcggaccattttgaaagtataaatgtcataacagtatttccaaaaaattagctatttcggcaggttaatcgatagggtagctttatgtagttgattctgtttagagaaactgtacagttcgtaatcagaaaggtaaatcttctggtatcttaacatgatatggagaaggaagtgtttaatagtgctctgtatgttgtgtttctctaggggatggaaaaataagaatgggttattagctggcagaaatgatgacagatttgagtgcttactgtaggtcagctgctttacatatgttacctgattttaatctgaggtaggaactattactcttcttcaggtgggaaaactcaggaccatagaggttaaatacctcatgcacagtaactactaagaagtggaagaaccagattaaaatccagtctatttatgcttagagcctgcccccttaactactatgcggtgttgtctcagatgtagaacacatctttgttttctctgaggacttagaaaaaacacgcgtgattcttctccactgaatataggaatagtttctaccctgtttagaacatgcatagtctttatcaataagtgttaactgacatgtgaaatcactttctactctttggaagccgatgttttaagtccaagtagtctgtatggtggaaattcctaacttatgttaaaaaaaagaaaaccactgtaacttagctataacagtcttatataacttagaactttaagtctcattccatttaccatacttggcgaaaactgacaaattttagacaactgtatttgagtattccagtcatttgctgtaaatacattttagttcagttgaataaacctttggcctttttcatattaggcactgtggtaagttatggagacacagtgattaatgttgtgtataattataaatgtgagtgatactcattaatactttggtataggtgctgctgaagaacaaagtactttattattgttttgaacaaaacatcacacaaaaggtagattttttttttttttttttttttttttttttgtgacggagtctcactctgtcgcccaggctggagtgcagtggcacgatctcagctcactgcaacctctgcctcccaggttcaagagattctcctgcctcagccttctgagtagctgaaattacaggcatgcgccaccttgctcggctgattcttgtatttttagtagagacggggtttcgccatgttggtcaggctggtctcaaactcctgaccccatgatccatccacctcggcctcccaaagtgctggaattacaggcgtgagccacggcgcccagccccaaaaggtagattctacttggagattagattacagaaggctttctaaggagcaaaatatttaacaataagtagggatttaaaaagagcagacgtgttcacaggggaaactagaaaaagcatagagggatgcttacgtttgcaaatcgtggcagaagtcagaaagtagaaaaattgctactgacttagatacacagttgtctctagcgtatacaaagtctacctatgcactaagacttgcactgggaacttttcttgaatgtcattttgacagatgtgtcaaacggacaatctctttgcccaggaaacagagttaacctggaacagtcatttttttttaaatttatttattttttgagacggagttttgctcttgttgtccaggctgaagtacaatggtgtgatctcggttcacggcaacctccgcctcccgggttcaagcgattctcctgcctcactctccagagtagctgtagctgagaccacaggcgcatgccctcatgctcagctatttttttttttttttttttagtttttgtagaaacaaggtcttgccacattgcccaggctgataccaaactcctgggctcaagcagtctgccagccttggcctcccaaagtgctgggattacaggtgtaagccactgtgccctgcctgtggtgtcttgggaaactcatgagtactatgtgtctgttgtaatagagggaaataagtggttttcacagtgatttgtagtggactgtgaaattttagggattcaggtcagagttgtcacacaggttgtagtcagggtgagaactgggtcatgatgcagtatgaaaaagttcgagagccactttggagagaacttgagataggccacctaccagtgtggtaaccaggcttttgagaattcgtctgggatacggtacaataaatactatatctattatgtgtgaagagatgttaagttagggacatactgtgaattcaaggatagaaaacttttccatcagtttttagggatcctactctttcacttaaaccccaaatggccaagctaggattgatttggtgtgctgtagaaagaacttcattggtattcatggattcacattacatcttagaggagttttcaaaagcgtcttagactgtatgtgtatatacacacacattctgaagcagtaggtgggtcttggggcctgagatctcgggtgaatctaaatttaggttcacaggtgatactgtagattcacagtgtctacagagtacactatgaatttgtggtgactacattattgacaaaatattttaggtttataatcagaaaaaagttaaaatagttaatgaagatgctttaaaagcctgtgtactttagagaagctacttaacacaaattgggtatctaatgtaggctgggctggatacttcattttcatcaaatctttttaaaataattggtgaaataacctttattgaatatggttttctacatttttcacacttccctccttcatagggttgtgaaaatttatttcatattctagatgaggaaattgaggcacagaggtacacttacaaagatacaataaatggcagaactaagatttgaacccaggactaagtgtattgcttgtatttatttaattaattaatttttaagagacagggcctcactctgttgcctaggctggcccttgaactcctgggctcaagcagtccacctgcctcagcctcctgagtagctgggactgcaggcacaccatgcctcccagttgtttttaaacactaatagtagtctttcataaggacacttataataaaggcagagctggaacccacacttcattccagactgctcagactgagttagtgttagaaaactgaaagtaacatttttattactgtatttcaggtaatcagtatctgtttttgccaccaaatcgttacattttccatggcgctgaggtatattcagactctgaagatgacgtcttatcctctagttcttgtggcagtaacagtgatagtgggacatgccagagtccaagtttagaagaacccatggaggatgaaagtgaaattgaagaattctacaatggcttagaagatgagcctgatgttccagagagagctggaggagctggatttgggactgatggagatgatcaagaggcaattaatgaagctatatctgtgaaacaggaagtaacagacatgaactatccatcaaacaaatcatagtgtaataattgtgcaggtacaggaattgttccaccagcattaggaactttagcatgtcaaaatgaatgtttacttgtgaactcgatagagcaaggaaaccagaaaggtgtaatatttataggttggtaaaatagattgtttttcatggataatttttaacttcattatttctgtacttgtacaaactcaacactaacttttttttttttaaaaaaaaaaaggtactaagtatcttcaatcagctgttggtcaagactaactttcttttaaaggttcatttgtatgataaattcatatgtgtatatataattttttttgttttgtctagtgagtttcaacatttttaaagttttcaaaaagccatcggaatgttaaattaatgtaaagggaacagctaatctagaccaaagaatggtattttcacttttctttgtaacattgaatggtttgaagtactcaaaatctgttacgctaaacttttgattctttaacacaattatttttaaacactggcattttccaaaactgtggcagctaactttttaaaatctcaaatgacatgcagtgtgagtagaaggaagtcaacaatatgtggggagagcactcggttgtctttacttttaaaagtaatacttggtgctaagaatttcaggattattgtatttacgttcaaatgaagatggcttttgtacttcctgtggacatgtagtaatgtctatattggctcataaaactaacctgaaaaacaaataaatgctttggaaatgtttcagttgctttagaaacattagtgcctgcctggatccccttagttttgaaatatttgccattgttgtttaaatacctatcactgtggtagagcttgcattgatcttttccacaagtattaaactgccaaaatgtgaatatgcaaagcctttctgaatctataataatggtacttctactggggagagtgtaatattttggactgctgttttccattaatgaggagagcaacaggcccctgattatacagttccaaagtaataagatgttaattgtaattcagccagaaagtacatgtctcccattgggaggatttggtgttaaataccaaactgctagccctagtattatggagatgaacatgatgatgtaacttgtaatagcagaatagttaatgaatgaaactagttcttataatttatctttatttaaaagcttagcctgccttaaaactagagatcaactttctcagctgcaaaagcttctagtctttcaagaagttcatactttatgaaattgcacagtaagcatttatttttcagaccatttttgaacatcactcctaaattaataaagtattcctctgttgctttagtatttattacaataaaaagggtttgaaatatagctgttctttatgcataaaacacccagctaggaccattactgccagagaaaaaaatcgtattgaatggccatttccctacttataagatgtctcaatctgaatttatttggctacactaaagaatgcagtatatttagttttccatttgcatgatgtttgtgtgctatagatgatattttaaattgaaaagtttgttttaaattatttttacagtgaagactgttttcagctctttttatattgtacatagtcttttatgtaatttactggcatatgttttgtagactgtttaatgactggatatcttccttcaacttttgaaatacaaaaccagtgttttttacttgtacactgttttaaagtctattaaaattgtcatttgacttttttctgttaacttacattgtttaaggtatataatttttaagtcttgcagaatttgtacagcttcgaatgctatagtattagatgctttctttctcatactacatttcttcatttggtttattacattagtctcaccagaccagtacttgcaaaaccctgatggtgctgatcgtagcaggtgatgcatcaccaccaagcatttcaaaaactatttcagccattctaggctagaggcctgagcaagtaaaacatggagaaaaggcagggcagggcctaagaaggatgtgacatgtcctatgataaaggaccaggagtttgggatttgagagagaacaggaagtggtggatagtgaaaatccatctgatgcaaaggctgggttaactgaaaatctgttctgggatgctaggtctttcaagtctgaagactgcagaccacatttggtatcaactttctgaggctgacctgagaacctacttaagccattaaaggttttgagggcgaaagtattactgaagaggccagcagtgtaccccttaaaatgtatgtgtaacttggtcgggtgcagtggctcacgcctgtaatcccagcactctgggaggcctacacgggcggaccacctgaggtcaggagttcaagaccagcctggccaacatggcgaaaccccgtttttactaaaaatacaaaaattagtcgggtgtggtggcggcacctgtagtcccagctatttgggaggctgaggctggagaatcgcttcaacccaggaggtggaggctgcagtgagccaagatcgcgccactgcactccagcctggtgacagagcaagactccgtctcaaagaacaaaaaagtatatgtaatgaataaagctttagcaatttcctgttcccagttctgcctccctccccagcaaactttctaggtagacctgtcctgtatattgttagcactagagaaattacctgtaagatgatatcctcaaaatattacaaaattaaggaacattctatatatgcacaaattgaagaagtcaggtagttgatacttttaaaggtacatagtcaatttaagtggtcaaaaggtatttggcaaaacctaatttaactcaagccctatgcataacgttattgctgaaccactggctaatgcagcatgtactgtatttcactgattgtaataccctaattaatgtcacatggtttaattagcgtttttttttgtagtggtacataaaatgacggtggaccttcaatcaatggtgttttacataatccccaactaagctttatttgaaacacaacttctgacctgtaatctagaaaggggtgggggagtatgtatatgtatgtacaccaaaacctctcccccaaagatctaaagccattctaggccttcagctcaaactaggatactagtagaaagtacagaaaaatggtctaatgacctccccaccttttgaagtgactgtcaaatgagactattaaaaaccacttgaaaacttttaaaaagcaagaatagcctgagacctcctagaaatacagatttaattggtgtaaggtggggtttgtgcagagtattaaaaacgcccccaggcgattcaaaagtatagccagatttgagaaacacccttagctggaaaagaattgaggagctctgttttgatgacttttaacatacactccttagggctggcctaaaaaaggaggttaacttacattagcctcaattcccaaattttacctagaaatgcttcataaattaggtaatttggggttcataagcaaatacagcagagtagggagctatcaaaatagagtgaattcttcagcaaaggaggacaaaactaccataaggcattctggatggtcaaagtgcaaaagaggttggggagtggaggaagagactgatgacaggaatattttgctcttgttttagcaggcttaccatgcactcttcaggggaagactgctctatgccatattacaccttgattcacagctttactaaatgt

SEQ ID NO: 12693 - DNA, 14883 bp, Human
aaagatacaatgatagaaccaaaaacctaaaaactctttctcaagcttccacattacttctctgcacttcagttcatctttatttattattattattttttgaagagatgggatctcactttgtcacccaggctgaagtgcagtcgcacaattatggctcactgcagcctcgatctcctgggctcaaagtgatcctcccacctgagcctcttgagtagctgggactacaggcacacaccaccacaccccgctaattttgtttattttttgtagtgagtgggtctcactatgttgcccaagctggtcttgaacttttgggctcaagtgatcctcctgccttggcctcccaaagtgttggtattacaggtgggaaccactgcactcagcccaattcatcttaaaatgggggaagggagtccttaggtggtcttcaaggtccctgctggccgcccacctttatgtccaaagacacttatacatttattgatttaggtgatgctgcagagcggcagttctggttgtctacacattaggaacaattaggaaatttgtagatcagaatccctgggagtgagacgcaggccttgtttgattaacttaataaaaaaaatatgataaataaaattggagaagccaagcaggttaagtacattagtccaggtataatatatttggcttcatattaactgtaaaaacatcacttttggctgggcacagtggcttacgcctgtaatcccagtactttgggaggctagggtgggcagatcacgaggtcaggagatcaagaccatcctggctaacatggtgaaaccttgtctctactaaaaataaaaaaattaaccgggcgtagtggcatgcgcccataatccctgctactcaggaggctgaggcaggagaattgcttgaacccgggaggcggaggttgcagtgagccgaaatggcaccattgcactccagcctgggcaacagagcgagactccgtctcaaaaacaaacaaacaaacaacaacaacaacaacaacaaactatcactttttcagatatgtataaacacatttcttcacaagttcaaggtattttaccaatagcaaataacttgatactgtcgttgtgaatgaaaaggatcacaaactctgatgtttagaatgagtcaaatctaggccgggaacagtggctcaggcctgtaatcccagcattttggggggccgaggttggcggatcacctgaggtcgggagttcgagaccagcctggccaacatggtgaaactctgtctctactaaaaatacaaaaactttaaaaaaaagtcaaatctagatccatgattaatgacgtgctcatttcacattgcatgtttgtatcaaaacatctcatgtgggtaaagcatagacaggcacagagaaaagaaaaaaagacaaaaaataagagaaaagatggccgggcgcagtggctcacgcctataatcccagcactttgggaggtcaaggcgtgcggatcacctgaggttaggagttcaagacgagcctggccaacatggcgaaacccccgtctctactaaaaatacaaaaataatcccagctactcgggaggctgaggcaggagaatcggttgaacccgggagagggaggttgcagtgagccgagatcgtgccactgcactccagactggagttttttcaaaaaaaaaaaacaacaactccgtcttaaaaaaaaaaaagaaaaaagaaaaaaaatcttatgtacactataaatatatacacctactaagtgcccacagaaattgaaaacaaagaaaaaaatccatgattaaaagcttttatattaacgggggaacctctgaccagaaagagccgacagggggcgttcctggatgatctggggctgtcaattgcgagacgcggaggattgtgggacttgtggtttttctcgcatcatttaagctttctggactacatgtcccaaaatgcaaatgcaatcagacggtcccactgtggggtgtgaagtgtccgtagagctgtgagaggtaagtgtgttctgtgtgtgctgcggatttctagaagttgtggatttcttgtgagggattctatttctcctctttgccctcggtgggacctggaagagagtagttgttccactgatgcacgttttcagcgggggtttcccctgaccctttggtctcgggaaaccggactgtgtgtttgttcagctgttcacgttttgctgtggaatgtcaaggagaaagcggggtcctgatctcagatctggaaagccaaacataaaataatgtttacatacggggtgcatgtcactagaggatttatgcattgcattgtgtcaaataatatgtcaaagttttttctttttctttttttttttttttttgatacggagtcttgcttcttcgcccaggctggagtgcaacggcgcgatctcggctcactgcaacctccgcctcccgggttcaagcaattctcctgcctcagcctccctagtagctgggattacgggcacgtgccacaatgcccggctaattttttttgtatttttagtagagtcggggtttcaccatgttggccaggcatgtctcgaactcctgatctcaagtgatctgcctgcgtcggcctcccaaagtgctgggatttcagacgtgagccaccgcacccggccctctattgttacagctagaaaagctgacgggcaggggtcttgtctctctgatgtgtccaagtagcagagcttgcagtggagggtaaactaaaataagggggaaatgaaaaaataaaaggaatgcgtgtgtgtgcttaattacatgaacaaaatcaaacaaaacctgactcattagggccagactcagaggctcacacctgtaattccagcacgttgggaggccgaggcgggcagatcactagagctcaggagttcgagactagcctggccaacatggtgaaaccctgcctctactaaaaatacaataattagccgggcatggtggccatgtagtcccagctattctggaggctgaggcaggagaatcacttgaacccgggaggcggcggttacagtgagccaagatcatgccactgtactctagcctgggcaacagagggagactctgtctcaaaaaacaaaacgaaaacaaacaaacaaaaaatgagaaaaaaaaaaaaccaccccagtttctcacatgaggcttctttttctctagaatgaagatgagctttgcgttgactttcaggtcagcaaaaggccgttggatcgcaaaccccagccagccgtgctcgaaagcctccattgggttatttgtgccagcaagtcctcctctggaccctgagaaggtcaaagagttacagcgcttcatcaccctttccaagagactccttgtgatgactggggcaggaatctccaccgaatcggggataccagactacaggtcagaaaaagtggggctttatgcccgcactgaccgcaggcccatccagcatggtgattttgtccggagtgccccaatccgccagcggtactgggcgagaaacttcgtaggctggcctcaattctcctcccaccagcctaaccctgcacactgggctttgagcacctgggagaaactcggaaagctgtactggttggtgacccaaaatgtggatgctttgcacaccaaggcggggagtcggcgcctgacagagctccacggatgcatggacaggtgcaggagctgtacacggtttgaacgcaaacccgtgtgttgttttgggagagtagggaccttggctgtcttgatcaccacagtcttagaccttgagaaaaggatttcagagcaagttgtttattttgcagttgattccagtaaattcattgacggagcaaggatgtaaaacaggaaagagaggaaagccaagaaagtgtgtgttaatgagtgggttactgccttgggcactggggttcagtcctgtgagggaccctccaactgtctaggacatgcctgaggattgtctcaatgaaacttgaggactggggccgggcgcagtggctcacgcctgtaatcccagcattttgggaggctgaggtgggcagatcacatgagctcaggagttcgagaccagcctggccaacatggtgaaaccccatttctactaaaaatacaaaaattagccggtcgtggtggcacatgcctgtaatcccagctgcttgggaggctgaggcaggaaaatctcttgggaggcagaggttgctgcagtgagccgagattgcaccactacactccagcctgggcaacagtgcaaaaaaaaagaaaaaaagaaaaaaaaaagttgaggatggtgcacagtggctcatacctgtaatcctagcactttggaaggctgaggcaggaagattgcttgaggctaacagttcaggaccaacctggcaaacacagtgagactctgtctctatataagtaaagtaaattttatatatatatatatatatacatatatatatattttttttttttttttttttttttaaagaaagttgaggccgggtgtggtggctcacgcctgtaatcccagcactttgggaggccaaggcaggcagattacctgaggtcaggagttcaagaccaatctggtcaacatggtgaaaccccgtctctactaaaaatacaaaaatctgttggaagtggtggcacgcacctgtaattccagctactcaggaggctgaggcaggagaatcgcttgaacctgggaggtagaggttgcagtgagctgagatcatgagctgagatcatgccaccacaccccagcctgggcaacagagcaaaactccgtctcaaaaagaaaaaaaaaaaagaaagttgagcaagctagggtgattttcttttattttcttttgtgtttgtgtgtgcacgtgtgtgtgtgtgtgtgtgtgtgtgtatgacaggctttcactctgtcacacagactgggatgtggtggtgtgattatagctcacttcagcctcaatctcttgggctcaagtgatcctttcaccccagcctcctaagtagctgggactacaggcaaacgccaccgtgcccagctaatttttaatttaatttttattttttgtagagacgaagtcttactatgttgcccaggctggtctcgaactcctgggctcatgtgatcctcctgccttggcatctcaaagtgctgggatgactagtgtgagccactgtgcttggccttgaagctagggtatttattcaccatctctcatccctcatgggtccaggatcactctaggggaattaattccctaacattttgactctgctcctcccaaggaggcttccgtgggcagagaacatctgaggcaagagagacacaggaaactgcttgtaagaaaattgtgtaggctgggcgcggcggctcacgcctgtaatcccaacactttgggaggctgaggcaggcggatcacgaggtcagttgatcgagaccatcctggctaacatggtgaaaccccgtctctactaaaaatacaaaaaattagctgggcgcggtggcggacgcctgtagtcccagctactcgggaggctgaggcaggagaatggcgtgaacctgggaggtggagcttgtggtgagccgagatcgcgccactgcactccagcctgggtgacagagcgagactccgtctcaaaaaaaaaaaaaaaagaaagaaagaaaattgtgtccaccagggtgctgtggttcatatctgtcatcccagcaactcaggaggctgaagcaggaggattacttgaggccaggagatcaagacctgcctgggtaacacagccagactccgtctctacaaaaaatttttttaagaaaggaaattggctgggcacggtggctcgcgcctgtaatcccagcactttgggaggctgagttgggcggatcacctgaggtcaggagttcgagaccagcctgaccaacatggagaaaccctgtctctactaaaaatacaaaattagctgggcgtggtggtgcatgcctgtaatcctagcgactcgggaggcttagacaggagaatagcttgaacccaagaggcggaggttgcggtgagccgagattgtgccattgtactccagcctgcagcctgggcaacaagaacaaaactccgtcaaaaaaaaaaaacaaacaaaaaaacagagaaaggaaactgggacgggtgcggtggctcatgcttgtaatcccagcactttgggaggcagaggcaggcagatcacttgaggtcaggagttcgagaccatcctggcccacacggtgaaaccccatctctactaaaaatacaaaaaattacctgggcatagtggcgcacgcctgtagtctcagctatttgggaggctgaggcacgagagtcgcctgaacctgggaggcagaggttgcagtgagccaagattgtgccactgcactccagcctggacaacagagtgagactctatctcaataaaaaaacaaaaagaaaggaaactgttcgaacgtggcctttagcatgttctgaggaaaatatgagctgaacaccaatagcatgtgctataaactgctgggtttccaatgcctaggatggctagatacatagaccataacgtagccgggcagtagtcagaactcaatcaataatgagggaacagatacatgggagggtatcatgcttatgggtctggcaataattgtagctaattggagacttatttctttaagccctagagaggctcctctgagggctgaagtcagtctgccaatgctgaaatatttactgggtgcctagaatgtatggtgtacatacgttacactatgtagtacattataacactaactactgtgcttcttagtggtcagaaccaaagtataggctgggctcagtggctcacacctataatcccagcattttgagaggctgagggggcggatcacttgagctcaggagtttgagaccagcctggccaatatgtcgaaacccagtctctactaaaaataaaagattggccaggcgtggtggcgggcgcctatagtcccagctactcgggaggctgaggcaggagaattgcatgaacatgggtggcagaggttgcagtgagccaagatcgtgccattgcactccagcctgggcgacagagggagattgtctcaaacaacaaacaaaaaccaaagtataaaacatggcccactttatatgcaagaactttgtaatatttgggaagacacaaaaataacataattggccgggcacggtggctcacgcctgtaatccgagcactttgggaggccgaggcaggggatcacctgaggtcaggagttcaagaccagcctgaccaacacagtgaaaccctgtctctactaaaaatacaaaattagccaggcatggtggtgcatgcctataatcccagctactcaggaggctgagacaggagaatcatttgaacccgggaggcagaggttgtaatgagctgaaatcgcaccattgcactccagcctgggcaacaagaacgaaactccttctcaaaaaacaaccaagcaaacaaacaaagaaaagcacataattaatgataaatgacaacgcatgattgtgaaattgtgtggttcttgatttatatgctgtgcatgttcaaataaacagatttagtaaagattggaataatcagttgagaaagctttttaaaaaaaaaatttttttttttaaatagagacaggatcttgctgtgttgcctagtctggtctcgaactcctaagctcaagccctcctcctgccttgatcttccaaagtgttgggattacaggtgtgagccaccatgcctggcccaagaaagctttttttttttttttttttttgaaacacagtcttgttcttgttgcccaggctggagtgcagtggcacggtctcggctcactgcaacctccgcctcctgggttcaagtgattctcctgcctcagcctcccaagtagttgggattacaggtgcctgccaccacccccagctaattttttgtatttgtagtagaggtagggtttcatcatgttggccaggctggtctcgaactcactcctgacctcgtgatccgcctgcctcggcctcccaaagcgctgggattacaggcgtgagccacagcgcctgccccaagaaagcttttatgggtacagggggcttgagattggctcaggtttgtctaggcaagagcgggaaacagggctttccaaatgaagggaagttgtagatcccagaggagtctggcctggcctctgtagaggtttggacctgggacttgcagaaaccagattgtctgggaaagttaggcccaaatcatggttacatttgaaaatcaggcagtgcagttgggtctgctgtgagacaccaaaggggtttattagtggtttctgagcaagcaagcaacatgataaaaatagcatttgaggaaggctaaacaggattaaaaagagcaggtcagggaggtcagcctgaaagacctagactaaggtggtatccagggaatttgagttaatgatgcttatggattcattaaaacaattttttccgccgggcgtggtggctcatgcctgtcatctcagcactttgggatgccgaagcgggtggataacctgaggtcgggagtcaagaccagcctgaccaacatggagaaaccctgtcactactaaaagtacaagaacaacaaaaaattagccgggcatggtggcacatgcctgtaatcccagctactcgggaggctgaggcaggagaatcgcttgaacctgggaggcggaggttgcggtgagccaagactgttgtgccattgccctccagcctgggcgacaagagtgaaactctgtctcaaaaaaaactcacaatttttttcatgaagaaaatctgttcttttaataatgaaaatttcaaacttcacaaaagtaaagagaattgtataatgaattctcatataccatcacccagattccaaggttttatcaagattttgtcatgtctactttatccattctgtctcttcttaagcattttaaaacaatccaggacttcttgacatttcacaggggcctttttttcttttcttttttttttttttttgagacagagtctcactctgtcgcctaggctggagagcagtggtgagatcttggctcactgcaacctccacctcccgggttcaaccgattctcctgcctcagcctcctgagtagctgggattacaggcatgcaccaccatgcccggctaatttttgtatttttggtagagactgggtttcaccgtgttgggccaggctggtctcaaactcctgacctcaggtgatctgcctgccttggcctcccaaagtgctgggattacaggcatgagccactgtgcccgctttctttttttttttttttttttgagatgaagtcttgctctgtcacctaggctggagtacaatggcatgatcttggctcactgtaacctctacatcctgggttcaagcaattctcctgtctcaacctcctgagtagctggaattacaggtgtgcaccaccacacccggctaatttttttgtatttttgtagagacagggtatcaccatgttggccaggcgggtctcaaactcctgacctcaactgatccacccatcttggcctcccaaattgctgggattacaggtgtgagtcaccgtgcccggcctggcctttttttcttttttagacagggtctggttctgacacccaggctagagtgcaatggtgccatcataactccctgtaacctagaactcctgggtaattagaactccagctaattaaaaaattttttttggctaggcgtggtggctcacgtctgtagtctcagcactttgggaggccgaggtgggcagatcacaaaaattagctgggcgtggtggcaggcgcctgtaatcccagctgctcgggaggctgaggcaggagaatcgcttaagcccaggaggcggaggttgcagtgagccgagatcgcgccattgcactccagcctgggcgacagagcaagaccccgtctcaaaaaacaaagacaagccaaaaaaattttttttgtagagagagcgtcttgctgtctacccagactggtctggaactcctgagctcaagcgattctcttgctttacgctcccaaagtgctgggattacaaggtgtgagccaccatgcctggccacaggggttcttttaagagaagaaaatcaacataatctgatggctgactagaactaaaaggagaaaaatgaggctggttgtggtggctcacacctgtagtcccagcactttggaagactaaggcaggaggattgcttgagcctaggagttcgaggctgcagtgagctatgatcatgccactgcactccaggtaagagccaccacgcctggccaagaccctgtctcttttttttttttgagacggagtctcgctcgttgcccaggctggagtgcagtggtgctatctcggctcactgcaagctccgcctcccgggttcacgccattctcctgcctcagcctcccgagtagctgggactacaggcgcccgccaccacggccggctaattttttgtatttttagtagagatggggtttcaccgtgttagccaggatggtctcgatctcctgacctcgtgatccgcccgcctcggcctcccaaagtgttgggattacaggcgtgagccaccacgcccagcctgaccctgtctcttaaaaaaaaaaaaaaaaaaaaaaaaaataggccgggcgcagtggctcatgcctgtaatcccagcattttgggaggccaaggcgggcagaccacctgaggtcaagagttcgagaccagcctcaacatggagaaaccccgtctctactaaaaatacaaaattagccgggcgtggtggtgcatgcctgtaatcccagctactcgggaggctgaggcaggagaattgcttgaacctgggaggcagaggttgcggtgagccaagatcgcgccattgcactccagcctgggcaacaagagtgaaactccgtctcaaaaaaataaaaaataaaataaaaaaataaaaacagacacaaagtgctctccctcactggctcaagctctggtgattggagaggtgagaaggggggccaggtgcagtggctcacacctgtaatcccagcactttgggaggccaaggcaggcggatcacctgaggtcgggagtttgagaccagccttaccaacatggagaaaccccgtctctactaaaaatacaaaaaaaattagtcgggtgtggtagagcctgcctgtaatcccggctactcaggaggctgaggcaggagaatcgcttgagaccaggaggtggaggttgcggtgagccaagatcatgccattgcactccaacctgggcaatgagagtgaaacttgctctcaaaaaaaaaaaaaaaaaaaaaaaaaagaggtgagaagagaaccaggagacactgtgtcctggaaaccaagaaggagaagcattttagaaggaatggtaatagacagtggcaaattcagcagatgagcaagggaaagtatagagggaaaaacgcaggtttgggcattaaggaaatcagcaggcaaggcatttgcagtcatgttaaggataaaagtgagctatagcagaaggttaggaaggagtgtataggaaggaaattgatgggctgggcgcagtggctcacacctgtaatcccagcactttgggaggccaaggagggaggatcacttgaggccaggagtttgagaccagcctgggcgacacagtgaaacaccgtctctaccaaaactacaaaaattagctgggcgagatggcgcgtgtttgtagtgcagtccctgccactcaggaggatgaggtgggaggataacctgagcccaggaggttgaggctgcagtgagctgagatcgtgccactgcattccagcctgggcaacagccagaccctgtctccaaaaataaaaaaaataaaatagaaagtatggctaaaatggggtggggattgtgtgttagggaaagaaagcagcgatggaagggctgaaaatggttggagatgaaacgtctctgacagctttgtgcctcccaagggcatactgttcagtcggcgtcttccttggttccagggtcctgtgcttggattgtggggaacagactccccggggggtgctgcaagagcgtttccaagtcctgaaccccacctggagtgctgaggcccatggcctggctcctgatggtgacgtctttctctcagaggagcaagtccggagctttcaggtcccaacctgcgttcaatgtggaggccatctgaaaccagatgtcgttttcttcggggacacagtgaaccctgacaaggttgattttgtgcacaagcgtgtaaaagaagccgactccctcttggtggtgggatcatccttgcaggtatctgacttggcaagagtggtaaccaccccttgtgcgggattgggagtcctggagagacaccctgtttggtttaactttttctagatctagagaacctagacattcttatgtgtgtcttttctccgtgcaggtatactctggttacaggtttatcctcactgcctgggagaagaagctcccgattgcaatactgaacattgggcccacacggtcggatgacttggcgtgtctgaaactgaattctcgttgtggagagttgctgcctttgatagacccatgctgaccacagcctgatattccagaacctggaacagggactttcacttgaatcttgctgctaaatgtaaatgccttctcaaatgacagattccagttcccattcaacagagtagggtgcactgacaaagtatagaaggttctaggtatcttaatgtgtggatattcttaattaaaactcattttttttaaataaaaaattgttcagctttatatgaaatgcttcatgaatttgtgtgtcattcttgcacaggggtcatactaacctctgtatcattccaattttagtatatgtgctgctgaagagagcactaaaactaatttttttttttttttgagacaggatctggctctgtcacccaggccgaagtgcaatggcctgacctcagctcactgcaacttctgcctgccaggttcaagccatcctcccacctctgcctcccaagtagctaggactacaggcgtgcaccaccatacccaactaattgtttttattttttgtagagacagggtctcactttgtcacccaggctggtctcgaagtcctgagctcaagctctccacccgcctcagcctcccaaagtgctgactttataggcacgagctaccacacccggccaaaacttttttttttgagacagtctcgctctgttgcccaggctggagtgcagtggtgtgatcttggctcactgcatcctctgcctcctggattcaagtgattctcctgcctcagcctcccaagtagctgagattacaggcacgtaccactacacctggctaattttttatagttttggtagagacgaggtttcaccatattggccaagctggtctcaaactcctgacctcaagtgatctgcctgccttggcctcccaaagtgctgggattacaggcgtgaaccaccgtgcccgggtgttttgttttgttttgttttgtctttgagatggagtctcgctctgtagcccaggctagagtgcagtggcatgatcttggctcactgcaacctctgcctcccagattcaagcaattctcctggctcagcctcccgagtagctgggactacaggtgcccaccaccatgcccggctaatttttgtattttcagttcaccatgttggccaggctggtcttgaactcctggcctcaagtgatccacctgccttagcctccaaaagtgctgggattacaggcatgagccaccaagcccggccagtggtcatctttccatgtcctaagtgctatggtattgtgactgataggctgatgttcacaagcattccctggaccctgctcttcgtttatctttgcattcacttgtttcatttctttacagatccctaaggagcatccgttttttctcaaactaatcaaagctcgctgagtgcagcctgtagggggcaacaaatcaacacctctctgccagcccatttctcaacccggcagctttcccagccaaagagttaaggtctaggctgaggagatttgccccagaacaaagactttttcaaagaagcagctgcattcatttcctttttatctcacctggcaggagaaatggcctgggacatatgtaggccagagtggtctctggagcgccaacccaaggatctcactaattttgtggggtaagggtagaaggaaatgactaaatttataatccaaatggttaagtgtctttaactgaaccattttgatataatttttgaaaaaataagcaatggccatgaattaattttttataaccaagagataaaggaatctttcaaaaatagcacagcagctgggcgtggtggctcaagcctgtaatctcagcactttgggaggccaaagcgggcggatcacgaggtcatgagatcgagaccatcctggctaacacggtgaaaccccgtttctattaaaaatacaaaaaaatgggccaggcacagtggctcacttctgtaatcccagcactttgggaggccaagacaggcagatcacgaggtcaggagatcgagaccatcctggctaacacgatgaaaccccttccctactaaaaatacaaaaaaattagctgggcgtggtggcgggtgcctgtagtcccagctactggggagactgaggcaggagaatggcgtgaacctgggaggcggagcttgcagtgagccgagatcttgccactgcactccagcttgggcgacagagcgagactcaaaaaacaaacaaacaaacaaaatta

SEQ ID NO: 12694 - DNA, 29133 bp, Human
atttattttgaggcagggtttcactctgttgctcagcctagaggtgcagtggcgtgatcatggctcactacagccttgacctcctgggcttaagcaaccctcccacctcagcctcccaagtagcttgaactgcaggtgcatgccaccctgcccagctaattttttttttttttttttttttttttttttttttggaaagacgaggtttcaccatgttgcccatgctggtctcaaactcctgggctcaagcaatcctcctgcatcatcctccagaagagccgggattacaggtgtgagcccccacgcctggcctttccctcctttttatcattccctcttccctcgtcttccttggctttcctcctcacacctcctgcgtttggcccccttccattttcttttctgcttctcttttcccaacttccccctcatcatgccagggggactcctgggctgcgtgccacccccctggaagtcccccataatgaagcaggatttatgcctcacacttcaccatgggagagcagaaacctctcacttgaagcaaaaggcactgaaaataagcaaatagttatgcatttgtcactaccgagtcctagctggcttccaccctaccccccgccccccaccatcttcttgctcattcaggtcatcgtgttctctgatacccagtaacttccatcattttctacatgcatttctgttggtcttctgagaattgtgattttccaaagtagaaagggcacatcgtctttttggagcctcaaaggtgcagacactgatgcgttgggggagatcacagtgtgacaaggatggggtgggagtgtgtcacccccctttctaccgaccctcagcagtggggagagagcagaggagatggaacctgagaggaagaagagatttccaattacttccttctcggtcccttctccactgaagcctgttactcctctgctgccggggcctcttgagttttctctcactgagccaggaaagagcttagtgaataaagaacaaggtatcccagcaatgcagggaagatgtccaggacagtgagtgtgaacgaggggtcctggagaatgtgcacgccagccctgcaggagaatgtccacgccagccctgcagcctggtgggctctgccatcagcaccccaaaaccattcatcagtcaccttcgacaattgcacgtgcaaaagccctctttttgtgtcctttgaagctttttttttatcaggctgggtgcgtggctcatgcctgtaatcccagcaccttgggaggccgaggcgggagaatcacttgagcccaggaggtcgaggctgcaatgagctatgatcatgccactgcactccagcctgggtgacagagtgagggcccatcccttcgcgggtccccattaagaaaatgggggagggacagtccccattttcttaatggggactttcttagtgaaatttgaaatgagagattattaatatgagctgggcctaacatctttttttacttgcagttggggcagagctccagggagttggttttgtcccctgctgtcttgtcccctccccctttttaattaattagggcctggctggactcacatgcaggccgctttctaagagcagcagttactttggcagcattcagaaagggcctcagttactctaccatgacaaatttctcagtctgtcaccgttcacttcctaaaagaaattcattgtagaaggtagaatgggatcttcatggcatttctgattcacaatgctcctgaaagttcctcggcatgtggaaaggccacagatgaatttaagcatgtgaaagaatactcatgtcagaggcacaaaggaaacttgccccgagtccacggtgctctgcggttaggagctggcctcactgtgcacagggggaggggtggtgagcttaccgggctttaaagcgcccttccaacctgtgagccctgcattccttacccttggttggattcttcccgggctgggagaaatgaccgcttctatgaggagaccatgtgccgaggtcgtgtgctaggaagccagttgctgtgagaaatgaccagtgtcatgtctgtctttcagccaccctacatcatgtagcagttcttctgagatcatgtctgtgctgttcttctacatcatgaggtacaagcagtcagatccagagaatccggacaacgaccgatttgtcctcgcaaaggtatgccggtggggagcccagggctgctgtggcgcctgctggttaagcccagtttgaacagccaccgtgtgggaacaaggcctgaaatgggcctcgtttattattttggttcttctttctttgcatcttaaagctcgagtgttctagtgagggccacttggagccctgtgatggcatggtaggaagggtggcttgggagagctgactgtccttcctttcctttggtcacaccctgcctcgccccacttagcacgaacgcttcccccatggcagggttatgctgctcccaccctctgtgctgcctgaggagaggcaggcagcctcagtgaatcccactcactgagcctgggggaacttgagtgtaaccgggagggacatcccacccctgtcagttagcttcctcttctatgtttctgcacatctgacctgaaactgatgggcacttctcatgagattgggcaaaataccagccacttcatgaagtatcatgggtgataggaaagaaaaagaaccttaaaaacaaggtcagtttgagaatgtgtggctggtttgatgccatctcaaagtacactgtgtcccgaagcaaattaaaacctggctaggggccgggtgcagtggctcacgcctgtactcccagcactttgggagactgaggtgggtggatcactggaggccaggagtccgagaccagcctggtcaacatagcaaaactccgtctccacttaaaaaaaaaaaaaattagctaggcatggtagcacatgcctctaatcccagcttttcgggaggctgaggcacaagaattgtttgaagctgggaggcagaggttacagtgagccgagatcgtgccactgcactccagcctgggcgatagagcaagactccatctcaaaagaaaaatctggctgggtagagtactgtgtccaaatagaaatgccagattagcacagtgggaagtgaagacaaaaactgggcatagctgaagtaagtgcctaaaggtcataattgtgacccttgtcttggtgtctgaaccataacatcaaatggtttggcaaaaaataaatagaatttacatgtgtacgcgcatgtgtggagagagggatgaagtaaatgccttccattgctttcagttggttattggaggtaagcagtatacaggaaggaaatcattgtgctaggctttaaacatgtctataaacttgaactttttttacatctttttttgttctttttttggggaggtagagtctcgctcttgcccaggcttgagtgcagtggctcggtctcagctcaatgcacccctgacctcctggcctcaagcgatcttcccatttcagcctcttgagtagatggcattacaggcatgtgccaccacgaccggctaatttttgtattttttgtagagacatggtctcactatgttgcccaggctggcctcaaactcctgggcccaagcgcccacctctgcctcccaaagtgctgggattacaggcaacaagccaccgcttccagccctctttacaatgaaaattgaaaaaaaaatagatatataaacgcaatatgggtgtttagatttctggtttaaaataaggaaaggctgggtacagtggctcacaccagtgctttgggggctccagcaggaggatctcttgagaccagcctgggcaacatagcaagaccccagtgtctacaaaaaatacgaaaattagctgggcgtggtggtgcgtgcctgcagctactcaggaggctaaggtgggaggatcacttgagccttgggagatagagcaagaccctgtctcaaaaaaaaagaaaaatctagactgtcatataacagctgctatcagagccattggccttaggggatgaagaggctttctatcgggcagcagcacaccaggccctgttcggctgccagaatttgtgtgttcatcagatttagctggctgatgaaattggaacaaaagagaaaacacatgaagcatagtccattgtggtttgcctgggaacggggtaaacagctatactccaggcagagcagatctttattctagcctttcacctccctgaatcgtctgccccgcagcataagggttcttgagaaagacagcacccatgtgggagcacttctgccataacgggcatcatactgatgcctcaccattttctcaatctatcctcactttatccttgacctcctgtcacctaagggggctctggtctccattgcacccataaagtctttgagatgggcccactggcctcacacttcacagccagagggaagcagagttggtctgactgctgagcccaggctcggtccattatgttataggacttccaagggcatgcaaggcgactgggagccagagcttgttacgtgagtgtggtgggtgccatagggagggagatgtggctagaggcatagtcaaaagagacttgagttgagtggggcagttctgctgggctggaaatgcagaaccaaaagggagtctctggggggcacaaagcatgcagagaattccggggaaggtcaagagcaaccagagagtagcagagggtaggaagcaagaagcaggagatcagagaatcgtaaataccatccatccatctacagtagtgatgacctcgctcatctctgctcgaatggcgctgacgtttgagcagaggagggtgacaggcaggaaacaaacttttaagtcaatagatggagtgtcaggtggggccaagcatctggaatcaagtaaaagtggaggaggtaggaggcactggttgaaaaagagtggtccagaaagacctcagtgctgacgcttgagcagggatttggaagaggcaggagagtgagctgtgcccacatccacgcacaagcactccggtagtgggtgccatgagtgctaaggccctgaggcaggtgtatgcccactgtgttcaaggagcagcaaggaggccagggtgccagagcagtggaagggagaaatggaggtgatgggggctggggtgggcagacaggtgcaaacagttgagctctacttggtgggaggtcggaagaccttagaaagttgagcgatgtgatcagtcaacttcagttttaacaggctcccccttgtggctagattgagaatggctgtgggggaggctgggaggccactgcagtgacagaggcaagggatgtttaagaccaggtcgaaatggtggctgcagaagctgttgggtaaattcagtatgcttgcaagttgggcctctccagtcagtgcagcagctctttggcatgaccttgtggcccacagagggccacattttctgcttgggatagtgatgaccctgtgcctgcaaacaggatgttgggggtggggtagatgctagtagaaagggattcatttctagcgtgggcacttctagatgagcacgtgtaagatctcagttgacctgagttttataaaccagggaaccagagtattctctttctggtttctgttttaagaatccatatcctccataggattgaacatgtgatttgtgcatgaccgggaagggccatgggaaaatgtcaagaatcatactttacgttttctgctttgtacttgggctccccgtctctattcccaaagctccagccacccttgccatactgtatggattacctatgactccctgggcagggacagtggatgtcttcgtcaccttagtcacctgagtttccagcccaggctgagccctgggcttgacccattttccacttgtaacgttgatcggaagcttggggtgcatatgggtgtggggaagaggaattcacccagcagggcgggaggggctgttcggatgggacgctgctacagagctgacaggagcagcctgcactcagtgcgtgagtccacctgataccatgtcctgcagctgcgtctgggctcactgggtcccttctcttacagagactgtcgtttgtggatgtggcaacaggatggctcggacaaggactgggagttgcatgtggaatggcatatactggcaagtacttcgacagggccaggtgaggttcttccccagaagccatttaactgccctacatctacatccccttcctagagtctcggggggcagccacctatctccgtgatgtggagagccctgaagggccagtccccatcacatcccgtggtgacccctctggaaggccttccctgtgccttttccccacctcgggcggctgccccactttctctcccacaggtctgttgaaaggtttcagctgctgttgcctttccattcttatcctagggttgatagcttttttaaaacttccagcactttagtggggtctgggatgtgtggtttgtttttgagactgagtctcactctgtggccaggctggagtgcagtggcatgatctcggctcactgcaacctctgcctcccagtttcaagtgattctcctgcctcagcctcctgagtagctgggattacaggcatgcaccaccatgcccagctaatttttgtatttttggtagagatggggtttcgccatgttggccaggctggtttcaaactcctgacctcaggtgatccacctgccttggcctcccaaagtgctgggattacagatgtgagccactgtgcctggccagatgtgttttcttgatgcgaacactcacgtcgttggttgtggaggaatttacttcacagcagaacacgtttccaaggtggggtgttttgattgttgtgattattgtaaataagttgtaagaacagaactagcaggtggcggcgggaggcggtggctcacgcctgtaatcccagcactttgggaggccgaggtgggcggatcgcctgaggtcaggagttcgagaccagcctggccaacatggcgaaaccgcctctctactaaaaaatacaaaaactagctgggcatggtggcgtgggcctgtaggcaggagaattgcttgaacccgggaggtggaggttgcagtgagccaagatcacgccactgcactccagcctgggtgatggaaactctgcctcaaacaaacaaacaaaaaaattagaaggtggcaatgctttaaaagggaacttaccagaaaaatgaatgtgtaaatgtttggggaacttaaggatgctgctttcttccccttcccctctggccctgtttgcttattgataaggaaatgtggcagaagaacctaaaagttgctttacagctagaacagaaaactagccagaggtaaagcctgcttgtgagcccccaggcttttcaagctcggctttcttagctgctgggctggggcagagttgatgagggagattgtgggaagcgaatggtctggagcagcagctccagttgcgtccgtttctcctcctgaaatgcatttgtttggttggcccagatgatcccccacagggtcctaaacctctcttgtcttgctccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtaactgtattctcttgtgcttgatttccattctgtcctgcccccttcatctcttgtaacccagcctgctcctctgttggcaggtggaacacttatgtggtggacggccgggacgtggaggcactgtgccaggtattctggcaggcttctcaggtgaagcacaagcccactgctgtggtggccaagaccttcaagggccggggcaccccaagtaagcaagcactttcctcctgctcctggttgttaaaagcatctgtccgctcagcagcagaggcgggagaggcttagaggggcctaggcagatgactcatttagtgaatagcagttctgcctggagtatatgttggaggctcctgctctcttattttcactagctagtgtctgcttaggataggagatatcaaaagccctagcaggtgaacagtgatgtgctgcctgcacaagggagtggctaggagtacagcccatcggaggactgacagggaacaatctctacggttagtagaatcagaaagcgtgctgtgtgtatgagcaggtgcaagaaataagagtgcatacctacacacgtgcctaggcccacactcttctggaagaaccctgggaattggggaagacgggagcttggaatcaccaactatcacatttcaaggctgacagctgaaattgtttatctcaggtttaactcatcacaaagagtgcggctcctggatttttttaaaagactatagacattttagaataaaactgttctgtgactcctaccgaaaatatagttttactctggtaccctccgttcagtaaattattttaccagtgtgctcctggcaggaccctgggtgttgtccttgcctctgcctccccctcatatgcccacacatagacccagtcccctagattacatcttggacccattcactcctccccatctctactaccatgactgttgccacacccatcatctctcccaaagttccagctggcctccctccacaccagtctctacactgctgccacagtgatctttctacagtggatctgatcagtcactttccccactccaaacccttcaatggtttccaatcttgctttggataaaactcaaacttctcatacccacaagacccaccctccatggtctgccctacctgtctctccagccttattctcattctcccttccactcaccagtggccctcaggggcatagctaggtgcaatggcttgcacctgtaatcccagctacttaggaggcggaggcgggaggatcactcgagcccgaggagttggaagctgtggtgagttatgatcacccactgcactccagcttggggaggagtcatagcgtgagacccctgtctcaaaacaaaaagcctcagggcctttgtccaagctgttctctctggctgcagcagcgtcccaggccctctgtgccaggtgttcctcctgtgagtcctagggtgacatctttttcatcggggtctgtttttcaggtgacctcataggcactcactaaatatttatggaatggatgtcttttgtttgtttcattacaggtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaaggtaggcagaaaggtggataattgaataaatcagatacgtcaactgctttgttctctaatgttgttcgtatgtacacaggattcttcatttattctggtctccatggacgaaccaattactagagtgacatgtaactaacagttcgtaggcaataaagagaggtttgccatttttaaaaaatacatttaggggtccaaagtgcagctgtgtcacgtggatagatactgtgtagtggtgaggtctgggctttcagtgcacccagcatcggagtagtggacattgcacccagtaggtacttgatctttcaccactcctggctccccttctcttttattaggtctgatttttatttttggctttcacatgtgtgtctgaattttctgattggtcaattgctatttattagctcctggtgtggtgtgcctttttctagcttcctaactttggtttgtgcatgaaactgccacgactctgtgtctccgctaagaagactggccccaggcgggctgaccttttgaacttactctctgaattacacagaggagcaggccaattcatcagaaacctcaaaaaggaatcaaatgatgcacaaaactcttgagtatcaagtccttttggtttttagcacctttacatcctgccttctggtatatcatagcagacctgacataggcaagttctttatggcctagaggaagtaaggcggcgagcctagggaggaaggacacactttctgatccttctttatttggagaaattttgagtgttgctcatgttttcttagcctggtaatgagggttaaaaataaatgaattttgaatacttgagaaatcaaaagacaaaaaccagaagaaaggagacggtatatcaacaaagggtgggccaggcacagtggctcactcctgtaatcccagcactatcaggaggccaagacaggaagaccacttgagcccaggagttcaacactagcctgggcaaagtagtgagaccccatctctacatagaatttaaaaattatccaggcatggtgccataatatggttccaggtactctggaggctgaggcaggagaatcacctgagtccaggagtttgaggggatagtgagctatgattgggccactgcactccagcctgggcaacggagcgagactctgtctcaaaaaaaaaaaaaaagtttgagaaaactatataactccatagttgcataattggtatgaaaatgtgtaaaaagcggggggaccatttttaggaatacataaaatatcaaaattgactaaaagaggtataaaaaccttaaatggatcaatagccctagaaaaaaatggagaaaattatccaagtgctatacccccaaagcaccaggctcaccaggttatataagactgactcatttttaacctttatgaaaagagtaatttctaaactgtttcaaatttttccaaatacggaggaagatgaaaatgtcatcccgatttacttatgaagcgaaaatgtgacaaagctagcctaaagaaaactgcagagcaactttctttatgaataccaatataaaaattctaaatagaacattagcccatctcaacttcattagtacattaaaaaaattaaatgaatcagtgagctcaaattagtaatgcagatgactcatgccaggagatgtaggaatagaattcagtgttctagtgttaggttaaaggaaggagggaagtgtgatcatcatcatacacactaaacaaaagcaattcataaaactcaacattttttttttgagatggagtctcgctcagtcacccaggctggagtgcagtggtgcaatctcggctcactgcaacctctgcccccggattcaagcgattctcctgcctcagcctcccaagtagctaggattacaggctcccgccatcatgcccagctaatttttgtatttttagtagagacggggtttcaccttgttagccaggctggtctcgaactcctgacctcaggtggtccacctgcctcagcctcccaaaatgctgggattacagatgtgagccagcacacctggccaagtaatttgaaaaatataatgagaaccattaatgtcggaaatctcactcttgagctgtggagtgtttacctgcttaggaagtgggggttgggggagcgggggatgttaactaaaaagagcacaatttgagaaaaacttgggtgccacatcagccatttagtatggatttaagattggctagcagtccatgtttatgacattaaaggaaatttttggtgagtcacgaatttactttcttcaagatagatgataatttgtcattctacaatatggtaccttccttctgtagtcgttccttctaaatgcatttgaagaaactctaccacctgattgtctctgtcttctagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagtgtgtagtgtctctcagggcttcttagaatcaatggcccactggacacaggaggcccagcctgtgctagtttttctttccatttatgaaagcaaaaggactggaaaaaaatttcctgggaagcaggaggcaagtagccaggtggagtctgagaggtggcttctaggtctgctaggagggccgtaatagactactcggcacttggagtctccaagttggctgagggcagcaggcccaaggccacagacagtgggtcctctgagcctcgaaccatctgaacccagggctctgggcctgaagcatcccaggctccctagtagctccttctgcccaattctgcaaccacccagaggcacactggctgaggagtcacagggaatgcagagtttccttctctccactgtagaggggcctaatatagcacagaaatgcaaatgttgcacttacttcaatcacaagaatatcaatgcttagagctggtgccttaggcaaagccattctgcttatctatgcctcagtctctccccagagtgatattaatgcagggagtatctcaagcacatgcacacaagcgcacccctctggagaggaaggagttatggccagtaaaccctttgaactctaaagctctgcgcgtcatagaagatgatgcccagctcctgtcattaggccagaaaaccacaggccagcaggtcttatgtgaccaccagtgactttatttataacaagtagtatttttaaaaaaaatttttttagacgaagtctcgctctgtcgcccaggctggagtggagtgctcagctcactgcaagctctgcctcctgggttcacgacattctcctgcctcagcctcccaagtagctaggactacaggtgcccaccaccacacccggctaattttttgtattttttagtagagacggggtttcactgtgttagccagagtggtctcaatctcctgacctcgtgatccgtccgcctcggcctcccaaagtgctgggattacagacatgagccaccgcgcccagccagtattttaaattttttaaaaattagttgccagcatttaaaaatcagattataggtgtagtggcaccagcctgcagtcccagctactcgggactctaaggcaggaggatgcttgatcccaggacttaaacgctgcaatgtaccactgcattccagcctgtgaaacagcgagaccccatctcaaaaaagaaaaagaatcaggaggtcttatatagaatacatatttctggattcttttgaaaaatgggaagaactactaccatagggtggcattccctcctgacgccagttgactgaagccaaacagcacccctgttgagatgggtgtccccacagctccccatgctctgctgggccatttgggttttttgttgttttgtggtttttggttttttttttggggtttttttttttttgagatggagtctctctctctctctcaccgaggctggagtgcagtggcacgatcacagctcactgcaacctctgcctcccaggttcaagcgattcccttgcctcagcctcgcaggtagctgggattacagacatgcgccaccatgcctggctaatttttgtgtttttagtggagacagggtttcaccatgttggtcaggctggtctccaactcctgacctcaggtgatctgcctgcctcagcctcccaaagtgctgggattacaggtgtgagcccccgagcctggctcattaagctgttttcattttgaatagaaaacaatgcgatccgtaattttctggattaatgctcctgtcaaaaattttgctccccacctcactgattgcctcagcacgcagccatgtagtctactccgtccctgctgatatgttctcacagttggaaaaaagttgtaaagaaaaggcgagcaggtggtatttagtgccatgttgaaagaggtggctacaatgtagagcttgaccaggggcagtcagggacaacctctcagaaaaggtgatacttaagctgagtctcaggtgacgaggggtcagccgtgtacagatgtgggagacagcatttcaagcaaggggcatggccaactgtaggcaggcccaggcttggaatgtttggagagcagaggaagggccaagtggtaggagcatggtgaacgcagaaaactctccagggcccaggtcatacggggtcttataggcgcccttttcagtatctctggttctcttgcagtttgctgggaagccactggagggctttaagcaggaaagcaacagcctgcgttttccaaaactctgaagactggagaatggcttcacgtaggaaagggaggagaaggagagggtgacttggaccagggcagtagctgtggagtcggagggaagcagacttgtcacatattgccttggcaggagagtcagcaggatgccaacggcaggtgtcaggacaggacccaaggctggtgcttgagtgtgggtggcagcacctgggggaaggtggtgtcacctcttgagattgacaagactgggggagaagtggactggagggcaccatcaggagctctgtgtgggcctggggggttggggcacctgttagatgtacagaggggagacagtggtatcagatggctgggcagtagatcagtcagtcattttcacatgtggccgctccacaccactaaatgcagttttctaaactacatattcgttggcctagttttaagctaacatcttttttttatttttattttttgtagagatggagtcttgctctgtcacccaggctggaatgcagtggcacaatcatggctccctgcagcctcaaactcctgggctcaaggggtcctctggcctcggcctcttgaggagctgggagccgccatgcttggccacatctacatttttaatcataaatttaagtcgttgcaaaggatgtagttgttcatatattgacatttttgatactttaatactcaaatcatgccattaatgatgacactggctgggcatagtggctcacacctgtaatcccggcactttgggaggctgaagctggaggattgctggagttcaagagttcgagaccaggccgggtgcggtggctcacgcctgtaatcccagcactttgggaggccgaggcggacggatcacgaggtcaggagatggagaccatcctggctaacatggtgaaaccccttctctactaaaaatacaaaaaaaaaaaaaattagccgggcgtggtggtgggtgcctgtagtcccagctactcgggaggctgaggcaggagaatggcgtgaacccgggaggcagagcttgcagtgagctgagattgcgccactgcagtccagcctgggcgacagagcgagcctccgtctcaaaaaaaaaaaaaaaaaaaaaagttcaagaccagcctgaacaacatagtgagacctggtctgtaattaaaaaaaaaaaattcatgccaagccacttttctttgtcagaaattaaaaccctttttctacttgatttccaatttccattccattcatttccccaatatatctttatgcatgaaagccttttattgattgtcctatcatttttctctgcaacaaaaatatgcatataaattgataggtttttaaaaaattataatataggcttctgagcattaggtttttttttctggactgagatagaattttgattattattagctggtatgttagtggatgagtatacttgtagtttgaatgtgatagcattgagaacagattctattcctgtttttcatcttcatgatgtgctatgaaaccttacttacatgaataagtagatgggaagggaagttttgttagaggaatgtcactcagttctttgaattccttcccagttgtaagtcaaaaaatcacatagtgatctttcatgtaaagttgtttataaaagttatttacagagttgacagtttcattaattaagttcttcactttctctccaccagcatagttatttcaaattgtcctctttacttgggtctggaggttctgcactccaggatgatccccctgtaagagtcaggtggctgagagcatgccctttggggatcaggttgctagaaggtgattgttaaaagagacagttgggagacccaggggcagtggctcacgcccgtaatcccagaactttgggaggccggccgaggtgggtggatcacctgtcagttcgagaccagcctgaccaatatggtgaaacctcgtccctactaaaaatacaaaaattagccagacgtggtggcgggtgcctgtaatcccagctactcgggaggcagagacaggagaatcgcttgaacccaggaggtggaggttgcagtgagccaagattgcaccagtgcaccccagcctgggcaacagagcaagaccctgtctaaaaaaaaaaaaaaagaccatgaggggagcacagaccctccttttggcagatgaatgtagacagagttgatctggagtttgggatcttgagtgtaacacccacagccacatcccctttggaaagcctgtgtgtatccgcagagaggtttgtattctagtttgaagccttctggggtatttgagcccggacttctggggaaggggggtaaggaatggcaatgtaaagtggggatcattaccagaatgcacatcaggggagcattgggccagatgcgacttcccgagggtgcacagggccctgaggacttgccccagcagcgcccatgaggcgacagcagtgggccactgccacactgcagaaaccgagaggaggaaatgccttgagatcaggggccaagtcaagtcacaggccacccaaggtcaggcagcctcttggttttgtggcttcgaggtcccttgtggggatggtggcctagatgaagtaggctgggaagagcgtggaaaatgagaaagcaggggcaatgactataggcaagttttgagaagtttgctgcgaaggagaacacagatgtaaaagcaggacaaggcggagatggggctgtgaagataaaaggtgctggcgcacacctgaatggaaatagaatgatccaagagaaagggaagtagcacaagaggggaggaggagctgcatggctggagacccctgtgagaaagcaggaacaggacagattcaggatgtcctgtcggggcatggaccctggaaagctgcggacaccaggagggcaggcaagagagtctcatctcttgctccctaggagctatgagttgagggcgccgtctgagcaggagggacggacgggtgcccagggtttgaggaaagaggggtgtgggaaggacgcatgctagaacttcagagcagttcagcaggtgcagaatgggagttatcatggggactgtgggagaaggggcggtgggggcaatgcccagggatgttctgattcatgttctctgtgctgcaggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtaagggttctaaatgccatcatcttggtagccttcctccttcacagagaaagattagcatgtgattggttaaaccacgaatttccttatggttccatgaagtttgattattcaagcctttttcttgaaaaagccatattgtactttaaaagtgtcagactctcagggcaacttttgaagtgcatctctcggtggtactgttgtttcagacagtgagaaacagttgcttatcccgagtgccccttgtgtgttgagctgcgtgcaggttatggacaggactggcagagtcatggagccttttctgccctcgctgtggttgcagtctaactgagggtgaacagcatcacagaggacgaggagcattctggctggctgcacagcctgctcaggtgggaggggggctgggaccaccatcaccaccttcctgcctggggcagcgagaaccctggagcgtgacacgaggcaggaactcttacaaacacacccttctcagagtagtagtcacctggcaggtgggctagaaggaaaccacaggaaacgggaagccagagaggggattgaaacaaggtgtgcaaggtggtgggggagaaaaccaggggggtggggggggacctgagagtgaagaaagaggtgagtgtgcctaacagatggagcactctgcaatggcgtgaagagcaaaacacacgagtctccgggattcctcacttgggaaacgtcagagagtcattttcgtgaatgacagaaatgacatgggaaagatgagccagctggcgtgcctgtggcaggcagatgggcttactagatgtggctgcacacacttgcttctagaatgccagagatgcacgctggaaagccatctcagggactccctgggagaatgaggctggacgagatggctctagatggagctagagtcacggctgtctgggtgaagctggaggcacaggtggtggccagagagaggaggcgcggcagtgttgcaggggcagaggggcctaggaaagggtccttgagcccacctgtggctgtgctcagtttcagttttgaaatagtcacatggagaaagtgactctaggttccatccaaagaagaactggaaggctgggcgcagtggctcatgcctgtaatcccagcacttggtgaaaccccatctctactgaaaatagaaaaattagccaggtgtggtggcacgcacctgtattccagctactcaggacgctgagacaggagaattgcttgaacccaggaggcagaggctgcagtgagccaagatcacaccactgcactccagcctggcgacagagagaggctttgtcaaaaaaaaaaaaaaaaaaaaaagccagagcggtggctcacacctgtaatcccagcattttgggaggccgaggcaggtggatcatctgtggtcaggagtttgagaccagcctgaccaatatggtgaaaccccatctctactaaaaatacaaaacttagccagacatgttggcacatgactgtaatcccagctacttgggaggctgaggcaggagaattgcttgaacctgggaggtagaggctgcggtgagccaagatgacctagtgcgctcaagcctgggcaacagagcgagactctgtctcaaaataataatagttaatttttttaaaaaaagagctgggctgttgaggttagacagtggtcctaggcaaggcagtgtgcatggtgacaatccccttcctagctgagaaaagctaagctgcccagtgcacattaagatttctctttcacatttctggtgagaaactacgttcccagatacaccctaaagtaccctgtagcaccctcagcatgctttgaaggtgtgttaactacttggaaggcctggagaaatgaaaaagaccactttggtatgcaaaacccggtctctggatatagaaaagatagagcagaaaagggagaacaaagcctgaggaccttcctaaagagaacgggttcagagacttagcaggccaaactcaggccaccaatgctcagccatcgtggacagtaacttggagtgatccatctgaaaagtcagctgagacttttcagttgactaacccgaggtgtcacagtgtgatctcaagggagacaggcgtgcaagaacacaatgtaaatgagttgtgaggatgcagcgggaccatttatggggctctgctacagctcgggacaccccgtggcaataggaataattgcttcttcagagctagaagtgggtggagggcaggttcctaatggggttatgctcctgttttcatcgggctctggttctctcaggtgacgatggtgcttcccagatggccctggaggatatagccatgttccgaaccattcccaagtgcacgatcttctacccaactgatgccgtctccacggagcatgctgttgctctggcagccaatgccaaggtatttttaaggggacactagtttcagacagaaaatgcttctggactctgctagtttcatactgatgattggacttttttttctcaacataaaagtgatattcattatagaaaatttggtgatagaattctttacaaaaaaaacaggagattatgcacacaaacacatttgccttgtaaaagagtccaacagtacaggatactgaacaaaacctgacagcctgtctcagtcagggtttagcagaagaaacagggaccattctgggtgttgtaaacaggagaaggtgtttaacaaagggtgcttaagaagccgcaggagcaagcttcaggcagagtcccagactatagtgttagtctccagtggctgcagccagaggccaagaagctcctgctgtgtcctgacatccaggaagctggagagcgggtggtaggctaccactacaaacgaacccgggttccctggccctggcttgcctttggaacagcttagggcgccaagagtgtgtgggacctcatgcaagggcatcagatggacagaatcaaattcctgttcagaacctagctgcacgggagacgaggcagtgtggtcttgatctttccagcctttcccactaacgttcagcaggtttcccttgccaccctggacctcgcccatgcgccacacaggtaacccctggcacagtcgggatggggactgtatgttccctttccaagcactcatgggcgtttctttgatttttttttttataagtgggctcccgctttacatattattaggtacttttttgtgtggtttttgtgttttgttttttgggttttttttctttggagacagagtctcactctgtcgcccaggctggagtgcagtggcacaatctcggctcactgcagcctccgcctcccagattctcctgcctcagcctcctgagtagctgcgactagaggtgcactccaccacggccggctaatttttgtatttttggggagagacagggtttcgccatgttggccaggctagtcgcaaaactcctggcctcaagtgatccacccaccttggcctcccaaagtgcagggattataggcatgagccaccgcacctggccaattgtgtacttttaaaattagtttatcttggagattgttctgtgatttcacacgttatagggtttcatttctagaaaggtcaagagaggcgcaaaacaagattaggtgatagaaattagagtagaggttgcttcatagtggggggagactgactggaaggaggcacaagggaactctgctggcggaagcgctgctgggcttggatgagggctccacggcggatgcagcattcaggaagggctgaacttaggatgtatgcatttcactgcagctgagttatgcctcggtgaagacactgaataaagatggatcatagcgtatgaacgaacagtagcgacgtttcttgctatattcgtttataatgcatccattaatatgtatgtaaattaacaaatactttagacatacaagtgttcatttatactggtaaatgtttatgtgctcaaattggtcataaaaatgtatttacattttattgggaaaggggccagtcgtcttgtattcagatagatgtttatggtctttctaaggatgaagcattacaagttattgtggcaaaagttaatgttttaacattctattcgggctttctagtcaatgtgagtcagtgctcctgccgtgagttaatgttctgtctgcacagaacaagtcagtgagtattggggaatcttccaaggggattggtgtgatggcatgggggagcttgtccttcagggcagccccaaggtcctgctgggacctgtcgtccactggttgtagatgctcacccctttctccaaagcctgtgtttttagtagaaagagctgtcctcttcacacccctccttcacttctttcaacgtctgttgttggaaattcattgtttgcttttctaaaccatggctccatttatgccctaggggatgtgcttcattcggaccacccgaccagaaactatggttatttacaccccacaagaacgctttgagatcggacaggccaaggtaagggcttacgcgctcctgcgttattcagtatcatctcctgtaaaaagaacacttctgaatctatcaccagctatcttcagagttgagacatcatcctttctttgctctcatttttttaaaaaacagttgtgacctttacctgcttttccttgggaaggaacattctatgaatttcagcttagcctgaacttttctgctttccaaatggagtcttttgttgttgttgagttcaaagatagtaacatgaagccacttgagcggtcgtggctataatttatcttggccgcaagctaaacaaaacagaagccagcgctttgggaggccaaggcgggaagattgcttgaggccaggaattccagagcagcctgggaaacatagcgagattcccatctttacaaaaattttttaaactagccgggtgtggtggcatccacctgtggtctcagctactcaggaggctgaggaaggaggatagaggagcgcaggaattcaaggcagcagtgagctatgatggatcacaccactgtactccagcctgggtgacaagagtaagaccctatctctaaaaacaagacaaaaaataatagaaatcacttgaaatgaataatctgttaggttcagattttacagatctaaggccaggaataaaagggaacatgatctctggtattctcacaaaagccctgagaagttcagattatcagtcctatctgtagatgaggattggagaaagtaagtgtcttacttaagggtttacagcttgtgagtaccaagaccagaatccaggcctgagtagtgagcccagtctccccaggtctgcccaccacgctgaccatcccctgctcagcctgcctgtcagggccatgcatagagaaaagcagaaacgtctatggagaaaataagtgactctgctcatcacctagggagtggggcttgtagacattttggcatgcttccttcctgtctttgttctaggcatacatgtatattttacacagttgagatcatactgaatagaaaggtttgcccatagccactcttgaaagagcagcaggtaacatccaatttggttgctaaggactaggctgctccagaattcacagttgcaagtactcagaatggccagagtgctgccataaagcaggtgtttccagaactgtccactgtgtgccataacgtagctggaaaacgccaccaaatggaaaagttagtgttcacctttggtgttaactacaggttctgtttctatggggagggtctcttgacattcacatggtttgcagagcttgcttatttctgtcgtctcttttctaataattttcctgtcctgacaaaagcaagtaaatttactgatagtaaaggatgtgagataaatgtgtgtgataacatgcatggcatggatcgttaaagggctgggctttgaaaagaggacatggatatgtgtgcatgcgtgtataagtattttaagaggccaggacatccttaaagaatggggtggctcagaaaccctttctgtactatcagcaatggttcttaagctacagggaaacctatacagaggggaagtggagaataattccagatgcctccgatgggtagctttggaggcaacaatctatgaaagaagcccaggaactctgtctttgcttgcagaatagtacgttgtcgagagcgagggctttgatgtcagccccgcctggctgtgggtcccagccctgccctgggccacttcctcctgctctgagatttgctttcctcagctgcagaacggttgtgccactgaacagatcttacagggaggctgtgagggttctcagagttcaggcacacaagatcttagcactcagcgtgttgccaatgcccagaatgttctcattaacatgttagtcactggagtccaatctttgcatgccatagtgagctctcaaaccagactcctgatgggtatgtggcgtatccatgctccaggacagctggagcagtgtaatttcctatcaaaaagtatgtgtcctggcttgtaaatgcatctgatttttttagtagtgagttattaaggagtgaaattgttagaattgggggatagcggcatagcaaagtgccttccactttgacatgcattctgtgtgtagtaaccacggcattctgttttgctggcactataccaggtcctccgccactgtgtcagtgacaaggtcacagttattggagctggaattactgtgtatgaagccttagcagctgctgatgagctttcgaaacaaggtcagttggttgagtatgagcattgaagttcaagctgggaagaggtaggacttcagctacctcctgtgccctgagtgctctttttatttttatccctgcatgttattctgagtctctttcttgtaccaagctggtttttgctgttctgcagatatttttatccgtgtcatcgacctgtttaccattaaacctctggatgtcgccaccatcgtctccagtgcaaaagccacagagggccggatcattacagtggaggatcactacccgcaaggtgtgtgtgggcattgagaatgctttggaaggttttggtgtttttgtttccttgattggccacatggcatgctctcaggcatcacctatagtctacctctcacccagcatggctttgttatttgatgttcactaagcgtggggccatactcatacacatctgtgtgtccccaacagagtgcacagtgcccagtcaccagggcgggtcagtggcaacacagaggagtggctattgcaggcaagcgaggtgtcatgaaaagcatcgcagtttctttgggtttggaatgatgaatagtatgccccaggccaggcgtggtggcttacacctgtcatcccagcactttgggaggccgaggcaggtagagatcacttgaggccagaagctcaagaccagcctggtcaacatggtgaaaccccatctctactaaaaatacaaaaattagctgggtgtggtggtgcatgcctgtagtcccagctacttgggaggttgaggcaggagaatcacttgaacccaggaggtggaggttgcagtgagccaggatcataccattgcactccagcttgggaaacagagtgagactctgcctcaaaaaaaaaaaaaaaaaaaaaaaaaaaaaaaaaaaaaaaaaaaaaaagtgtgccccgacgaaagcaggtatagcagagaacacagcaaatgcagaaaacagtgtgtcagggagaatgggctgggcagtgtttgcgcctggaaaggttaggtgggacagatgatgtgatacaaggagcattgagtgttcatgcggcaggggccctctgagcctgcacaagcggtgcctgatctctcgaaggactcctgggacccagcacacagttgctctcacacctgaggttgatgacagggaaagggtgcagggggggatccaccagggcaggaaccatgggccaggtggagttgaaagaagtcctgccccagcctccccttggccccacaaggggcatactgagaagtgcctcccacgcaggctgtgttcctgcctaagggatgcctgctagagacttggcacctcaagtgtgtactgggggcaggtcctgttggcaccctctgccaggcaggtacccaaatccctggctcccagcaggaaagcaggtgctcatgtcaaccacattgttcctacagacagtccaggtgcatgaccgccctgtctagtggggaaagtgttagagtagcaagggaaccttcacgagccaagagctaaccttgccaaccaacagcctcaagccagctagtcacttttctgcactgttaattcattagttctaaccattttcaggtccccaacagctttgagaatcagagtgccacagacccccacactcaggcagcccttactgtaggttgaggcagagcagtttggaaactggcagtttagaatgagaactccgcaggcccatcggagtggctgttcacatgaatcagattttcccctgggaagctgcagattcaaaggcctctatgtggtgaggctttaaggctgacgagctgctttcacaaaagggcctaacatccttgtttccccaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccagctgctttattcagcacgtgccttctgtgtgaatcagtttctcagtggtcagttcctaaataaggaaagagcttttatccaaaccagaaagagtgagccatggcccccaccagtaaacctgggaaagaataatgggctgcagaggaagcactcgctcgaggacagcacctggcctgaaaagctgtccctgagctgacgccttcctgtcagctataagcacataaagtatgtggctagaggccaggcgttgtggctcacgcttgtaatcccagcactttgggaggccaaggcaggtggatcacctgaggtcaggagttcaagaccagcctggacaacatggtgaaaccccctctctactaaaaaagacaaaaattagccagacatggtggtgcacacttacaatcccagctactcgggaggctgaggcaggagaattgtttgaacccaggaagcggaggttgcagtgagccgagatcctgccattgtacgccagcctaggagacagagcgagactctacctccaaaaaaaaatttaagaagtatgtatctagaatcaaagtgtcaaccagaaaaagatgaacctgagcttcaaaactagatttaaaattctactagatgtgtctgctgtgtcacattcctgttttggctttggttttgttttgagacagggtctcactatgttgcccaggctggtctcaaactcctggcctcaagtgatcctcacgcctggaccttccaaggtgctggggttagaattacaggcgtgagccactatacccagcccattccttatttttattgcccaaattaagtggtcagagatctttggagtcatgaccagtgtgactgaggaattgttctagaatgtgcgggatagagatggaagcactggcctggggcttggagtcctcaggacctcctcctactcctgcccttgtaagtcactgagctggtttcctggcctgtaaaatgagcatgatgatggctctgcttatttcataagatttcaaaatttattttgtaaaaatagtttctatagggtgattgcagaaaatttagaaaatgcaaagaggcaaaaatgttttacctcacttatctcactacttcgaggtaatcacagcttctcacactccagacaattttactcatttaaggtatacaattcagtggttttcattctttttatggccacatactattctattgtatggagataacacattttattcttccattcagttgatgaatgtggattagttccacttttgtctcttgtgaatagcgttctgacaattcacatattttgtgaagatgtaggtttcacaaaatatgtgaaagattttgtgtagatgtagattttcccttcttatggacatgtatactaggagtggaattgaattgctgtgtcgtaggataattctgtgtaccctttcaagagtgtggtggggggtggtgtttaaataccgttttgtgaggagtagatgcagtgacactgaaggtggctgtaaagcattactttagaggaaggcattctaacagacaagccacgcttgcttgtattcaggtgcaaaatgtcaggtttggtgagaccacaggacacataagcgcacggtggcaacaaatggagcaacagattccatgattaaaatgtgcaatttctaaacacaggaaagagcccccaaagcctcacttcagtcccctagaaggttctaggcagaaacagtagggcagatcaaaggaatgagagcataggagccatgatcacccagcgaggggagtgagccctgttgccagcttggcctggctgtggcttctgagtaaacacgtgtgtttgttaactgttaagaacctggtaatgaatactccctggaagatgccatggaccctggcctctggccagtcccctcgcccttgagtcctcctaacatcttattgctctgattacttcccatggagaagccagccagcagggactcgggaaccatgtgtcccaaaacct

SEQ ID NO: 12695 - DNA, 7659 bp, Human
atgtgttaagatggcattgaggccgagcgcggtggcttaggcctgtaatcccagtactttgggaggccaaggcaggcggatcacctttggtcaggagtttgagacaagcctggccaacatggtgaaacctcgtttctactaaaaataccaaaaacaattagctgagcatggtggcgcgcgtctgtaatcccagcttctggggaggccgaggcaggagaattgcttcaacccgggaggcggaggttgcagtgagccgagatcgcgccactgcactccagcctgggcgacagagtgagacaccatctcaaaaaaaaaatagcattgagatcaataaggaagtctagaaaccaggaagctttttgcaaagagaaaacgccttttgttattctcaccgatggatattaagctttccctcacagacaggactacaagcttcagagtggatctgagatgaatgcgaattgctgtgtacctttgtaagggacagaagaccggattttcaaatttaaaacaaccattctgtttctggaatcagaaatcagtttcgagatttacaactgtattttttaaaaaatctgtcttcttagtggactcgggggggacttcacgtggcacccagtacacgccacgccaagccaccgaagccagaggtgtgtgtctggggccagagacgtgcattccctcagcaaggccggcctcagacgcaaacgccagcaccgccaccctgtcgcccgctgagaggatctggccgccggggggagggggcgggggggggggcagcgggggaacaacaaaaaaatcccagcataatgattattcccagggaccgttgggtttttttttccccaaggcggccgaaaaaacaagtgctccccttccccggaaatgagatgcacaggggtattcattccattccgcggctgggaagcccctgcggaaacgagtctggctgcatgtgcggcctcggtcccagaaatcaaaaagagcgtcccctgagcccacagcttgctcctccatgtgaccggcccctgggctggtggccactgtggacgcgcccggcgccccctctcccggctccctgcgggttccgcggagccgccggcgcgcagcccggccaggtgcacccggcacggccccactaacagcgcgcgcctccagccgccgggcactggcggccacgcgggcgagatttacggtggcgctaggcggcggcttccgaggccggccggcgcccaggctccgattacaggttcacactgggggcccggccggcggccgcccagcccccgccggcgcgccctcgcgcggcccggctccccgcctgcccattcttctccattcatgcggacgcccagcgccgccgccgccgccgccagcgcggccgccgccgtcgccgtcgccggccgcccggattggctggcggccgcggcgccggcactttcccacggcccgcggcgcgtgcggctcaccggaggcgctgcaggctcggccctggcgcgcggccaggccaatcggggcgcgcggggcggggaggagccgcggcccccggcgggcttgtgtctgggcccggcctcccgtgcttccccgccgcccgcgcctcctccttcccttgagtgcaggctggacagagcccccgcggagccgacgcaccccccccggtcagggacgggctcggagggcgggggcgcggtccgctagagccctcggcctcgctcccgcccctccccggagcggctgccaatcatcggcgcgagaaaccggattggccggggggcggctgttgccctggagttgccgccccgcctctccgccccctcgcccgccttccccactcccccgccctccccagggccctgggaaggggctcagcgtgggaaaggatggttgagttttaaccagaggcaaagcgtgagcgggatcagtgtgtgcggaacgcaagcagccgagagcggagaggcgccgctgtagttaactcctccctgcccgccgcgccgaccctccccaggaacccccagggagccagcatgaagcgagctcaccccgagtacagctcctcggacagcgagctggacgagaccatcgaggtggagaaggagagtgcggacgagaatgggtgagctggcggcggcggagcggagccgagccagagcgggaggcgagcgcaggcctgccgcggtgacagcgggctaggacccttggcgcgccggtgccctgcgctgacctccgcgcgtcgcaggctggcggcagcctgcggccagggaacccctaggtgccttccagcccaagtggcaaaaaaagtctgagtgcggggagggtgtgggggcgacctctcagatcacctctcctcgtttaacggcgatttcagtttttgtttgttctttttctcttttcagaaacttgagttcggctctaggttccatgtccccaactacatcttcccagattttggccagaaaaagacggagaggagtgagtctctttacactctccttttatttttgttattgattaacggaaataaccacctttttttttgtctttgaaatttacagtcgtaatggtaatgccttcctttgttttgcttgccttctgcagataattgagaagcgccgacgagaccggatcaataacagtttgtctgagctgagaaggctggtacccagtgcttttgagaagcaggtaatggagcaagtaggtaaagctctcagcatagctatctgcaccttctgaatcttcccctcattaatctcatccgccttggaaaatagctgtgttgcttgtgcctagatgaattcgtacacagataccagcgtattttgtgaagacaactgattttgctttagtccatgctttacgatttacaaagcatgtatctttgtatatatgtttgcatattttaaattgttccccaaaggaacttgtgccaaatcaatcttttgccattctcatctttagggatctgctaagctagaaaaagccgagatcctgcagatgaccgtggatcacctgaaaatgctgcatacggcaggagggaaaggtacatctcctagacctagttggggctctgaatggttggcaaagagtgagcagcggctgaaggccaggattggtgcagtagctgcctgatttttctttgggggtggggagagaacggtgtgtggtgtgtgcagttccctgtcagtacattttcgaatgcacatagaatcttctccagtgaattcaccaccccagctctctgcggattgagctagtgcatcttttggaaaaatacctattatttgtgaggtcttcaaaagttgtgacagccctgattcagatcaggtagctttcacatttgtccattgctattttgagaaaaagcatttaaaaacaatatgtggtcttatttttggtatacgggattttaaaaaaaaggtgctgccacatgcctcttgaggaaagaaatgtattctggttaagtaaaggaaacctaacgggagaccaaggtctgtgtgtatgtctctccagcaggaaaatgctttactgaggtccaagtgcctaaaagctccgcgatgataacttacatctgtgtgtctaatgaatttcactgctctgtggtttctctgcccttgatgtatttttttgttgttgttgagggaaaacattaaaggaatgaacatagtttcatctgctggtagggtataattccaatttctgctctgcagcttctaattgggctttgaacttgcattagcaaacacattctgcttatgttgattaatgcaaagatttttgttgattccaaagactttcggaagaacccctgactgttgtgttttaagggatgcaggtatctgccaggaagggctgtctctgggacttaagaaatgagggaaacgggcaaagccctgagatttttcttttgttcttttgcttaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaacctgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaagtattctgtggtgtatgtcttacataccttggcctttccccctcttggctaagaaaagataaactttccttggttttcattttgcctgattggtttgtatgtttaccagtttcattattcttggacttctaaactgtgtgaattcgtgccgttgaataaggtgacttcattacaatgcagagagctttgccctgcctcctacaaggggacatagcccttttgctcttatgtcagatgatctggccctaaactggccatctgtggattaggaaagctgaaatcagactgagacttacaggggttgaaaggagcttggatgaaatattttaaaaccgtgttgactatttgacaaatatttactgagagtacctactatgtgctcatttctatgctgagagaatggaaatttatttcttttattaattttttttaaatggcaaaacaagaagacccaaatgtaggggctcgggactctgtggcctgatgagcagtggcaggctgtaattctgcacctgcacagctccagaagtcttcactggtcttatttccaaggaatttaactctttagttgcactggactcctgagctgtgtagtgaggaagctgacatatgctttaggttagaacaaaacactgccagcatggagggcgtattctgggccccaggggagaggagtgtcttcccattgccttaaaaatagccctgtgccaattaaggagtgctcctaaggagtttgtcttgatcctgagggcggtggggaggagacggagaaaacccatgctggcagatgataaaataaagccttcctttgctttgcccaaacacggagcccctcctcccatctggtgaaaaaacacagtcagaagacaaagagaagtttggagtttgaatttgagcttcaacttctgtgtccctgtgaagggatgggagactgcagcatttttgtgattgtgggtttccaatcccttcaaagctttctctgcatggcctcagacgtcgatccctcttgtgatgcacagctctgctctcagcattgcctgtgccacacagacactctttctgtcataaggctgtgatggaaagtgttatgctaatttctgccaagtgtcagtttaattttagcaaccgcgatttccaatgacattacagcattactgaacagcattgtacttcgactatctcttactgttacataggtttagatggctgctaatgtggtaagaagtgaagcctctcatttgctggctctgctgaaagagctgtggaactgtaaaacatgtagcatgttccacttgtctcatcagtgatcgctatatctggttagcgggaggcgtggcagttcatttccagattacatacttttccatggaaatattctggtttcttttcaagccctttcaaggtgaaaagtatctgaggatggtgcaggtggagtgtgagcttcctaggaagcaggatggagtatgactatgtaccaatagtgtatagaaaaattaattcaggaaaactcccatttctattctgttgatgcaattaggaaaaaaataacaccagggttatcagggccagcatatttttgtattatatgtacatttataatacatctaccagtgtataaacaaaattttttcagagaatgcataagtttaccttataaggaaaataaatcattggttataaagaatcttgaagggcttcaataattactcatttattttcatttaatgtattaccatgaatcaatatgatgaagtagatagatgggcagaattcttgtatttaaaaaagcctctaaaaatccaaggaataattgtttccaatttattcagtctagttaaatgaggatgtgatttttatccaggttttcattgccccactctgtgactcactaaaatcatgatattttaaatatagattacttaaatttgaaatccctcaggaaatgttttatctcctagttatacttttccccagcctttccca

SEQ ID NO: 12696 - DNA, 15546 bp, Human
gtactggcccagggcgctcggggcgggaggtggcaggcgaccggcgcgcgtcaggctcgtcacccgctggattgcggggccggagcggggacggggtctgggtcctggcccgccctcgtgcagccgatcggaggccccgaaccccgcgccgacccagccatccgccctgaggccgacaggggagctggggttcaccgacccccgcggccccgccgtcgggcgcggaccccatccagccccacctggccccgccgagtgtgtgctttgcctggggttaagtttcagaagccaagatggaacgattcgggtttctattcacaaggttattgaaggcatggcggtggggaccgcgcaaaagagatgagagtgtggggggaaaggggtttctgttctaataagggcttagcacgctggccgcaggtcctccgcgccgaccgggctccttcccgctctcccccgggccaaaccccgccagggtcccgtctttcccagtcgcgtcctttcctcttctccccgccccgcgccgggcttgtgtggacagagaacggagtgtcaaagggacgccctgggccgatccccaggaagctatgaatccctccgtgacggaggggtctggggatcgatagacggccctttctcagaggctctctccactactgaccaagcggccctgccaacgtgtggtttccggctggaccccaacccagccgccgccagtctcccggcgcccctggctgggtctcgctcagtccctgccctcgcagacgcacagcggggtggccagttcaaaagtcctacataacttggagagaaccagcagctagaaaacctgttttaaacacacagcttgagttttatacaacccacgttgtccaaggcacgaactgttggacacgaattcatactttagaaaccaaatctaatttccaagcgccaatcttcacctcccggactctaactctgcggctgcgagtgcatacaccagggggactggaggagactggaggcaattatctggataatccaagcccgaaaaactcgaacttgaaaatatacgattatgtcctgaaatgcccgcgtcattgatctagtctttcctaccatcagagctgacacagctccagtccacgggcttctccgcggggtctaggatccacagtccctgggggctgaagacccaatggaagtaactgatggatcgcaaattggaaatcgtaacgtggccgacagacctgatcaggaaaactcgcgtccttatatgaaacagccccgaggccgcgaaagtagcctcaggagttgtcagattcaaaagcaattttgatttaaggttttcaaaagccccagagggcaaatgtgaccactcgggtcagccagtcagcagtttggatccagacaggggaccaccgagtggggcggccgaggagccgcggcgcctcccgacgtcacacgcgcctgctcgcacttagccacgcgcttggggttattctttacactcaggactgaaacttcgcccgcgagaccgcggggcgcggaggagggccgaaacccaaggtccaggtccagggcccgcccccgcgcgcccgcgttggcgcccgcgcgctccctccgcaggggttagcaagattgcgctcattctcgccccggctgctccccacccgctcgctgctctggggtaccaggtccgcggccgcgttcccacgcctcggctggagccttgcggcgggcattggcgagcgcggccccgccccctggcccagccaatcgcgagccacgccgaccagcgagggggaggtgccgggcggaaggcctgggccggtgcgcgggggcgggtgaggtggccccacccgctcgaggggggggcgtggccggcgccggctcttgcggccgagcagagttgcggcgtgggaaagagccgctaggagcagaccgcgccgccgccggagccgcgcctgcccaggcccggggagggaggaggcgggcgtcagggtgctgcgccccgctcggcgtccgagcttccggccgggctgtgccccgcgcggtcttcgccgggatgaagcgcccctgcgaggagacgacctccgagagcgacatggacgagaccatcgacgtggggagcgagaacaattactcggggtgagcgcgggctccgcgggagcggcccgcagctcgggagcttggggtagctttgtgaatgcgtggctccctggaaatcccgaggctggtctccgcagcatctaggtagagagggaaagtttggcctgagaaagtttgagtggtgggcgctcgcagagcgtgagttgggatggggcaagggatgtggattttcaccgtaggggtggagtagccaggatgggagacgccactgaaaggcagagcgcaggagttggcgagggagggtcctggctgtcacagttggacgcgcgaacggcagcgtctgggcgacaggcgatgtcccagccactgaaaccgtatttgggggcactttcaaaatagatcaggagaaaataaaaacaatttgatttttgatttttagagataccaaaatcacaacttgatttttggaggaattaaagcaacctgcgatgtcaaggctacgtaggttgaactttgcaggttgaccgtgtgtgacttggctaacgcaagagtgagtgacagatgtaagcatcggaaagggcatcatttctttgactgcttgttctcaagtctggaagagatcggcgtcgtaatcacagaagccagacctccactttcctgtgacagagggagattaccgaggcattttagagccaaggcgggtcaaatgataattgcttctaattggcatccccagaagcaccttaattatttatctgcagctgtcactcaaagagggaaattcttcctacctttggaaaactggttttctttcatattgttattctaatacatacaaagcaaagcacaaaatctgcaagagcaaagatatttacacgaaagcaaaggtttaagtatctgatcattaaagtgttgttgtgccgtctttaaaaatgaggtctgaaaaacagaagctatcacgtgaaaggtgaaacccgtaaagaaggggtgaaaatgagggggacaggtaattcagaaataagatccagaagtgagaaggtgaggtaatagcaacctggtgtgtgcagcatttctaaaatgaaagagaacaaataacaggaacctggggaatttgagaacacaaagaagcatagtatccatgaattatgaagagaaacagatacaaactagaaaggattgtaaaaattatgtgaccaaataatactttgattgaaccttcaatataaaaatatattttcattagtaaatccaaggtgcattgcagcttctggagatttaagcttagcctaaagtctgagacacacctacagtttcattttcaaagtaaaacattcacctagtaataaaatgagttttaattttcctatcagtggcatatttagggcatatttttggaagattagtatgcaaaacatcaagtttgtcaattttttcctgttgcaatatatgactaactgaagttttgaaacagtaagataacttctatttattttaaagtttgcacctagagacaagagtttgacgtatgacgactgcacatctgtttgatagtggtgcttaacataaccctgatttgaaaaagtggcattattttgttcagtgtgcctgacaggagggagaaggaaagctatttgagattagttgactttaaaatatatgagtggaactaggaaatgctaatatctaacttctcagcccaactgccggtaattatttcactgggagactttcaagtaaaaattgtgggacattttggccaatgggttagcatctggattacaaattaaggcgtaatttttacctgaaaagagacagccgggctgaaagcaaagtccgttaagagtgaaacaagaactaagaataaaataacacagacttgaactgtgcaatcactctgaatatttaatgggtgccacaagtacccagaagaaactattgttatgttaatgcagcacctgacatactcttcttatttcataggcaaagtactagctctgtgattagattgaattctccaacaacaacatctcagattatggcaagaaagaaaaggagaggggtatgtgatttttccccctttttatttcatgtaacttatactattgtgtaacagttacattttttcatttgagtaattttatcatttgtgaattcataaacttttgttgtttgcttcttttggatagattatagagaaaaggcgtcgggatcggataaataacagtttatctgagttgagaagacttgtgccaactgcttttgaaaaacaagtaagctatcccctccccagaatccccccacccaccccgccaccccccaaaaaaaagctcaaacacaatctgattcgctcatctgggaatgtgggttcttgttaaagctcattaaaataatagtgtatgtgccctgatctggcacagagcagctatttcaataaaatgctttgttgtggcaaaactattaaaaacataatccatcatgaagttgaaaaacatttccattctttagcttattttccccttaagggtaacagtgttcatgctttctctgttctttctatgaataccagtagtggttttatttaaaactgtgctgtataccgtatccttcaaaaaaaaaaaaaaaaaccatttttttctcaaaatttttttaaaatgtaatatttttaattaaaaaacaatcagagcccaagaagtaacatctctagctctatttcctaaatgataataccactaaaatttatttaccaagccatttgctttcatttttaatccctgggttggtagaatgccatttgatttgggtcatctttttagaagtttggtaaaaatgaagttaatcataaatgccccttttcatagttacctattcctttacaaaaaaagaaagaaagaaaaagattttgcacacttagaaaagtagaaagccaaatgtttaaatcttttgtggttttagaagtcatggctctccccctgccgcagtggttaatgacacagatttctaagagtatctttcaaaggatatggcagcatgtccttgttgaaaatactttcagtttaattccaataagacaacagttgtttgtttattccattttgtttgtttacttcatgaatctgcaaacattataaaacaagccctacaaagtccttggaaattatccagaaagtgcagtttcaattattagtgactttactgaatctgcttgtaccattttcatggaaaaattaaacgctgaccaaatacaaaacataatatgctactgattatacatttttaagacaaaaagcacacccaatctatatgcagagactgtgtttgataaactaaaaataatgtggaaattgtagttttgattagtagcattttcagtgccaaataggcttcaagtgaaaatgtcagtaatcaatgatgtttttaaaatttggaagtactgaaatgtctgcagttatgaggcgaagtctgtttgattttttttcttggtttgttagattttttttttcttaaatgttgacttaaaccttaaaagcaaacatcagttgtttggcagttagttaccataaacacaagctttcccatttgcagagcttggctaccaacccaagtgagttggccctgtcacaatatgattagaaaagtgttctttagagcagttaagtaactctggcactctcaccgtacgtggtgctgataatttttacaaaacaagtaaagcatagggacctgaaataaaccttagtgtccttaaaaaagaaaaaaaaagagaacatattggtaattatttagctcttccaggaaatgagaagccacccacagtccccgagacagcttgaaatggcacatttgtatttcaattggttaccagaggtttccttattctgaaagcagggacataaaaatatatttgcaagacaattttattaagaactattttaaaaggttcaaaaatccttaagcatttatgatgcttcctaggtaagcagtaaattattgcttcttgtttgtgagcttagaaattcacagtgacacctgctggtaattattggggaaaaaaaccttaaaagtcgtcctttttaaaatttttggatctgcttgaaatgcagatccaattatatggttctagtgtgaataccttatttcaggacttagtaggcctgtgaaaggacttattggagttttctattttaaaaatatttaacaatcaattgctaaaatcctatctccttatcttctggagttgttatgcaactcctctagactttggctttatagaagactattgatgccccatagtaaaacatattattaaccaagacacagattgaatgcaaagtttgagatttttacaactgaaatcattttgctgtggtgatcttaggagaataattattcttatgatttaaaaaagtcattctagtttcttttagtctttaaaagttaaaatggcaaatacttgtcattaggtatgacattaattagtgctttcatgtaaagtttggaaagaattcgaagttttctgtgaaaaaataaaagttgggattgtctagtgagagggaaattgaagccataatgctaaattcagtgtataatgtttcagattagtttctgtaggacataggattatttatttatttatttatttatgaagggatctgcaaagttagaaaaagctgaaatattgcaaatgacagtggatcatttgaagatgcttcaggcaacagggggtaaaggtaagtagatgacttcatttttttttttttttgccttttttacctttctcttttcatgttattccccctaatattgtaaggaagtcatagctgaacagttctttaacaagctgagataggaggccccagattaaagccatggaaatcaatgctaatggcaggattgaactcgtgggaaagaacttttggaacaaaagaagcacttgaccctgggcttgtgtttgctttcataatactgtgggagtaaagcttcattcacagcagcctggtcagagatttgtttaggacttaagaagcgcatgctggaatctgtacagaaagaacaaaaaacaaacacacaaacatccaaacataaacaggaggttagaggtaatccttttctcctccttctgcttctttcttcctactccttctcctcctctgtcttcattaaatgaaggctaagactgaaaataattcagctattccaaaggaattgactctagagttattttcattattgttttcagatttttgcttggtcttgaatttagaccaaacagaacagttgaagtgcaggtaggaagtctctacaccagaagccattaatggagcagagtcattcttggggaaagcaaacaggagcaggcactccaggtccagggccctagagaggtgtcctctgtactggatagtgacttagggagtaattgtcgaggtggtgagagaggatctcatctcatgctaaaaacagccttgagatcctagttcactcagatttcattatcccacttacacatcacaactcagacttgattttgttcctctgaatctttttcatccttcaaagaatcctttgatattcaccttagccaagggtgttattcagtatatttaacaactgaataaggagaaggtatcagaaggatttaagggctccaactaaatcctgaaggcctcccggtgctcagcattaaccttttactacactgtatacgggtcctagatcagggcagaggcaggacattggagggaagcaactgttaccaatatttaactcctgtatggccataccattgaggatctctagaacatcagccctgatcttaaccatctttttcctgcgtctagtagggagggagggtaaccattgtacagagaagccccaatgggttgacttttcccagattgtaccttctcaaggaaccatcctgaatgatggcatgaaatgcaaacattcttacataatagaaaagataactggattaaatcacagaagccaatgatccagcctagcttgaccactgctgtgcctctgacctaagaaaaaagtctgggctgcactttgagggctacactagcagcatgagcgccaagggcccctgcagctccatgattctgtctctacaactgctacctcaggatgttaggatactgattgaattagtcatgctacaagaaaatttgtttgattgctttacttcccttagcattgttagccacaaggctaagttttctcattagggtttcaaatatttggcatgagctgtacttctaaagagtaatattgttcttaggctttattataaaaactaagttccatcttggttgctattcttggccacctagacagtcctaaaatttgtcccagaatagtttgtgaacagatatttccaagtaggctccatacacgtcacctgactgtcaggccattgaagaggtcattgcactggagaatggccttcaagaagggagctggcggctgggtgtggtggctcatgcctgtaatcccagcactttgggaggccgaggtgggcggatcacctgaggtccagagtttcagaccagcctgaccaacatggagaaatcccgtttctactaaaaatacaaaattagctgggcatggtggtgcatgcctgtaatcccagctactcaggaggctgaggcaggagaattgcttgaacccgggaggcagaggttgtggtgagccgagatcgcgccattgcactccagcctgggcaataagagtgaaactccatctcaaaaaaaatagaaaaaataaaaagaagggagctggctgtttgggttaacattgtaaaagaataccaactgcctcatagtgcagtggtgaagggcatcgtatctgtagctggattgcctgatttcaaatcctggttctgccactgattagctctgtgactttgggcaaattaccccctgcgagctggtccagttttatcatctgtaaaaagaggacagttgtagtgtccatactatataactcataaggctgttacaagttaattcacttaaggccgatagaatagtgctggtgtagagggagtggtatggacatgtatgttactgttggcccaagatccattcacaaaagggagctacttatcatcatttccctctgaagtccacaataggataggaattgcataatttatattcctttaagatataacagagagctcagccatatatgacaacatagcaggcaaaccacaaatttcaattacttcatgaccagtaatgaaaattcttagaagctcttggggctccaattctgttagttcattctttatagtctgtcttggtatgacaatagtatctagagaggatttagtagaataacctaagtttcgaaatccctctggatttctggactctgtctattctattcgttacccccgtctttctctcatgggagtcagaagtctgcaaagccctacagaaccctgaggaccaaaatgtgaaatctttccatgaatacctcttcttcaggaatagcttttcatcctaatccaagaggctctgtttgttaactatgtcagagtcctgggatgataactgtttttgctgctgatcttccgtatttcatgatattctcttggtatcagctttgtactgctgttgtttctgttttagtagtgtatatatttgccacaaatatcttttgggaacttccaaatcgttggaattttagctttaggactcttaatatatgtgactactatctccaaagttctttgattacagattaagatagccaaatttttaataggtgatgaataaacaggtaatgctttgatcagcaaaaacatagataatgtaaatgttttagataaaaataactgctgggtgtggtggctcacgcctgtaatcccagcactttgggaagccgaggcaggagaatggcttgagttcaggaggtctagaccagtctgagcaacatagcgagatcttgtctgtactaaaaatcacacagattagccaagtgtggtggcacatgcctatagtcccagctactcaggaggctgaggcaggaagatcacttaaccccaggagatggagcctgcagtgagctgtgattgggccactgcactccagcctgggtgacagagtgaaatcctgtctcaaagataaataaattaataaataaccttatttgaatgtgatatttcttattcatgtatatacacatccccaaaatgaatagaccaaacttttgatttggaaattactttttaaaaagttgtaaatgaaaaataatctgtttttatataccagacgtcactcattcaaagtgggcaacatttctccatatgtctgattattattgtgccctacatgccctacatgggcactccaataattagacattattattttctattctaatgtattatcttcagacagagactcagataaatgtgaccaagctctagccatttttatggtagtaaccataggtataggagtgcatgcatatacactgacaaaattaatatacattttttttcttgggtgtatgctagaaaaatgtaaggacatatatttgaacttcagataaactaggcgttgacatatagtattttcatatcaggaacttagccttatattactgacagaaatataagatcttcaagtaagaaaccaaattttttttaaaaactcattttgttttcattaaattttttatacaaagttatgacaagatggtttcactttgttgataaaaaacattgttagtcaagaagcagttatgaatttattgcgattctagcacatttctaaagtcctcaagctgctaagatgcacttggcatctctgttaaaatgccaagagagtaaagatgtttcagataagccctttaatctccaactcatgtgacagagacagagagactggaactctgtatttccatgaaaaagtttcctggagaatttcactatcccacaatacaaagggagagaccccatttctttctctggaagtgtttgaaacgcggatgttcttaatttttttccccactgtgatatttagctgcaagaacaactgtagcatattgcattgccagagttgtcacacatgtgagtggcaaagtatactttcttaacttctgcaaaaaattaaaaccataaatagctggcaatatttccagaaaggattatcgttccacttcagtcttctgaaggacagagtggaacatcagtgggtggttattgttgactataccattttctcacccctacctcccgcccatctctctcctgttccctactttgctcaaacccacttttaggctactttgacgcacacgctcttgccatggacttcatgagcataggattccgagagtgcctaacagaagttgcgcggtacctgagctccgtggaaggcctggactcctcggatccgctgcgggtgcggcttgtgtctcatctcagcacttgcgccacccagcgggaggcggcggccatgacatcctccatggcccaccaccatcatccgctccacccgcatcactgggccgccgccttccaccacctgcccgcagccctgctccagcccaacggcctccatgcctcagagtcaaccccttgtcgcctctccacaacttcagaagtgcctcctgcccacggctctgctctcctcacggccacgtttgcccatgcggattcagccctccgaatgccatccacgggcagcgtcgccccctgcgtgccacctctctccacctctctcttgtccctctctgccaccgtccacgccgcagccgcagcagccaccgcggctgcacacagcttccctctgtccttcgcgggggcattccccatgcttcccccaaacgcagcagcagcagtggccgcggccacagccatcagcccgcccttgtcagtatcagccacgtccagtcctcagcagaccagcagtggaacaaacaataaaccttaccgaccctgggggacagaagttggagctttttaaatttttcttgaacttcttgcaatagtaactgaatgtcctccatttcagagtcagcttaaaacctctgcaccctgaaggtagccatacagatgccgacagatccacaaaggaacaataaagctatttgagacacaaacctcacgagtggaaatgtggtattctcttttttttctctcccttttttgtttggttcaaggcagctcggtaactgacatcagcaacttttgaaaacttcacacttgttaccatttagaagtttcctggaaaatatatggaccgtaccatccagcagtgcatcagtatgtctgaattggggaagtaaaatgccctgactgaattctcttgagactagatgggacatacatatatagagagagagtgagagagtcgtgtttcgtaagtgcctgagcttaggaagttttcttctggatatataacattgcacaagggaagacgagtgtggaggataggttaagaaaggaaagggacagaagtcttgcaataggctgcagacattttaataccatgccagagaagagtattctgctgaaaccaacaggttttactggtcaaaatgactgctgaaaataattttcaagttgaaagatctagttttatcttagtttgccttctttgtacagacatgccaagaggtgacatttagcagtgcattggtataagcaattatttcatcagttctcagattaacaagcatttctgctctgcctgcaggcccccaggcacttttttttttggatggctcaaaatatggtgcttctttatataaaccttacatttatatagtgcacctatgagcagttgcctaccatgtgtccaccagaggctatttaattcatgccaacttgaaaactctccagtttgtaggagtttggtttaatttattcagtttcattaggactatttttatatatttatcctcttcattttctcctaatgatgcaacatctattcttgtcaccctttgggagaagttacatttctggaggtgatgaagcaaggagggagcactaggaagagaaaagctacaatttttaaagctctttgtcaagttagtgattgcatttgatcccaaaacaagatgaatgtatgcaatgggatgtacataagttatttttgcccatgcctaaactagtgctatgtaatggggttgtggttttgtttttttcgatttcgtttaatgacaaaataatctcttaatatgctgaaatcaagcacgtgagagtttttgtttaaaagataagagacacagcatgtattatgcacttcatttctctactgtgtggagaaagcaataaacattatgagaatgttaaacgttatgcaaaattatacttttaaatatttgttttgaaattactgtacctagtcttttttgcattactttgtaacctttttctatgcaagagtctttacataccactaattaaatgaagtcctttttgactattttttatgtggatgagttgctttgcagaaaagtttccttccactttctatgtggaaagtcaacatgaatttcaagaggtctttatttactaacgatccaagctatggcttttctttatgtctttcaaaatcatttgatataattcacagcttgcctgaaaataacatttatctgagcttgtaaactaagcataggcagtaagatacttggaggcaagaaataatcagtttcctctgccttttattcttaactacagttcttggcaaagtgcaaattcaagacttccaaatggtataccaaatataggataataagctagaacatgtcatacatgttgtaattcaaaaacatttgtagagtgttttaaaaacatcacatacatacatgataggcgtgtacatacgtcctaatgataaatcccttgtgcttcaatgacaatttcttttgttgctgtggagattgtatgggtattgcctctgcttcagtgaggcctaaataaaccatcatagagctcctgaagctattgggccaaacaacataaaaagaatgaaagtgatttttattatgcttatcaatttgttcaaaggaaaaaggagggcttttatattctggttttgaaaaatccagcaagtagtttaatttctgtctgtaagtgggtaatgaaaaggtcgaggggaggcaaaagcaaatcaccttgtttcttgtgtctataagccttgtggttcttatattttccagctggctctaatagaatgaggtagcaaataagaaaattgatttcgttgtcttaggtgtttgctttataatcatgatttgtggacaacagccatataatttttactttaagatctaaaacctgaatgtattcctattgtaatgtcagcattcagagaacttcttttccttttttgaaatgtaaacttttagagatcaggaatttaaaatttatttgaattaaatattttaagataaattcctttccttcctccttccctccctttcttttactttttgttttttcttacattttttattgcaggttatatatgtattattatttttcttttttcttttttttttttctttttcaagacagggtctcactctgctcactctgtcacccaggctgaaatgcagtggtgtgatcatggctcactgcagccttgacctccgaggtgcaggtgatcctccaacctcagcctcacgagtagctgggaccacaggcatgcaccagcacactcggctaatttttgtattttttgtagagacagggccctagtatattgcccaggctgctcttgacctcctgcgctcaattcatccatctgcttcagcctcccaaagtgctgggattataggcatgagccttcatgcccagccagattattatttttcaattccactgactaaaatatttgcaaatgaacttgcaacatagttaataagaaagtgttcctaaagataatcgttgtcagtaattcaatcatttcaagttaattatgatcaatgtttcatatgatcaacttgtagcatcacatctcactgtttatattaacctgaccaccggaggttgccatctcccatccaagtgttctgtgaaggtggtattccaccatcagatgtggtaattctcatgtttgctaccaaaatagaaaaagagttataccctttaaagttattttagggaaaaagaattttcagggtttgatttattgatggttgcttttatttgtgtaaaagtcccaaaattaactcaaaggatttttagtaagataaaaggaaaaaggtaacacttttagaaatttgtgtttttccaactgtttaaagctatgtgcatgactaattagaaattttgtttaaagttcacgtcagtgagccagaaggtatttttttaaaataactgttatgtggcccagcattgcactgtatatgttgagttttgcatggtgtatagtagcacatcaaagtacaatcctatagactgatagtgataggtatggc

SEQ ID NO: 12697 - DNA, 36317 bp, Human
ttcaggagttcttgtaaggcaggcctggtcctgacaaaatctcccagcatttgcttgtctgtaaagtattttatttctccttcacttatgaagcttagtttggctggatatgaaattctgggttgaaaattcttttctttaagaatgttgaatattggcctccactctcttctggcttgtagcatttctgctgaaagatctgctgttagtctaatgggcttccctttgttggtaactcgacctttctctctggctgctcttaacactttttccttcatttcaaccttggtgaatctgacaattatgtgtcttggggttgctcttctcgaggagtatctgtgctgttctctgtatttcctgaatttgaatgttggcctgccttgctgtgttggggaagttctcctggataatatcccgaagactgttttccaacttggttccattctccccatcactttcaggtataccaatcaaacatacatttggtcttttcacatagtcccatatttcttggaggctttttcatttctttttattctttttctgtaaccttgtctccttgctttatttcactaatttgatcttcaatcactgataccctttcttccgcttgatcgaattggctattgaatcttgtgcatccgtcatgaagttcttgtgccatggttttcagctccatcaggtcatttaaggtcttctccacactgtttattctagttagccattcatctaatcttttttcaaggtttttagcttccttgcaatggattcaaacacccttctttagctcagagaagtttgttattactgaccttctgaaacctacttctgtcaactcatcaaagttattctccatccagctttgttccattgctggtgaggagctgcgatcctttggaggagaaaaggcattctgatttttagaattttcagcttttctgctctggtttctccccatctttgtggttatatctacctttggtctttgatgttggtgacctacagatggggttttggtgtagatgacctttttgttgatgttgatgctattcctttctttttgttttccttctaacagtcaggtccctcagctgcaggtctgttggagtttgctggaggtccattccagaccttgtttacctgggtatcaccagcggaggctgcagaaccgcaagtattgcagaagagcaaatattgctgaacaacaaatattgctgcctgatcctttctctggaagcttcgtcccagaggggcagccgcctatatgagttgtctgtccacctctactgggaggtgtctcccagataggctacacgggcatcagggactcacttgaggaggcaatctgtcctttctcagagctcaaacgcggtgctgggagaaccactgctctcttcagagctgtcagacagagacgtttaagtctgcagaagttgtctgctgcctttttttgagctatgtcctgcccacagagatggagtctagaggcagtaggccttgttgagctgtggtgggctccacccagttcgagtttcctagctgctttgtttacctactcaagcctcagcaatggcggacacccctccctcagccaggctgctgcctcacagttcaatctcagactgctgtgctaggagtgagcaaggctctgtgggcgtgggacccaccgagccaggcacgggaatcaccttgtctactggttgctaagtccttgggaaaagcactattttggtgggagtgtcctgtttttccaggtagtctgtcacggcttaccttagctaggaaagggaaatcccccaatctcttacacttcctgggtgaggcgatgcccccgcctgcttcagctcgccctccttggactgcacccactgtccaaccagtcccagtgagatgaaccaggtacctcagttggaaatgcagaaatcacccgtcttctgcgtcgatcatgctgggagttgcagactggagctgttcctatttggccatcttccagtttcaatagttctttattttatttatgctatctatttcttttccttttttttttttttttttttttttgagatgaagtcttactctgttgcccaggctagagtgtagtggtgtgatctcggctcactgcaaccactgcctcctgggttcaagtgattctcctgacttaacctcctgagtagctgggactacaagagcatgccatcatgcccagctaatttttgtatttttagtagagatggggtttcaccatattggccagaatggttttgcattcctgacctcaagtgatctgcctgcctcagcctcccaaaatgttgggttacaggggtgagccaccgtgccttgctatttatgccatctatttcactgaagattccgcctctcatttcttgagtcattttttttaaatttccttaaattggacttcacatttttctgatgcctccttgtttagcttaataactgaccttctgaattcttttttaggaaaatcaggaatttcttcttggtttggagccattgctggtgagctagtgtaattttttgggggggatgttaaagaaagttgttttgtcatattaccagaattgtttttctggttccttctcacttgggtaggctatgtcagagggatggtatagggctcaaggctgctattcagattttttgacccacggggtgttctcttgctgtagtattctcccccttttcctatggatgtggtttccagagagctgagtggtagtgattgttatctctcttctgtatctagccacctagctggtctgccaggcttcaggctggcactgagggttgtctgcacagagtcctgtgatgtaaaccatctgcaggtctctcagccatggataccagcacctgctctggtggaggtggcagcagggtggaatggactctgtgaaggtccttagttttggttgcttaatgcactatttttgtattggcctcctgccaggaggtggcactttgaagagagcatcagctgtagtagcataggggcatcaggcagtgggcagggccctagaattcccaaaagtatatgccctttgtcttcagctgccagggtgggtagggaaggaccatcaggggggcagggctaggcatgtgtgagttcagactctccttgggttggtcttggtggcagctgctgtggtggatgggggtgttgttcccaggccaatggtgttatattcccaggaggattagggttgcctctgctgtgtcatgcaggttgtcaggggagtgagggaaagctggcagtcacaggcctcacccagctctcatacaacccaaaaggccagtctcactcccaccttgccctctcaaacagcaccgagtctgtttccaagcagtgggcaagcaagactgagaacttgccccagactaccagcctcctagctgtgaaagcaaacggggctttcctgcctccctgcctgtggagtctgcataccagattcacaccctcccctgaggtctggacaggaaacttcaggttctgttggaattgttacaaagttcagctggaggtttccttttccctgtggtcttttccaaatacctctggcagccctccccaaggactcctatgagacaaggcagaaatagcttcccaggggactcagagagtccacagggcttttcttgctgcttcctctatccctgtatttcactcagctctctgaatcgacccagcttaaggtaaggtcagaatcttctcccatgatctagaccttcaggttccccattgagggtgtgtgtttggggcagacaatctccatttcccacttccacagcttgggctctatttggggtgtctcctgggtcctctaggagcattccgcttccttcagatggtctgtgagtgctctcagctttcctggttaatttctgcagtagttctggagcaaaagttcacaacgtgagtctccatacattgctctgtctgtccacgtgagagctgcagtctagtcctgcctcttgtctgccatgatttcctagaataactttctactatggtttttgtttgtttttgtctttctacttttaaaaaatttctgagatatacttttagttgttttcagtctttgagtcatgttatcccttttcattttcagctttatagtgtattttttctaatcctaggtgctgaaaatgacacagtaaataaatacacatgttcagctcaccatcttgagccattagttctagtaaattcatgttgtatttactcaggatgatacctaatactctattcaacgattccattatcattaagaatagcacattaggatctatttttttaataatacatgctttaggcctggagcggtggtttacgcctgtaatcccagcactttgggaggcccagtcaggtggatcacaagatcaggagatcaagaccatcctggctaacacggtgaaaccccgtctctactgaaaatacaaaaaaattagctgggtatggtggcatacgcctgtagtcccagctacttgggaggctgagacaggagaatcacttgaacctggcaggtggaggttgccgtgagctgagattgttccactccactctagcctagataacgaagtgagactccgtctaaaataataataataataatacatgctttagtacacaaagcacttgacccccttttttctctttattctggaagtcttacatatacagttttcttttcttccttattttccagctaaagagtcaaagttttctttcttccatcttaagttagtgaatttaaactgggtattttcagaaagcaatggtcatgtatactaagatgcttttaagagaactgactttggttataaagagatttaatgcaagcctccagtttaacttggaggactgagtcacccctgtaataacatgtttgtctgaaccacgcacaggacatcctttgccattcaacctctgatttgcacaaggtgactaaaggaccagcagcaaacaaaagcaaaggtaaaatagacttttttttcctgtttgtaaaaattttaaaaattgtttttagaaatttgaggagttagaaaaaagccaatattaatttcttggaatactcaatttcttttgcagcctaactttacttaattttcaaatgcattaccttttgaaatatgagtttgtttttatgaaccaagcagcctaaaatacacatttgtcactgatagttacgagctaaatttcagttaactttttatttattataaatctacatttgaaaataattcccactttaatgactactcaaggctttcttcatttttcttgtgcacatagtttctgtgattgcattactaaccttaacttgtgatagcatcaaaatgtattccatgaagcaggttagtaaattaactacaaacaagccataggaacacatgacttcatgagacagccacaactttaatattcttttgaatcaatagatgtaaagcactcctcaagctaactttataaacataaatgttttccattagagtattagtgcgtattttgacaaagattttacttttgcaccatctttaatgaaacatgtttttcatacctaattttatagttatacttaccatgatggtcaatacaagaggactgtttgttggaataagtattgcagattttaggaagcatgcaacatttaaaagggctcagaaagtggatgatttttggttgtaaaactgggtcgtacattttctttccaaatattgttaaagtgactgaatatttagagataacagtcatctgacatttcaaaaaagaaaaatcttagtaattggggagaggataaataaataaacatatacatatatgtacatatggatagatttagattttccagaaaagaaggaacaagtaccaaaacagtataaggaaggtaaatcttaaatcattcaacctgttaaagagaaatcttaaagttgagaaatttaataatgatggggaaaatgctgtttactttagtgactatgtatgtgactgtatgtatgtatataaagtgaaaatttgaaaaattatgagataataaaacttgttatctctagatcctggagtacctgaataactaatgtacagtctctctctctctctctctccctctctctctctctttctctttctctctctctttgagacagggtctctctgtcacccaagctggagtgcatcggcgcgatcttggctcactgcaacttctgcctcctgggttcaagtgattcttctgcctcagcctcctaagtagctgggattacaggcacccaccaccacgtctggctaatttttgtattttttggtacagacagggtttcatcatattggccaggctggtcttgaactcctggcctcaagtgattggaccattttggcctcccaaagtgctaggattacaggtgtgagccactgcaactggcccaggctttcttttttaaaacaatatacataaacaaacaaaagagaaaccttttaagacaaaatttttgttccttcatagacatgctgacttgaatcatcttcataatacttggttctctgcagggtatggtggagcgtgcctgtagtcccagctactcaggaggctgaggcaggagaattgcttgaacacaggaggcggagattgcagtggaccgagatcgcatcactgcattccagcctgaacgatggagccagactctctcacaaataacaaaaaacttgattctctatttcacctgtttatacaaaactttctatatttctatgtagaaacatgtttctatatttctcatatgttttatcttacatagtagcatgcaaccctcttacataccaatcaggtagaattagagtgacactggatttacctgtttgtttcaaagctttgggaattcttccaataagtgtgacacatgttagaatcattgttacttgagatacttattgtactgataaatgcaatacaattgtagcaatagctaagaaagcttagtcacacgatttatttcagccttgcttgtaaattagaattcagtttgaggatggaaagaagagctcttgttgaaatatgaatacttagatttttgttgctgttgttgagacagggtctcactctgtcactcaggatggagtgcagtggcatgatcactgctcactgcagccttgaactcctgggctcagatgatcctcccacttcagcctcctgagtatctggaaccacaggaacgcaccaccagccggctaattttttgtattttttgtaaagacagggttttgccatgttgctcaagctggtctctaactcttgggctcaagcggtcctcctcctcggcctcccaaagtactgggattacagtcttgagccaccgtgcgactctacttataatagaattacagatactgtgaatttctaacaagaacaacctgtagttgttttgttcacagaccgaagtctctttacctaagtactaagcatgggcctaatgttcataataggcccaaatgcatgaatcctgtgctctgtcttatcatgaatatgtgaaaaatctaaatctcattcttcgaggagcaatatttctttgatacactatattgggtggttgaagaactggctacaatcctaggctggagttcctcctgcctttgtcaagagaattccagaacgaccttattgcatccttagtctaacccaaaatctatgattggaacatttccaaatttccttattgtattaggaaattctctcaagattacatctggaaatcaaaatctattgtgaaacattttgaagttataaggtttgtgtaattagactgcatgcaattagcagtcttggacaaataaacttatttttaaagaattaaaaaatatttgtatgaaaaagtatttcttcacatttatggttaatgtatgttgctatgaattaatgtaggaacgcaacttactttactaagatccaagtgcaacacagttctcacaccatgtgaatgggaaaccaaagtagacaacaaattatttaatgatcttttaaaaaatacatgcaaattaatgattagttaaatattacatttgatgtttcaacaaagtttttttaaattatactttaagttctgggatacatctgcagaatgtgtgggtttgttacgtagctatacatgtgtcatggtggtctgctgcaccaatccacctgtcatctacattaggtatttctcccaatgctgtccctcccctagccctctgccccctgacagcccgtgtgtgtgatgttcccctccctgtgtccatgtgttctcattgttcgactcccacttacgagtgagaacatgcggtgtttggttttctcttcctgtgttagtgtgctgagaatgatggtttctagcttcattcatgtccccgcaaaggacatgaactcattcttttttatggctgcatagtattccatggtgtatatgtgccacattttcttgatccagtctatcattgatgggcatttgggttgtttccaagtctctgctgttgtgaatagtgctgcagtgaacacttgtggatgtgtctttatagtagaatgatttataatcctttaggtatacacccagtaatgggattgctgggtcaagtggtatttctggttctagatccttgaggaattgccacactgtcttccacagtggttcaactaatttacattcccaccaacagtgtaaaagcgttcctatttctccacattctctgaagcatctgttgtttcctgactttttaatgattgccatcctaactggtgtgagatggtatctcattgtagttttgatttgcatttctctaatgaccagtgatgatgagctttttttcatctttgttggccacataaatgtcaccttttgagaagtttctgattatatcagttgcccactttttgatggggttgtttgtttttatcttataaatttgttaagttccttgtagattctggatattaaccttttgtcagatgggtagattgcaaaaattttctctcattctgtaggttgcctgttcactctgatgatagtttcttttgctgtgcagaaggtctttagtttaattagatcccatttgtcaattttggcttttgttgccattgcttttggtgtttcagccatgaagtcttttcccatgcctatgtcctgaatggtaatgcctaggttttcttctagggtttttatggttttaggtcttaggtttaagtctttaatccatcttgagttattttttgtataaggtgtaaggaaggggtctagtttcagttttctgcatatggctagccagttttcccagcaccatttattaaatagggaatccttttccccttgcttgtttttgtcaggtttgtcaaaaattagatggttgtacatgtggtgttatttctgaggcctctgttctcttccattggtctatatatttgttttggtaccagtaccatgctgttttggttactgtagccttatagtatagtttgaagtcaggtagtgtgatgcctccagctttgttctttttgcttaggattgtcttggctatacaggctcttttttggttccatatgaaatttaaagtagttttttctacttctgtgaagaaagtcaatagtaacttgatgggaatagcattgaatctataaattaccttgggcagtatggccattttcatgatattgattcttcttttccacaagcatggaatatttttccatttgtttgtgtcctcccttatttccttgacagtggtttgtagttctccttgaagaggtccttcacatcctttgtaaattggattcctaggtattttattctctttgtagcaattgtgaataggagttcattcatgatttggctctccgttggtctatcattggtgtataggaatgcttgtggtttttgcacattgattttgtatcctgagactttgcttaagttgcttatcagcttaaggagattttggactgagatgatggggttttctatacagtcatgtcacctgcaaacagagacaatttgacttcctctcttcctatgtgaatgctctttatttctttctcttgcctgattgccctagccagaacttccaatactgtgttgaataggagtggtaagagagggcatcctagtcttgtgctgcttttcaaagggaatgcttccagcttttgcccattcagtatgatattggctgtgggtttgtcataaatagctcttattattttgagatacattccattaataccagtttattgtttttagcatgaagaggtgttgaattttattgaaggccttttcggcatctattgagataatcatgtggtttttgtcattggttctgttgatgtatggattacgtttattgatttgcatatgttgaaccactcttgcatctcagggatgaagccaacttgattgtggtagataggctttttgatgtgctgctggattcagtttgccagtattttattgagagtttttgcatctatgttcatcagggatattggcctgaaatttgttgttgttgttgtgtctctggcaggttttgatatcaggatgatgctggcctcataaaatgagttagggaggattccctgtttttctatggtttggaataatttctgaaggaatggtaccagctcctctttgtacctctggtagaattcggatgtgaatccttctggtcctgggctttttttggttggtaggctagtaatttctgcctcaatttcagaacttgttattagtctattcagggatttgacttcttcctggtttagtcttgggagggtgtatgtttccaggaatgtatctgtttcttctagatttctactttatttgcatagaggtgtttatagtattttctgatggtagtttgtatttctgtgggatcagtggtgatactccctttatcattttttattgtgtctatttgattcttctctcttttcttctttattagtctggctagcagtctattttgctaaccttttcaaagaaccagctcttggattcattgtgtttttgaaaggtttttcatgtctctatttccttcagttctgttctggtcttaattatttcttgtcttcttctagcttttgaatttgtttgttcttgtttctctagttcttttaattgtgatgttagggtgtcggttttagatccttactgtttctgatgtgggcatttagtgctataaatttccctctaaacactgctttcactgtgtcccagagatctggtacattgtgtctttgttctcattggtttcaaagaacttatttatttctgccttcatttcattatttacccagaattcattcaggaggaggttgttcagttcccacgtagttgtgtggttttgaatgagtttcttaatcctgagttctaatttgattggactgtggtctgagagactgtttcttatgatttatgttcttttgcatttgctgaggaatgttttacttccaattatgtggtcaatttaagaataagtgctatgtggtactgagaagaatgtatattctgttgattttgggtggagagttttgtagatgtctattaggtctacttggtccagagctgagtttaagtccagaatatccttgttaattttctgtctcgttgatctgtctaatattgacagaggggtgttaaagtatcccactattattgtgtgggagtctatgtctctttgtaagtctctaagaatttgctttatgaatctgggtgctcctgtattgggtgcatatatatttaggacagttagctcttcttgttgaattgatccctttaccattatgtaatggccttccttgtctcttttgatctttgttggtttaaagtctgttttatcagagactaggaatgcaacccctgccttttttgcttattcctccattcctttattttgaacttatatgtgtctttacacgtgtgatggttctcctgaatacagcacaccaatgggacttgactcttcatccaatttgccaggctgtgttttttaattggggaatttagcttgtttacatttaaggttaatatttttatgtgtgaatttgatcctgttattatgatgctagctggttattttgcccactggtcaatgcattttcttcacagtgttgatggtctttacattttggtatgtttttgcagtggcgggtaccatttttcctttccatacgttttgcttccttcaggagctcttgtaaggcaggcctgatggtaacaaaatccctcagcgtttgcttgttttaaaggattttatttctccttctctttgaagcttagttgggctggatataaaattctgggttgaaaattcttttcttaagaatgttgatattggcccccactttcttctggcttgtagggtttctgccaagagatctactgttagtctgatggacttccctttgtgggtaacctgacctttctctctggctgcccttaacattttttccttcattttaaccttgggtaatctgacaattatgtgtcttggggttgctcttctcgaggagtatctttgtggtggtttctgtatttcctgaatttgaatgttggcctgccttgcttggttggggaagttctcctggataatatcctgaagtgtgttttccagcttggttcccttctccccatcactttcaggtaaaccaatcaaacataggtttggtcttttcacatagtcccatatttgttggaggctttgtttgttccttttcattcttttttctctaatcttgtcttcacactttatttcattcagttgatcttcaatctctgatatcctttcttctgcttgattgatttggctattgatacttgtgtatgcttcatgaagttcttgtgctgtgtttttcagctccatcaagtcatttatgttcttctctaaacttgttatcctacttagcagttcctgtaaccttttatcaaggttcttaggttccttgcattagattagaacatgctcttttagctcagaggagtttgttattacccaccttctgaagcctacttctgtcagttcatcagccttactctccatccagttttgttcccttgctggtgagaagttgttatactttggaggcattttggtttttgtaattttcagcatttttgcactggtttttcctcatcttcatggatttatctacctgtgatctttgatgttggtgacctttggatggggtttttgcatgggtgtcctttttgttgatgttgatgttattgctttctgtgttttagttttccttctaacagtcaggtccctcttctgcaggtctgctggagtttcctggaggtccactccagaccctgtttgcctggtatcactaggaggctgcagaacagcaaagattgctgcctgctccttcctctggaagctttatcccaaagggcacctgccagatgccagccagagctctcctgtatgtctgctgacccctgctgggagctgtccctgttaggaggcatgggggtgagggacccattcgaggaggcagtctgtcccttagcagagcttgatcactgtgctgggagatccactgctctcttcagagccagcaggcaggaacatttaagtctgctgaagctgtgcccacagccaccccttcccctagttgctctgtcctagggcaatgggagttttatctataagcccctgactggggctgctgcctttctttcagtgatgccctgcccagagaggaggaatctagagaggcagtttggctacagtggctttgccgagctgtggtggattccacccatttcgaacttcccagtggctttgtttacactttgaggggaaaaccgcctactcaagcctgggtaatggtggacgcccctccctcaccaagctcgagcatcccaggttgacttcagattgctgtgctggcagcaagaatttcaagccaatggatcttagcttgctgggctccgtggaggtgggatccgttgagttagaccacttggctccctgtcttcaccccctttccaggggagtgaatggttctgtctcattggtgttccaggtgccactggggtacaaaaaaacctcctggagctagcttggtgtctgctgaaatggctgccagttttgtgcttgaaacccaggaccctgatagtgtaggcacctgagggaatctcctggtctgcaggttgcgaagaccatgggaaaagcatagcagctgggctggatagcactgtctctcaccacacagtccctcatggcttcccttgggtaggggagggaattctccaaccccttgtgcttcctaagtgaggtgatgccccaccctgcttctgcttgccctccatgggttgaacccactgtctaaccagtcccaatgagatgagccaggtacttcagttggaaatgcagaaatcaccctcattctgcattgatctcactgggagctgcagaccagagctgttgctattgggccatcttgccagctgcctttctttgtttctttctttgtttctttctttgtttctttctttctttctttctttctttctttctttctttctttctttctttctttctttctttcaatagaaacaaaacataattcagttggtcacataacatatactatttgttatttaaacctggtaatgatcaggctgattggcacaattcagttgcaacatcaagaacatcatcatttatccagaaggtgtacttgaagtggaaaactaggctcttaaatggagatatggaatgtctatgtagatcaagtgtggtggctcactcctgtaatcccagcactttgggaggctgaggcaagtggatcacttgagctcaggagttcgagaccagcctgggcaacatggtaaaaccctgtctctgccaaaatataaaaattaactttggcatggtggcacacacttgtagtcccagctactcaggaggctgaggtgggagaattgcttgagcccaggaggtcgaggttgtagtgagctgatattgtgccactacacttcagcctatctctatctcaaaaacaaacaaacaaaagaaatgtatgtgtagcaaccatgtaagatgtaaaccaaaaagtgaagaaaattatatacagacataatccaaccagctctttataagccaaaatctactcagattgcttaatttgatgggcttgaaatctcatagtcaagtttaacgaagattgacagagatattttaggtagaaaacattaggtgcaatgccaaaaggcgttacaaactcaggcatgacttaatcaaatatgtggtagtcagcacatagtggacataagacgtccattgagccatatggtaggattgctgtctaggttagaagatctgtcttatgtgaaaatgtcaaacagagaaaggcaagagtgcagagaggaatggggaaagggtagtgtgcaagatcctctcccatatttataaattagaatttaagttctagttcataaatataattttcaaaagttgagactttagttgataagaacagaatagacatcaatactatgtttagatatacaacatgccattactattatcattgcactcctctgcccctaaagacagtattgtgatattctgggaaggcaagttaaaacaatagaaataaaaattgaataggaaaaataatgaaacttcttctagtgtgctgtttatggtaactggctccagagtgtaagattttaacctgcactcttactgacttctgttatattgcactgaggtattttgtgttgtaaacacaccagggtagttggacgtaattcaaagaaagcaatcagatttgagaaggatttagaaaagtgtggggaagaataaaaagaaataaaaacaatgccatagacattgaagaataaaaaataaggtcagaagttagtcttcatcaaaaaggtatgggtgatgaaataaaatggaattgaagaaaatccaaggaaaaaagttatctgatgctgaagaagttaacaagcaatctagcttcctgagttatttaaaattaggctgaataaatcaccaaaactaatatatagtcaaagataaaaaagaaagaacaatcattttttcatatccaatttctccacatacttttatctgttgtaactagagttttgccttgtttacaatcagagaaggcctattactgtaaagtatatttttccactagtattaaataattcaccggtattgtgcattacattttgtggagaataataatactaatcagtttcttcaagcttatcatcagtgttcctaccgaacacctcctaaaccattaaccactgttaattttcttttaccatagatagtaaccaatcaataattagcttttaataatcaaatgtcagaatagagccttaacttaaagctctggctgatagtgttcatttccattaaaaaaaatcattcttatttcctgaaaagggatgttcttgtcagattgcagatgagcatacaatttctcaaataaaattataaaaatgatcttcataacaaaatgcaagtgagatgtaactttctttaggaaaacttgattccttatactgtagtcagaatcgatttgcatcttctcttatatatccaaagaactttgagtttttaaaatcagattgatggttttgagttagctgttacagcaacatattacaaaattccaacagaacttccttctcaaataaatctcacccatgctcacttctctcacttagccaccctgttctcttccctggaagcaagcaatataaccttttttgagtatccctcctgatatggtttggctctgtatccccacccaaatctcatctcaaattatcatcccatatgttgtgggagggacctgtaatccccatgtgtggagggagggaagtgatcagattatgcaagcagtttcccccatgctgttctcctgataatgcatgagttctcacaagatctgatggttttataagtgtttggaagttcctccttcataacacttctctttcctgccaccttgtgaagaaggcacttaatttccctttgccttctgccatgattgtaagtttcctgaggcttcccctgccatagggaactgtgagtaaattaaacctctttcctttataaattacccagtctcaggtatttccttatagcagtgtgagaacagactaatatagctccagagatattcctcagtacacaaattattatactgtgtacatatgtaatttgtgtgtgtatgtgtatgtgtgtgtgtatatatatgtatgcatatattcctttctttgaaaaatggcaacaatctatacacactttattaaaatttgtagcttgtgtacagacacacatgtaaaacaaatacatattttaaagactattttaatatctggtcaatgtccttatcaatatgtagaagaaacctcattctttgttataggtgcatagcattccactgtatacgaggccatgtcttatgtggcctttgccttatagtagacatttattttgttgtcctaattataagaattaggaagacattaattttgtcttcctaattataagaagtgctacaatgaattacatagaagcagaatttcttggtgaaaggttttattcattgataattcagatagaaatttccagtcttctgtttccactaggaatgtactctttcttcattcaggttggagtcaacccctgcacatttcaccttgctcaaatttcttatcctgctaaaatatatatgcttgtacagagagatagatgataggttgccatttgtaaagccaggggaaccctagtttttaagccactccattcaggactgaggcaaaatttgaaattaagccatgtttaccagagacaagacaatgtgatctggctacagcttttgacctctcaaatgtttgcctttcctctccactcttgtactcttaacattgagagctaggatctagggaactgggatccaactctctcctgcttaaatattgttctggtcctcaggcctgaggttggggactcagctccccatctctagtttctgtctgataaccccaactagtatcccaacactcctaatcaatggcttgggtcatttttatggggagggaagtattttaagttgtaatcttgactatggacattggaaagacttaaataacatttcgcagaccactggatggctttttagttcaacaactttaattaaaaacctgaagacataaatcaacttaatgttatcttaaggaacttagttaaaaacaggttgacagagggaacattctattaaaaatgtgatcctaagacttagtgtgcttttccaagaaatctgttgatcttggctgtaagaaatttcaagtcctaaaagaggagtaatacttagacaaagaccaagtgtatactttaatacaaagataatttaaacctctttcagattgtatttcttaaaactgcaaaatttgcttgcttcattaaaaacgaggcctttcagactgaataatatagtgaatttaccattagcaaaagtgacactgaaatagtcattttcacatatttacaaaacttaagcctatatttaagaagactggaaaggaaacaattttatacaatcaagatagtataggagttctaaaattagttcagatggagggacactgtgttctttgataataacataaaatagttatcataaaattcagtatctaatgatgaattatgggccttaatgaaatactgttatagagtagattatattataaacccataggcaacaagtttttaagaaaaatgtatgaaaaatacttaattgagaaacctctaacattaaaatattttgctttttctgctggaatactaaagagccagcttgcagagcattgatgtttcaaaagagaaaaagttcatcagagaaaaaaatagatgcctattattggctgttgctctaataagcttttattagaaaataggttggcaattagttctgcgaaattgagcacatagctttgaacttgatggttctgctctgtctctcagtctgataaatatatatgagtatatatatttttcatcattggcaacaaaatatcactttggtcagtactttccttaagggcttggaaataaaacagtgcatttattaaattccttagggaccatgaccttcaggatatctcttcaaactctcacggttttaggagcagacacttggcatcttaaaggtttttaaaacagaaccccaatatcatgaaaaaagaaatagaagacatgtagatttggaaaatcaactcgtttcactaatacctgaatattaagaagggagtatatgctttgaaaaacttttccagagcattcactctaatcgtaaagatcagtgtggatcaccatgctgtgtaaagttaaaaaacatcgcactgggtgtttgagaacaggcacttagagttgcaatcaaaatgaaaacaaattagtgcaattaatttattgatttataatatccttttcctttgtggtgattatttaaaatattatggtctcataaataactggtttgaactgctctcatttctgtcttagattattgcaagagctttttatagtcttcctgcttctctcttgtgtcttttcccttaaaggcttgcctcaacacagcagccagaggaatccagttaagcccatggcagacaatgtcattcttctttcaaagcccaccacatctttcccatctcatttacagtgaaagcctgagtacctataagccccaacaagaccctcactctttcttctctggctccttttacctagtcactgacctcttcaaaggtctttagagacagcagacatgctctgccacagggcctttgcacctgctttccctcatacttccccagacatcctccaggctgactcctcttatccttgggatcagtgaggcttgttaccatctaggaacaaatcctgccttatttatttttctttgttatcataatttgcaacatactgaatatttatttactgttcttatttattatctccctcccctacaagaatttaaactcagtgagggcagaggctcttgtttgttttgctcactattgtattgttaatacttagaagggagcctggtacatagaagatgctcaataaacattttctgaattcttataagaatgaacactaagtgcctctgccttcatcatacaatgtcagtgttccaaagaccaccaggagcacacctgcagttaaattagtttactttatcagttattgtgggaagggagggtgcacaccatgggaagccatggggtgtctcagtaagagggtattaggaggaaactatcatatgatttaggttttggctgagtgacttggtgaagagtctaagaaggcagggattttctctagattagatgttgtcagaaagcagaggcgttcctgtgattgggtaaagaatagcagtcattcattcagcaagagagagggatgtttggtattttgtgggttgcacagtgaccttcttttctgatcttagacaatatttaaaagtggcctggctttgtctcattttattatggtctgagagtaaacttgtccagactggtattctgtgacattgtttaagagaagcattatgcagcctagctgtgagtgtagtactcacagtttctgaatgccaagggttgctcttttttttcttttaatttatcacaagcaagtaagcttctttggggaaggagtgagaagggagataggaataagtaggggataggagatagaggcttttttgcagactcttgtagctgtacatggtggtcctgtctccctcaaaagaacatccctcctgccaccttcttcactgtctccttcactgtcaggaggaaggggcagtgatgaggtgaggtgcttgagccgacctgaaataggccctgtctgtttgctgcttttgccacatttgtctctggtcagggtaagaagattagaactatgaaaccaaggtcaacatagtagcagctaaaccttcctcacttccttctactagaggaggggtcaggagaaagctacttccctttacctatggctttaatgagtatgtcatttcattgaaaatcatttgttcaggggcctttaaaatgtcttcacagaagtttccttgttgaaggaaaggaactagtccttcctatatattcccagaacagaccttacttctaaggagagaaacctgggcattaaaatttaagggacaagtccaggttaaattcctcattcacttctacctccaatatcttgctaactctttctaaacattgtcatttagaggtttgtttacaggagcacatttgcctaggcggattatggaagggggaagggagaaagaaaaggaaggttgctattgctggtgatatggttaactgtggataattgcacaggttgctatgctacaagaactagtcaagataaggcagagctcagcggtggggattttaatggcataggtggggtgagggaaagaggtctagggaagctctgaagcaaagggcacttttggaagggcaggcttggggaggttccttggtgaaggaaggacaagagaaacagagattgcatggtgggacagggaagggaaaacagtgtctgagaggggtcacgtgaggggatctcctcccaacaagccatatttaactaggagggcacaccagtgccctgacctggctgtataggaagcagaaacctgacatacagcaagcagaagacacgggcacaggattttacttatttattttgtcttttttggtcgtgcacccacacattttatcaggagctatgtctaccatctgccatgtaaggtgcacctccagttcaccagaacaaacagttcaccagttctctttcaactacagtgtcttccctgagacactgagaacaataataacattccaagataggagaagagaatcacttggtaactttgtaataaatgaaccaggatgttctatggtggtgatgagggagccgaccaaaggggaaacaatagtcagtggaaaactatgttttgaatgagaccaaagcaggaagtatctggcagggtagatttttctttttttggtacacaaatatagtcttttctaatgtaactcaattttaaatttaaagaaaagcttcttcccccttctattaatgaatgcatatgtaaatctatttttcttacctggaggcaaaatataataaaaaatcaaagagaaggggaagttttgagtaccacaatttttcttactcataaaattagattcccttgaaaatactattctcttcaaatcataatttagagctacagtatgatatatttcatgctactaagtggggtaatcttattcagctttgtgcatggaggagtatattcaataaatgaaaatatctacctctatagctcctaaatactggtgttttgtgtttatccatttacttaggccttcttaaatgtctttggaggaagttttgtgaattacttaaaatttttttacagcagtgtccaaggcctgagaaataccatgaggtttggctggtgacacctggtggttagacgtgataattacacacaacatgtagcacaggctttactacaagccacaaaagcaccttgtattggtccattctcacactgctaatgaaaacattcctgagactgggtaatttataaagaaaaagagagttaatggactcacagatccacatggttggggacccctcacaatcatggcagaaggtgaaggaggagcaaaatcacatcttacatggtggctggcaagagagcatgctcaggggaaccaccctttataaaaccatcagatggcatgagacttattcattatcacaagaacagcatgggaaatctcgcccttgtgatacaattacctgccaccacgtccctcctatgacagggagaataggggagctacaattcaagatgagatttggctggagacacagccaaaccatatcacttctctataaatcagagttcctggttgtaagcaaccaaaacaaaccttgcttacttgagcagaaaggcggtgtcccttgaggacaatatctccacttaacagtaacattatgggcatcaggttcagaatctggatgccccagcttgctgctccttgacactggaatttacgtcaccactggcaatgtcacctcagcctccttgaatctcaatatccaaattcaaagcctagattaggatgcatctaattggactgacgacagtcatagaccaataccaaacctgcaaggaaggctgggacattttggcttatttaatgaaatatgggctttgccttccaagatacttatggtgcagaattgactactgaggaaaggggtctgtatccggagcacacagccaaaggacaaatgtctaccggacaccttaatctcactaggcatcaggcataaccacaatgcattttcatcttaatgacacacaagactgcaaacgttttatgccatcaaaccctttgatgagcttttacaaaaataatttcatagtagttttacaaagagatgactaaaaaataacttgacaaagtagccactatcgtcttccctcttctactatccaaacacctacctatcttctctttctctctcttttttttttttttttttttgagactgagtctcgctctgttgccaggctggagggcagtggtgtgatcttggttcactgcaaccgccacctcccaggttgaagcgattctcctgcctcagcctcctcagtagctgggactacaggcatgtgccaccacgccaagctaatttttgtatttttggtagagatggggtttccccatgttggccaggatggtcttgatctcttgaccttgtgaccatctcggcctcaccaaagtgctgggattataggcgtgagccaccctgcctggctctatcttctcttttaactccagtgtcttccctgagacattctgttacaccaggggtttggtctaggtcctgttgcttgctgcagagaaagccaatcactgagtcaaggagtattgctggggaagaaggccttatttgggtgctgcagccaaggagaataaaggatcagtctggaatccatctccccaagcaactaaaatttggggtctataaagtagggaagaaaagtaactatgtgtgggaaaacaggaattaaggaagggtaagaaagaggacttggtcaacaggcaagtggtcagttaggcaatcatgatgagtgaggcatctggtgtctcattgtttagatgtgataatctggtaagtttcagttccttgaaacattctgggaggcttgatggttggtttaccgagaaaggaacccagataagacaaatataactttcttaagttttaccctgggagggtcaatttctaagtttattcagaagaaacccaaaacatctattctttgggatagttgggctggttttaatttcttgccactcaaatcactttcctttccattcctacctactgcttactccaagaagtaattgctccaataaattatcatgtagtacttgttatgcatttttattatttaaattttacatcaccttgccttccatataaagtgacatcaggcaagccttttcatctctctaagcctcagtttccccatttgtaaaatggaaatgtaattataagccttatgtagttattacaagtttaaaaaaaatatttacaaagcagttaagcacaatgcctgggatttgatgagttttgcaaaatgatggtaaatattatttcacatctttatctgatcatgaactccttaaaggcaaggactacatcttattcattttgttttctggacatggggtctggtgctccatgaatgtttgttgaattgcatttcctgcccctgaatagaagctaggtctctacatatgcttctatatctcaatttatttataggcctctttgagacctttaagtgatacactttacaaatagtcatatataataataatatctatttattatttgagtctttttcctcaaaactatgactaacagaaaattaaatctctccacaggtcttctagagtgcactaaagcagaagataacgtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaaaccttttatagctgcttggaatgctccaacagatcagtgtttgataaaatataatttaagactaaatttgaaaatgtttcctgtgattggaagcccactggccaaggccagggggcaaaatgtcactatattttatgtcaacagattgggatactatccgtggtatacatcacaaggggtccccattaatggaggtctcccacagaacataagtttacaagtacatctggaaaaagctgaccaagatattaattattacatccctgctgaagatttcagtggacttgctgttatagattgggaatattggcgaccacagtgggcccggaactggaactcaaaagatgtttacagacagaagtcaagaaagcttatttccgatatgggaaagaatgtatcagctaccgatattgaatatttagccaaagtgacctttgaagaaagtgcaaaagctttcatgaaggaaaccatcaaattgggaattaagagccgacccaaaggcctttggggttattatttatatcctgattgccacaattataacgtttatgccccaaactactctgggtcatgcccagaagacgaagtcttgaggaacaatgagctctcttggctctggaacagcagtgctgctttatatccttctatcggtgtctggaaatcccttggagacagtgaaaacattttgcgcttctccaaatttcgggtgcatgaatccatgaggatctccaccatgacatctcatgattatgctctgcctgtatttgtctacacaaggctagggtacagagatgaacctttatttttcctttctaaggtaagaagcttcttgtccaatggtgggggatttcctccttatctctaaaaggacatttctttgttaattatgttctttgaagaattgatttcaattaatggtttgttatatgggagcataattcttccttgactagtcatgcatttagactcttcatttatggaaactgaattttgattatcttactcattattattctcttaaggaacaaagtaaggtgagaaagggttaaagtagataccagcaacgactacatttcctgcacaccaactttaactgtactcacttacaatcgggcattttggaaggttattgaaatgatcggcagtgagcaggttagacaatcaaaaaggatgttttgaaatggagtgtttgctcatacatgtggaagcagaattgtctagccacttaaacaaaaaaattctagggaaagtagtgggtattttaatctttgttttgttttttttttttcttcaagatggagttttttgttcttgtcacctaggctggagtgtaatgatgcaatctcggctcactgcaccccccacctcctgggttcaagcgattctcctgcctcagcctcccaagtagctgggtttacaggtgctcacccccccccacccagctaatttttgtacttttagtaaagacggggtttcaccatgttggacaggctggccttgaactcctgacctcaggtgatccaccctcctcggcctcccaaagtgctgagattacaggcatgagccaccgtgcccagcctaatctttggatttggataattttgtgtaacctttctacattgagaagactcaggacttgtggagggcttcacatgtgtgatgcagtgatgttttaaggtattgctggataccagtggtttaatatattttaacagaggcatttttcctttctccaccattacaaatttcaactcaccaatatctgttaaagacgttctgagttctaggcatcctaaggaggaggcatagaaaacacccaggtgagggctctacagtgaccaggtatctttggaacataaatggaatgtattcatcagagggagaaatgatgcatgtgtatgaaatatggtaaataccatacctccaacatcactcatgaggtgaaggaggaaggaaaaaaagtctctgttgtgaacttctattcataccacccagaaaaatcagtgaaaaataattgaatgaagaataataggaagtcagtaccgtctgaaaggttttaaaaagttatctaggccgggtgcagtggctcacacctgtaatcccagctctttgggaggttgaggcaggtggatcacaaggtcaggagtttaagaccagcctgaccaagatagtgaaacctcatctctactaaaaatacaaaaattagctaggtgtggtggtgggtacctgtaatcccagctactcaggagtctgagaagagaattgcttgaactcgggaggcagaggttgcagtgagccgagattgtgccactgcactccagcctgggcgacagagcgaaactccatctcaaaaaaaaaaaaaaagaaagaaagttacgtaaatctttataaaataatcttgactctggaatggaatcaaaatttaaataccagtttcttttgtaagacgtcttttctatatttgactcaaccaagttcctttctttagtgataataaattgacttttggaagaaacaataaactctgagggacaaaacgttcatttcaaaagatgaatttagactactgggacattctgcacattctgtgaacctggtataagcttctttttctatagctacagccacggaaatgctttctttcctcaggaaaaaaggagcaacagtttgggtttcatctcattctgcactctttttttccgagtggcaagctatttccaagtgttttaaactataagtgtacccaccattgtaccctattgactttaaaaatctgcccatgatttttttttttttttttagatggagtttccctctgtctcccaggctggagtgcagtggcgcgatttcggctcactgtgacctctgcctcccgggttcaagtgattctcctgcctcagcctccaagtagctgaggttacactgcatgcgccgccatgcccagctaatttttgtgtttttagtagagacggggttttgccgtgttggccaggctggtttcgaactcctgacctcaagagatccacccgccttggcctcccaaagcgctgggattttaggtgtgagccactgcgcccggccccgcccataattttttaaaagcctgatattcatttgtaccaaactcttaatgaccattaatggcttccatttctgattttcccaacaatgtctgaattttagaatgcacacacacatacagttaagattacaaaaaagattcactagtaagtagcaaatctcttaacctccctggacttagtgtcttagtgtcttcatgtacaaaatgggacaatattacctgccccactgacctagcaaaagtatgatgtaaatcaaatgagaacatgcatatgaaaacttgaagctctacagaaacctatgtgatatggctattacttttttaacagccatcaaagccttaaacttaaacatgggatatttaagagtggtatctcaggcaatagctatagcgtggggatatagaggcagtcaaacctcatttcagacagaagattgcctgcattatttacatataaatgcaacctagacataacctgatgctgtgcttttaaaacatttattatttattattagtttttcatttttatacatttacagggtgcaagtgcagttttgttacatggacatattgagtagtggtgaattctgggcttctagtgtacccatcacccgaaaaatgtatattttacccaacaggtcatttcttatccctcactctcctcccacccttgcaccttttggagtctccaatgtctattattgcactctgtatggccatatttacccatcgtttagctcctacttatcagtaaaaacgtgatattttactttctgtttctgagttatttcacttaaggtaatggcctcctgttccatctgtgagatgtgcttttaaaaattaacaacaggagtttccttgcctatagatttaaagatatttatccttgttattaattcatgctgtctccggtaaggcacaaaggcagctcattagtaatgctccagctccccacagtgggcacgttgcttacatgcactttgataagcgtcagggactgacaccgaagtgttgagtgaatcccctgagtagccctaccctctacttctgaaaccttgattcaggtccaaggatcatgtgtaggtgcaaagcaccctgtgccacactgggacctgggaggctcattttcagtacatctactttgttccttcttttttctgtaatgtgacaacaccactgtggctcaagctttcaggtggtcccaatctgctcccagaggcactttatctgtgactttcctagctgggtagtgcccttgattttctgatccccaaaacatagctgctttgtgattcattcagcaccctactgtctgtgaggtgacagtgaactaatttggtgagaaactgatttgaaaactaatttggaagaaactgacagcaacctcagaaggtgtggctttcaccagaaacatctgacgcttacatacttactatagaccaataatctataaatataaaatgtaaatgttatgtccttattctcctttgatgacaatgccttcatcaaaaggagagctgttagggatttctgccctgatcataccatgtgactatatgacaccattttcagggaagtttcaaagtgagcggagtgaggagttctgctcccttatgtctttgcccaaagagggagtggacgcagactcagcagagtctgcagtcttggtactgcagggatggctcctcctctgtccctgttcatcgtgccattgacaattttcaaaatcctttcatttatactatctcatttgagcctctcaaaacctcctctccttcctttcatgtcagctatgacctgttcaacagatattataatcatagggaatgaaaatggatgttaacctgaaagggaaattagtttaaaccaaaatctctttccttgttgaaagtcacaagacaattgcccagaaaaaaaaaaaaaaactttaaaaactgatattgtaaaacctttttttgagtgttagacaataaaagtgtcagataaagagacttatctctcaagtattaatattaagtgcccaatggcaaaatagcatttacagttctgcttttattttccaccaaatcacctaataacattttctagcgtttaattggtagaaattcacccttggagtaaaaggtgaatgcttagtatcctaaagagtggggtgagggaatgtgttgtaatttaataaactaggaaaccaactacatacattcaaatcttaatttgctccagaaaacggcctagatccctgttaatctttaaacattaaaacaataaccctttaagattataaaatcaaaattctctctgctaaaaccttacctttgtctgtcttaaccatattgcagaaaattccagcgactttaccatgactggatgagtcataaataaaacccattaggtcaggtacttagaaattaaacacacataatttcagggacaaatataaaagctggaccaaatcagagcctgcaagcccttaacgttgcttctttgcctggccttggaattgaaatgactatggggatgaagtgtcactggggcatgttgcaaaatggaaaaggaacctggttaacaggatcgcatttggagaaggaaaacttttggattctgtttccagggcacatacatatgacctggtatgtgggtatgtgcccccgatttatttcaattaaataatttctgataactatttacagcctcattgccttcaatataatatcctgcatggcaaaatatgtttttctttaaaaatatttatgtttttgcatatgattacagagtgtgatttttgagcattggtttattcagcatttgtgtcactctaagaaaatagaaaatagtatctaaggagtatatgagctcagtaccagccctgttatactgaactcagactctaatcctaatccctggtgggtttttttgttttttgcttttgaggcggagtctcaccctgtcatctaggctggagtgcaatggtgcgatctcggctcactgcaacctccgtctcctgggttcaaatgattctcctgtctcagcctccgagtagctgggattataggcgcccaccaccacgcccggctaatttttttttgtattttcagtagagacggggtttcactgtgttgaccaggctggtctcaaactcttgacctcgtgatctgcccgcctgggcctcccaaagtgctgggattacaggcgtgagccaccgcgcccagcccctggtggattgttttacattcaaattaataatgaactctactgtcttcaatctagcaagatctagtcagcaccataggagaaagtgctgccttgggagctgcaggcattgttatttggggagacatgaatttaactgcatccaaggtaagtcagtatcttgaaggtatatttaatgttttctattaaaagtatttctctgctttcttggagagcttaatgacctccatagcaaaccagctttagaataaatattccaaatcagtgcctgatacatagcaaaggctaaaaaatattgtgaacttttataaagatagtaatcataacactgacatttgatgaatatttatgatgcgctaaggttgtgctaagagattttttgagtcggatttgctcacttactggtcatatgaggtagtgactatcatcctcatttacagatggtgaaactagagaggaaaccaactaggttaataactatttaggatagttagtggtagagttggcattagccacagtttgatgatggacaccttgcatttaatgactatagaaaatgtgttatatactattttgagaggtagaaacaggtggtaactttttaattctccacaatgaagttactttttcctctacagagaaatcagctgaaaattatcagcatttaaaataagatttatggcggggcacggtggctcatgcctgtaattcctgcattttgggaggtgggatcacttcaggccaggagttcgagaccagcctgactgacatgaagaaagccagtctctactagaaatataaaaattaggcgagtgtgatgacacatgcctgtaatcccagctgctcgggaggctgaggcaggagaatcacttgaagctgggaggcagaggttgcagtgagccaagatgacaccactgcactcgagcctggttcaaagagtgagactccatctcaaaaaaaaaaaaaaaagaaaaaaaaaagatttatatggctcttcaaatttctctcagctgagatttttttttactccaggaaagattcctagttttccccaatccacattaatcacaatctcttccatatttccagatgcggtttgtttatatttctataatgtaatgcattttaccttgaatactggcacccttgacactttttgctaaattgaatttttttgcaagtccatgatgatctgatattattctcagaatttcacagtctcaatttgttgctactgagatagtgttcatgaaactgtttatgcctatgcccacatatgagaattaggtagaaactgagaggattaattcctgactttccaggtgtgatatttccaccccagtcccttggtggctcgtcagaagagcttcatcaggaaggtgggtgcacacaggtggcctctgtttagaacacgtaataggaaccatatacacaaaagttacttagccatataggttttcatgtgtttgaattgtattagaagtacaggacccaggacagttgatggaaattaacaggaaaatccagaaggctataatacttggtagaatggtggcataagatgatttgacaataaatgatggactatgattcaggctctaacacaaccaaggaaggccccacatacctgaatggtagctgagggcagcagttctggtacattcctaatttgggtttgttccttttccttttatacccattaacttgggagctagaaggaagaaaaaaagaatgtaaattgcagaaaggcaaggtctcatgtgctgattctgggggctatttgcaagttcagttgcttagcctgattataacatagtatccatctcctgcccctcagacctctcccctttctgatttgggacccttgttatagtgcccaggagcctacaagttcaacaactgaaccaagccattatgttttaatcaagaccaaagaactgtgctagaagctctaattctatcagtaccagcgagaaacactaaaatcgatttctttgtacatttctaccagggagaacacactaaaattgatttcttcctacatttctaggccaactgtacaaaggtgaagcagtttgtgagttctgatttagggagctacatagccaatgtgaccagagctgctgaggtatgcagccttcacctctgcaggaacaatggcaggtgcataaggaagatgtggaacgcgcccagttaccttcacttgaaccctgcaagttaccacatagaggcctctgaggacggggagtttactgtgaaaggaaaagcatctgatacagacctggcagtgatggcagatacattttcctgtcattgttatcagggatatgaaggagctgattgcagagaaataaagacggctgatggctgctctggggtttccccttctcctggttcactaatgacactttgtctactgcttttagcaagttatcgaagcattcagttgtgagataattgagtttaaagggaattgtgtggcctctagcctagtcatttaaagaaggatgtaacttataacattttttttctcttatgaattctattgagagatattataagtagacattatgtatgtcacttaacataaacagaaacattattttatttgcctccagtctggctaggaaaccagatctggggtaaagtcaatgtacacttcctccttattggaatatttaagttgcatttaaactaaaactagtataatttagtcttttcatgaatgtacatacataaaattatacataaaaatattaaattattcatttcaaagactgttttttcaagttggcaatttatttaaggacacattactaagtaatcatctgatttaacagaaggggtcacctggtcaactggtccactgaagaggactaaatccagtttctattctagcctcgggttcacactaggtttctgtttcccacttggactcattaaatgcagaaccattcctggcatagcttctcatgaggggccggagactgaggtaagggggagccattaccaacttgcaaagcaccaattctaagatggcacttggagtccttccttcgtagaccctggcagtctgaacactgtcaaggctttgggataatattcatgcttacctaccctgacactgctgtagatctgggagctggagccatattagtaaagatgcagttggtgacttttgcaagcaaaaatcattatgtagaaaacatgacatttaaggggtccagaagtgctatggaaaaggaggcctatgagaaatgttagatatttttgctttccccttcccatgtatgactttttatagtgaatttagagtcattttgaatcaatttgaatcatggtttcactacgtatctagttgtgtgaccttgggaaatttacctacagtccccattttgttatctgaaatttagtaatataactccgacttcaattaattattctgaggagtaaatggaataacatagccattgcatacttggactccgctgttgatcctcaactgactttttttttttttttttttttttgtagtgatggggtcttgttttgttatccagcccggtctcggacttccaggctcaagagatcctcttgccttagcctcccaaagttctgggattataggtgtgaaccacggcacccagcctcaaccaactgttgattaccaaagtaatgggaaagtgcaggataaaacagggtcttgggcaatttctacttcttgatgctatattctgtttaaaatcacttatacgcattgtgtttttctcttgagagtcatgtttaattgataggacttccttcttctggagacaatctacttgaaaggtaaactcaaagtaagtaatgatgctgttgtagaagaaattatagttgattcaacctccttcttcacctctgtttttctgtgaaacatttgaaatccaggtgtgttcttttcaactgcgagtctatgcttgttggaggttattgacattgttaaggtctaatttctaaatgtaaaaaacataacaaaacaaaatgctgtgaatggtaggtagtattgcattgattagctttttaaaaaattaaacttatttctatatcaaagatgatacaatgaaattatagaaaatttgtgaaaatagaaaaaatgataaaggaaatcaccaataatcactataacataaacgggtaacttttggtatattactttctaatatttcttctaaagaccttttaatatgtttgtaatagtaatatatgcatatgcattttcacttacccatccattataagtagtatccgtgttatttcataaactttatagctattacttaaaatcatttttaaggccacataatggtctatcaactagatgtaacacaatttaattaacaattttctgtatgctgtgattttttttaaatgccaagcttttactatttagtcacttcatcagagaaaactttccagatcatccttctaattcattcattcactcattgatcagtttgtttgttaatcaatttattgagcattacacgttagtaggtactgcctaagctttggaatacatccttgaacaaaacagacaaagagtcctggcatcttggaatttacgttatagctcagagaaacatattaaacacacaaataagcaatttatatcatatgttagaaggggataagatttataggaaaaaatatagagagcagagtgggggagggagggatattctgtgtttaggcctcatcaagcaggtgcccatttgaacgaaaacttgaaaaag

SEQ ID NO: 12698 - DNA, 9634 bp, Human
agtcaagaaataaaggctgaaataggttggctaagttacgtttttaaagacagctttatgacttgtgaggcaataaaactgcaccctttggagttatcttttctatcagacaggaataatgtgtaatttatcaatgttctcttagttcatggctaatttcacagagtctgagacctaattagtaagtcaagcaaagggataggtccagagagaacttattgttggtgaggcctgtttgataatgttttcatataatattgacagtatacacagtcatagtttcattttacttattatttatttatttattgaggcagagtctagctctctctgtcatccaggctggagtacagtggctcaatcttggctcactgcaacctccacctcccaggttcaagcaattctcacacctcagcctcctgagtagcttggattacaaatgtgcaccaccaacccggctaatttttgtgttttcagtagagatggggttttgccacgttggccaggcttgtctcatttcatcttatttctactgtcattccatttggtcaatttgtaatttaataattttgtacaaggcagtttctacattaattttatttttctgaaaagtgtctatcatattagtggcattatgaaaatcgtagattattttctgtgttttgaacaacttgatattttatttattcttgaacacttgtaggacctcttggctcatatgtctgaataccatttctttaaaatgtacgctttaacatgtatacatatgtaacaaacctgcacattgtacacatgtatcctaaaacttaaagtataataataataataaaagaaaaaagaaaaataaaacttaaaaaaaaaagtgtatgctttaacaataaattattaataaatagttatctgtgttattcaagatataattaaattgttttttgtgcactgacccttacctttatttcagatccatcacagagagtgcatggaggtatttaaactgcattaactgtttcacaattaagtattatcttatcaattaggtattcaagaaagatcacttacagaattatagatggcatgagctagattttactttctaaagaaataaccagatacatgagcaaagatgttaatacaaagatgtttgtcacaacatggttttcaatagcaaaaaaagagagaaaaatatataaaagacaaataacagtggataggtttcaataaataatgttacagtgatacagttaaatactatacagctattgaagcatgtcattattcatatttagtatggaaagatattttgctattttgctacatgaaaaaatgaggttggaaaaagtataggttttgtgaatctgttgtatgaaagctgtctatagttacatgtgtatgtgtgtggaggaaaaagtgttgtcattggttttctgatgatgcactcagaaaagacaagtattcacattttttcttgtggctgatctggattttcaggtttttctacaatgaacatgtaggctgaacattccctaagcaggagagtcccacctctaacatctcctgtaggcctggcaatggcaggcaggaaagacagaggaaggaaggagggagaagggaaggagtgaaggaaggagtgaaaaaggtaaggaagaaagggaataggggaggaagggaggaaatgggaagggaaagaaggaaaggaaggaaagagggagggaagaaaggaagggaaaagggagggagtgagtgaatgaaagatggaaagaaggaagaaagggagggaggcagggaggaaagaaagttgcgcttcccttgagctgccatgggcactgactcttagggtctgaaagcccctgagatgcaaaagcctagtgctcacaaagagctggaaagcctcaaggaagttcttcaatatttctggaaggaaactgtctccagaagcttccctccccacgacagataatgagcagcaagtgcttctggcgacttagggtgatgtgaaatcacgctgggaatcctgctcctcctcaggtcctggcagtttcagggcccctccctaggccttacttaaaaggctgaggcatccttggaggaacaggcagactccacagctcccgccaggagaaaggaacattctgaggtatgctctggggcgctggtggtaccggagctctctcctgaccccagacccagaatctgctccgtggaggctgttcacatgctggggagctcggtgcagctgcttgctccccagaccccagccaactcagcctctctctccatgattttctgttgtttattccaaaataggggagtctacaccctgtggagctcaagatggtcctgagtggggcgctgtgcttccggtgagtgtatgaggccctggtttggtggtgtcctccggaggaagtgagttctggatagacccgttgtccagctctgagcaggagggaggaagggaggggctgccattgcagctgggaaattgtgaccagcacctcattgctcttagagttttcccagcctttttcaaataggggcaggactggggcaggccatctcacaaggggtccctgatgctgagggggacaagtgaacctcccagtctagagctccagccaagtctatccaaggtgggaacgggggccaggatccctgctcagagctccgccattgtcccccatcacagtgaatggatgtaagctcacccactctgtgcccctacctccctgctactctttggggataataataaaacaaaaaccattaccatcagtcagtctgtccacccactggcatgtaccaagccagacactctgccgtgttctgggcttaacaacagaggatgagagtggtcctttctctcagtctaataaagcacttcccacgatgtgttctatgggactcgattagaggagtcccacagaggcatccaggagatgctttacacagtggagctctctgatcaagtaaatgcagggaattctgctttctacatcctctcataagagaaccacagcccagctcagcatatgagtgactgaggttttctgaagtaaggcaacttgttgaatcgtatttagctatgcatcgacccaatttttacactgcatccttttcccccatataacttttggagaaacccactttaggatacatcttccacctcataggatgccaggaaatcaactgagttcaaagatgagaaacaactttgaaaagttaaataaaagaaatttaaatttaaagaaactcctcacttagtaaggaatatatgaccaaatagaaatacatgtatcttgaagaattgaagaatcaggctttaacgtggaagaggcctggatgttatccaacccatcatcttagtgtagcaatggggaggctcaggcccagagtgggcgagagagttgtctcctgcgactcagcagcattggaggcatagatggggcaagaacctagggctctgactcaccgtgcagcttctcttccaacaggagatgggttggggcagaaaaggttgaatagggtgaaggagcaaaccacagactccagtgggagactgtggggtcatcctccttgtagggcatgagcccagcagggctgggagacaaggctgtgctgttacttctggcacagtaggaagaaagagagacaaaatgcctgagatcagggggttctctggatccagggcatgctggagtgtccaccctcctcctaatgtagtcctcaccccttcctgatgtttcagaatgaaggactcggcattgaaggtgctttatctgcataataaccagcttctagctggagggctgcatgcagggaaggtcattaaaggttggtgatgaaacatgacccactttccttggtctctatacactctcaggggagggggcctgaagagggcttagaatagtcatacagattagcataggcctacagagcccaggcattagggcagcacaaaccaggctctaagcaaaggcaaataaaatactacacctctcagcaaagtgaagacacacgctctggggccacctgaagcttctgtgcagaagtgggaatgttttccaagaggcttgtcttgtcattcccttacaggtagatttaggtcaagcattgcattccctgggagccagtaagtaccaaggagagaactaacgtagattctctataccttttttcccatatgggagtgggtttctgcctctccaccctgggtcccctctgctctctgaagatcctcagtcacttagagtggagggacccagagaacaggtggcattgttggacctcctgcttgctcactctgccccatgcactgcaacaggtccctctctaaaatagtttgcacctgcccacctggggcacccttgctgagcacagatgccaggtagatccttcagctaggccatatgtgtatgtgtgtgcttactggtgtatgtatgtgtgcatgcaggcatatatgtgtgagcatatgtgtgcatgcatgtatctgtatgtaaccatgtatgtgtgagtgcaggtatgtaggtatgagcatgtgtgtgtatatgtatatgtgtgcatgcatgtatctgtgcatgtatgtatctgatgtatgtgggtggtgaggggatgtacagagaggaatgagaccctcttttgctctcagcaacatcacagggtgtagaaagttgtccaaacaattccaaaggggggcttattaagacagggttcagaaaaaggcctgagacccaaggggcattaaaggagggggttgagtctattttgggttgtagaggcttgaagatttgaccctgaactagagggtggagtggaggtggtacaatgtgcttccatgccttgatgtccactctgggccagtggacaggagaagccatgtcatgacagctgctgagaagcctcccttctgcccagcctgggggcaggccgtctcacagcagtcctgtgccctagagcccaggacaggggaagaaggagggaaaggcatccagggccctgcatctggcctctttcccacaggtgaagagatcagcgtggtccccaatcggtggctggatgccagcctgtcccccgtcatcctgggtgtccagggtggaagccagtgcctgtcatgtggggtggggcaggagccgactctaacactagaggtgagacttggggcatcctcactggggactcagccacagatgctgagcctactgaagccgggcagcccacagccctggtgctgtgggacaccctagcaggattctgttgatggcagctttgcctcctccctaaggatcctgcccagccctccctctgcccctgcttctgccctcacctgacctcccctcctctgccggcagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaaccttgtaaaaaccatgtggggtaaactgggaataacatgaaaagatttctgtgggggtggggtgggggagtggtgggaatcattcctgcttaatggtaactgacaagtgttaccctgagccccgcaggccaacccatccccagttgagccttatagggtcagtagctctccacatgaagtcctgtcactcaccactgtgcaggagagggaggtggtcatagagtcagggatctatggcccttggcccagccccacccccttccctttaatcctgccactgtcatatgctacctttcctatctcttccctcatcatcttgttgtgggcatgaggaggtggtgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttatctgtatttcctaatttttctacaatgaagatgaattccttgtataaaaataagaaaagaaattaatcttgaggtaagcagagcagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagacgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaacaaatgcatttgttttattattgcaattttctccaatattttttattttctttctcacaatgaacaactatccttcatttacccaaatattctatttaaaagctaataatacagcatttgttgagtcatctggttctgcaagattgagatcctcttgtcctatgtgccaggaatgaactccagtgtccccacccaaaccctggggaatgggagcagaagccagaggaggagcccatatctgagccccaggtattccacctgcacttcacctgttggaccagcttggtggttgagagtccactgaggcactggcaaggaggtggccaggacagacaaggctgcctctatggacctcacagctccagcccagattcagctgaagtcctcaggcaacaggcagcacagctcctaccccaggcctctcagggctgccaagaacatgagctccggatgctaggctgtgtttcagaccctgttcacactctctttgtccatgggcccagacacagtcttgtgctgctccctctgcttttgggtcctccatccatcctctctgcctagataaatctctcatctttcaataccctgctaagatgtcacctcctccaagaagcttttactgagttgagacacccccagctatctgatctggcaatgtttgtatgcacctccctgcactgtagtaccttaacttggagtctgtggcccctgggatgaccttaaggttagggacatataagtttgtctcttagcaccttgcataatgcttggcacataatggaaacccaatgagtatataatgtagaaactatttctccaccctggaatattctctccttctcctccacccatctaaacaggcccacctctaagggagcagcttaaattccacctcattcttgaaggtttctccagcctgaatttgttgcttcctcatttgtaggatgacagaactcagaagagctttagccatgatgagccgacacaagtcagtagtaaaagaaggaatataaaatgcctccttcaggaatgtacaggctggacatcatgactctacaagtgaaaaagagttagtggctttagatttctgcaattttggtataaatcactggcctggacctgtatttacagagatgcaatactcacatcatgtggggtttgtacaaattgcagacatcgaggaacagagaatgttccaagggcaggctgtagggaagaggctacgatgtgggaggtattatcctgaaaaaagcaatgcacagggagccctcttcaagcacttaaaggcttgccaagtagaagaatgtgcttgttctgtgtaattccagaacacacaagcagaaccaatgggtgcaaattatgtggaggctgtttttcctatatgacccccatattttaaccacaaggaccacaaacattgatagggtttcttcaagaggttgtgtggtccctgaccctggagatgttaaggcagagcctaattaaccaatttctcagggatgccatagcacagatttctccaattggagggaaactatgattccatgtctatgagatggagtttcactctgtcgcccaggctggagtacagtggtgccatcttggcccactgcaacctctgcctcccaggttccagtgattcccctgcctcagcctcctaagtagctgggcctacaggtgcatgccaccatgcctggctaatttttctatttttagtagacacgaggtttcaccatgttggccaggctggtttgaactcctgacctcaagggatctgcctgccttagcctcccaaagtgttgggatacaggcatgagccaccatgcctggcctaaagtcctttcaattctaagattttttttttgcccaaggagcttatctgccactattgtttccaacatgtccttggcccacagcttagagagtctggtcttcttaattatcttttcaagtgtttatgacttagttcctcagctagactgtgaaactacttaaca

SEQ ID NO: 12699 - DNA, 19438 bp, Human
ctcagttgctgccaaacgagccatgaactgggctgggtttttcatatttgatgaaaaagagtctaaacactaactgatttgggagaggtccgataaagaaaaaggggcattaaccttcactatgcctttagccccagccacctttttaagaggaaattgctgggcaggtgggggagggctagtcgaggaacgaaactgtaagccggacggagtgtgaggaggggaggtgataaaaggattatagggtggaagagcagaggctgaggaagattcgggacttagctcagcctggcaaggaggggagaggtcaggtgggtctgtagaaaaggaagattagaaaaactcagcaacacttagggttgggactgaggggacaggcaggagggaaagatggaagatctgggatgagttgcattgggaacagagactagcgagggaccaatgtgtaaaagaatgcctggacgtcaggcacctcagaccatttgcccattttacgacaagaattatttagatcttgtaggatggaaaaattgaaagtgctgttttctggctatttggaaccactgtcgagtttgtattggggtcaagcagcattgcaggagaaaataaggcatttaggctttaggtcaggtgtgagttgaggaggttttaggtttttaagaacacaggctaagggagaagaagggagaatggagggcggaatcttgcccctagtgaaggaggcaagcctagagaaaagagagagtagagacatggaaagaaggggtcgggggggtggttcttgccccctagaaaagtgggaaaggggttggggcatggaaataaggggttggggtgcagagataagaggtcggggcatggaaataaggaatcagggcacagagataagaggtcaggacttggaaataaaggattggggggttcttgcccccagaaaagcagagaaggggtagagacacggagagaaggagttggggggtgcttgccccctagaaaagcagtacttgccgctaagggtgaaggagaaggggttggggggttcttgccccctagaaaagtggagaaggggtacagacacggagagaagaggttgggggattcttgccccacagaaaagcggtacttgccactaagggtgaaggaccaaggcaggcgtccccgcatggtcagacacctctgaaatgtgggtgaataatcaggcaggcgtccccccgtgattaaacaccaaggtaagactgtcttcccgagtccatgactggcgccggagttttgggtccacggataaaatgcgtctcctgtctctaccagaaaaggaaaggaactgaaatgaagagaagggagagattgaagggtggagccaagattgaaaggagaaagtggttgagggatagtgacagaagttggagaagagagtaagaagaggctgcttacccgatttacaattggtgagatgttccttgggttggtgggtctgaggacccgaggtcgtaggtggatctttttcatggagcaaagagcaggaggacagggaattgatctcccaagggaggtcccctgacccgattcacggcaccaaatttcatgcgcatctgtgtgaagagaccaccaaataggctttgtgtgagcaacaaggctgtttatttcacctgggtacaggcgagctgagtccgaaaagagagtcagctaagggagataggggtggggccgttttataggatttgggtaggtaaaggaaaaagggggtttttctctggcgggcaggaatgggggtcacaaggtgctcagcaggggagcttttgagccaggatgagccaggagaaggaatttcacaagatgatgtcatcagttaaggcaggaacaggccattttcacttcttttgtggtggaatgtcatcagttaaggcaggaaccggccatctggatgtgtacatgcaggtcacaggggatatgatggcttagcttaggctcagaggcctgactatatatatataaattgaaaatacaaacatcaaactagatgtcatggtaactaatgctgagctccaagaagaatgaattgttgtggactagagtagtcaggagaaactttatgtaataggtggctgctgagctgggacttcaaagttgagtacaagctgaaattgtggagatgaggttatgccagcgaagaaccatggtgagagcaaaatcaaagagatacaggatatatgggatgttagaggcaatgagtggactaggattggtcccgctggctggtttctagtgatatttgggaaagtattaagggagatagatttggaaaaataatcaggtagtggaagactttattctgcaggtactgaggagtgtggcagagatttgctagttgacagcagtactcattacccattctttctgtgtggttattgaaattcctggtttaacctgatgcatgagtgttcggaacaaaaagcatttacgacccttccttgtagctgtgtggtgtcaatgaaagtggtgtgtgcttctgagtaggtccttaaagggaagaggtatgcttccttccctttaactttcccattgtctggcctattgtgtgaaatgtggaagtaggctgctgcttgggtccatgtgagcaaagcaaacacctcagcgttgtagagtagccagagagaaggatcccgagtcccagacaccttcaggcagccatagttcgggttactcacatatgcattttatgagctaaaatttcacttctattttgtttaagccacggtattttgaaatctctaatatagcagccaaaattttgaattgagctattgcttccttgtagtcctcatggtagccaggcaaggcctagggtggccagtggcccctgagcttcacgtatcctagcgtgtcttataaataacatatacatgaatgagttgggaagctctgcctttcttacaacaaggaacctctggaagtgttcgagtaaggaagcagcaagataagaataaagtttcacaagaattaatctgagtgatagttaacagatcagtgttgcctggggctaggagaggggaatgcaggatttatcacagatgggcaagaggaaactttttgacacgatgaaaatgttctagatctcgattgttgttgtggttacatgagtatatatagttgccaaaactaattaactatatacttgaaaggggtatatttattaggggtgtgtgtgtgtgtatgtgtgtgtgtatatatatatagtatgtttttatatatatatgtatataaaatctcaataaagttgattaaagaacttaatttgggctgggcatggtgactcatgcctgtaatcccagcacttcgggaggctgaggtgggcggatcatgaggtcaggagttcaaggccagcctggtcaacatagtgaaaccccatctctactaaaaatacaaaatattagccaggcgtggtgatgcacagctgtaatcccagacatttgggaggctgaggcaggagaatcgcttgaacctgggaggcaggggttgcagtgagccgaggttgcaccactgacttcagcctgggtgacagtgtgagactctgtctcaaaaaaaacagaacttaatttgcctgtgtgtgtatgtgtgtgtacaagatattttagataatttatacttgttcttgggaaataatagtaggaatgaggttagacaagagcatcattttgatttggcctggtgatattgatttacatgtaggagaatttggcttttctaggtaaagaatcatctgagcttcaccacaggctggtgaagataccatgccacaaaatggggaaagtggaagtatagctctgccacatattagctaagtaaatgtattcagtctcttggagtccctcttgttcatttgtaaaataaagtggggtgcctgcaaattgcaaatgagttgtgaagaacagagaaaataagtgtaaagcacctcctacatgtgcctggtacctagtacgcacccctgaaagtatgaggtaaagagtgattgcaattaacacataaaaatagaaaaagaaaagctttcaagatcaagatgataccaaagattctcctatatatgtttctaggatgtgaggaaatgagaactcagttcacaggggagacgaatctgcttgtaaatctcaggatgacaataggaagggggttgggtgaagcaacatagcagttggcagtgttttaaaaaaggggcagcttctttgccagagaagattcagtagtatagtgatttcttctttctttacctcccttgactcatccacaggagagggaattcagacaaaaggaagcttctgtggcaatctatttaagattctcctcatataagatttggttcccagcccattttctgtcaggcttcctgagatgggaaagcaatgcataaaaattctcaggcttgacagtgaattctcctgagctccagactgaaatttacagctgcctgtagacatctccatctgcatgtcctgcaggcatctccaactctgtgtctcagaccaaattaattaccctctcatactcgttcccctccagtcttccatctaggttaatgccattgccaatttgccaggcacaaaatccagaaatttcagtacttttacttcttgtcccacactccctgaggtctagctactgccaatttttgtggattcaccctgttgtgatctgttttatgcactctgttttttgacttccattgtcctggtgaggatccttatccctctccaggaccacaacaacagcaatctattcagtctcctgccagggcctgcagtgtgtacaactctcaagtgctccacttacctaggctgtggtcaatggtggcccacccacccaggaattgcaaaataagtataactgtctcctggtcccctctttctcacttggctaatccagttaaattaatgaaatattcatcatttctctttctgaaattgcttcggtgactttactttgggcctacagaacaaagcacccaaactcaaatttcattcatttcctgtcccatggcatctcttcaatcattctatgatctaaccacattgaaccataagtcataactccaaaataatgtatactttttaacctcaaactcatggctcatggaatattttccatgagccagctagactccactgctccttctgatccagcttgaacgccatctccttggcatagctgccttaattccactctactccatctcttattcttaagaagggccccactcactgcatattcccttatttatttttcctgtggttagcacaagtgtctctaacccagattctacagtgtttaaggacagacatcatctcttgttgccatctctgagtctccagggcactttgaatggacttttaaccagtctaaaaataatcttcttaaatttctacttttaaaaaatggtgatttttttttttaaccaaagaaagcttttaaaaattcccaaagaaacagttaacagttttgtttgcaatgtacccaaatagtgaactccctcagctctactgcattaaatatacttttttaactcccttgcagttttattattccaggtgcactgctaccataagaggctttgtgagctactgctataaatgtcattcattcccattaagcaagtgtattatatacaaaacgattgtctaaatttatgttgaccattctagagggtagtgtatcaggtaatacatcaaaatatctgaggtctaaaaatgtagaaagcaacttttataatttgaggactttttattttactgagcccaacatattatatgcttgctcttgctgtgactgtaagacatatcacaaaaagcagcagctaaatttgaccattatacaaataattcaaacaaaactcatacatagctatctcagttacgtgggtattttaggtgaaattacagggatttggggtattgaggaagttattaaaagggatgcttttggctctgattgaacaagtaatgtactcagttttcattaaaatctatggaagattttaaacatggcagtcaatttcaaggattatattccttaactcatttgaagagaatttgaaattaactaagagactcatagtctcttaaaaattaataagttataaaactgtgatatgcaaacattgaaaagatgaacacaaatgggcatatttttatattatctcaaacaagtatattatttaacatttaggtaaaaagcaaaagtgaaaaatgggcatctttttgactcttctcagtgaaaatacatattcttataggtccattccggagtttggaaatcaatattaatactttatgcaatcattctttctcatgtttttctccccttgacaatcttctcaagtggcataagtgcttgtaatgtattaaaaagtaggcagagacaaatcattactctctagaaaatatttattgacacattttaattttctttccatattctgagaaataaacaaaatacacaaaatacagtaaaatgcacttttcccatttcaaataaatatactatactcttgtaaaaaaatttaataatctgtgtaatttgccacagtatattaatcagtgaaataaaacaaagaatctctaaattgtcacatgttttaatgattctcacaagcatttttctggagaaaaagaacactattttctgtagaatttatattgacttggagactattgcttcttgtttggagaaggcaaagataagctttttaaaaagtgtttagtgtcaaaaagagtcttcatttgggagaaaaacagcatacaagtcctttctgaatcaactaagttatgtgcaaattttcttattaatacttcctaaagaccagactacattctgaataatgattcctatgtatcacactggtaattttcaaaattagtggttaagtatttaaataacagttatatgtgtaatataagcccaggacagaatagtaaagctttattaacaggaaaggctaaaaataatgatgctatacaggacaaattttccttttcataatggttattcttaacattatcagaactgaaatcgactgaattatacagatttaacacagacttatatacaaaaaatccctgatcagcttaagacaatgtgttagcttgctcttttaagtggtaagaatattttagtaaccagcaaaaatcacatttaggtagtcaccaatattgaaagttttctgatatataatttatttagcatcagaagaatagatcgctgagtaataaaagttattagtattttctaacttcctatgttagcatttaattagtactttatatactagttggtagaagtaaatcaacctttactatggctccagtcccaccatatgtgactcgtttgcatggatgcggaaatgctaatcaaaccatgctgcctcaaaacataactgtgttcagtaaaagtcatacacaggctacacagtgggtatgacatctgtcttcagcattttaagggcatcaattattgtccaggtggtgacttatgacatgaaacttttccatcctcattttaaagcatagaatagtatatgcttaggtgttattttatggcaacatttttatttctacatatttctgaaacacatagtatgtactcaaaaattcacaagtccaataaaacaagtttgtggttttcttctgtgacatttctttttataactcctccatctcaaagtgtgtattaaagctgtttgccatggatgtgtgttcaaagattcttgacaggcttggtttcaacagttctactgagggacatgacaggtgctgagagttgtcattcttcaaggacatcatttggtctgtcccaggctcccttctatcataatacagagcccagagcagagtaatggtgagaatcatggccaggatttgtgtcaccccaatggagattcccagaaacctcagcacctgcagttgtttggttcctctcaaaaaggaatacattttcttcccacaaccctgtaaaagaaatacatggtcaacattactttagatatgttacagaaggccaaaaatagttaatgaaagcaaacaatctgtatcagttaatgaaatcagactaactgggatcataaagtttaagacagtggttctcagggaaagctgatgagaagaaggagagagggaggtgtgtagcttttgaaaagcctgtccagctgattccaatgagccaaccccttcttttgtctttctcaaaacctgaaattgaggcccactgacataaaacccaacatctaaagcaggggttgacaaacttgttttctttttttagagagacagatagtaaatattttgggctctgtgggccatatggtctctatggcaactactcatccctgccactgtcacaagaaagcagccatagatggtaagtgaatgaatgaatgtggctgggtttcagtgaaacttcaaacacataaaaaggcattaggccagatctggcacacaatgtttacgatttaataatacttaacaccggtttggtaaagtcgcttctctggccgccttaacctatttgatacaaacacaagaaatttgcacaaacacagacatagacatacattctgtgggaaactaacatagacatcacaaagacaactcaccaaaatttaagtattttacaaagagttccactcaagtattctataagagctcattcactcttaggtttatgtgttgttttaataagcatctttatatgacacagtgatacaggagatagaaattatttaggcagatagtgagggtaaaagagtcctcggtggaatttcccttttaacaaaaagcagctccaaaatcattaatagaactgcctgaaaaattgagctgtagacatagacaagcaagctggaagcttgcacaggtgaatgccagcagctgtgccaacagaaaagggctacctgggggccacgtatgttcaacatggagggtccatcgtcccttgtctttgtgtatacagtaaagaaacaggtaatatggtgccagccaagtagaggaccatctgcacaataaaagattagggtggggggtggccagattttcatgcactatgcgaatggtacacctgatctgaccaatctttcgtgccctgtgtaaatcagactccgcctcctcaagctcatctttaaaacctattgcattttgctgtggaccggaaaacccactcgggaaccctctctgcaggagagagttcttctctttcttgtgcctattaaacctccactcttaacctcactccttgtgtgttcgcatccttgatttccttggcctaagacaactaaccttgggtattaccccagaggaacgatgccacttcaacggtatagtataatggttaagatcatgaactgctatgtcatttggggcaagttacttaatctctctgtgcttcagttttcttgtctaaaaacatagatgataatagtgcttacctgtctgagatgttgggaggattaaatgcacagacacattttaacacttagaatagtgcctcatacatgttaagaacccagtaggtacaatctcttgtctgatgtgtcagttcacagattagaaagtagaaagatcaaattaaaaatagatggaaaatctatgattagcagatattaatggaaaagtacgaggcacaacacttcatgaaagagtatgaaaacaccagaagcacagcattatgtcaccagtgagtacttctgcacagagcaaggtggctgctactgttttacaggacaatgagataactgtccaaaatgattacttgctcctgagacattagatcattagcttcctgatgaagcagagaaatattttacatagttcgggaagagtcacctcaaaatttgttaagttaaaaaggtttggcttcagacatctggaaaattaatttgcatggcaacttcatttaacatcattaccaaataatgtggcactattttctcacatctatctttgaagaaattgatataaaacagccttggatcatgtttagctgattccttacctatgtgctcggtacttagtacaaaaatggacttttagtgaataattagcatgaatatattaatattttagtaataataattataatagatttcagaattagaggcaaactggctgggtgtgggggctcatgcctgtaatcccagcacgttgggaggccaaggcgggcagatcacttgaggtttagagtttgagaccagtctggccatcatggtgaaacactgtctctactaaaaatacaaaaattagctgggcatggtggtgcatgcctgaaatcccagctactcgggaggctgagacatgagaattgcttgaacccgggaggcagaggttgcagtgagctgagatcgccccactggactccagcctgggcaacagagggagaccttgtctcaaaaaaaaaaaagatttagaggtaaaccattcaaggatacaaaatttcagttaggaggaataagttcaagaggtttacaatacaacgtggtgactatagttaataacaatgtattagttattcaaaaaagtaagccattcaataaatatatatgccgatgattcaactctgtgaaatgctgtcagtcaattacttgatttttaccctttcaatagtctctggggcttaaattgtatctatattggcttaagatctcctacctctttagactaattcattttaagctaagaaactgtgccagaaaagtaatgtttccttttcaaatctgtgaataaaacaaggcagaggttgataattaagtacagtttatcatgtttcatatcttggcactgtttaaagtctatttcagtttatcttaaacaatcacatttatttttaaaatggtacagtaaattctatcacctaggatggctggggaatgagacctattaatactgaacactctagaatgggaggggtccttggaagtcatgaattcaacttattatcttttaaaaacatggcaaaaaagcacttgtagagtgacatagcaaaactggcatgggaaggacctccaaagaatctctactcatataatcaatgaaaacactggtaaaaaacctgttaacctcaatttttctagaattctggaaattaaccaaagtcttgcggcaatctgaggagcgtttattcacgaaaagctgctgaatctcttaggaacagcaagtgctatggaattatcatttgccctattcccatccctgctcccctcagctgactagaaagccaagagcctgcaatcctggtgagaactggcagcctagccgccaccagagggcgcagaatggggttgcagctccttcaaggcgcctctcccggaggattgctactgtatggctggtctggcctggaagaccccactcaggaggatgtctttatttgacctgaacttgaagctcgactagggaacagcctccggtccctccctccccaggaggttaccaacgacagttagaggtaactattgatctctgaggctgcctgaggcagttggtaacagttgtgcacatgggggcttgacaagctctgacatattcgtggagatctcgaaagttacacacatgaatagggctgtgcttaggttcaggggctgtgcatagtcccaggaaagacctgcaaaatcctgagatctctcctctggctgaccttgaagctctgtgcacccttggtaaaggccgggagactcactggttctaggcatctaaggaaatctctgttcattcattaactgaccactaagctaactgagtagaaacttcaatgaccacatgtgacaaagaatacagcctttacagaattagtttagaaaatgccatcgaaccgacaaataaacacagcaaacgctggagaggtggaaaagtctgattttcagagctgtcacattatattatttaaaatgtcctgttctcttaaagaaaaacagttataagacatgcaaagaaacaaagtatgactcacaggggaataaaaaaacaatgaatgaaattgcagttctaatgagagggactcctcgcctcactagacagccctgtccacaccggaacaacactaatttttaacaagcactcccttgttggaacctgccttctttgtaaggatgcactggttctaactctgctctcaacccttcccttttccataaggtagacagtcatagctgaagaatcaattatccctttctctttaattattctcctctctaggctaaatagtcctagttttcaagttttccaaatatgtacacttaatcattctgctgatccttttctagactgtgttgattctgtcaatgtttctttgaaaatgacattgatttgtaactttaaaaaactataaaatgcaatgacatattaagacaatcaaggttattgaaaatgactttggattccaatgacaaaacagctttttcggttgcccagaaatgtagacatgcaattgtattgacacatcacatagttgggacttggtgtccttccagatcactggtcccttaagattatcttcacactcaggtaggcaagtatgctttgttccaagcaaaggtcctacctagttagactcctccatttatatagcaaaatatcaggtgatcatttcctcattttgtttaaaaagcatacaggtaactcctcaaacaaggcagaacttcagtcctcaaatttgtcatcagaattcattaaactatatattttatgcttctctatcaagagtatctccaaaagaggtgtcaactacaagttgtctaaaagaaatgaaatcagttgacatctcagtactgtatgtccatccgtcaaaccaggtcaccaaaatatgccaacttgcaatatattaacttatgcccttgcatattattttccaccaaggtgtatttaatgacatgtattggaaaacaccataagaaactgctctataaaatttgtgaaaaatgatattgaagatattttttctcgataaagtagtagatataaaatcccacttgataaaatatttagaattttgctccctttgaggttagaatgtttgctctcctaacattagaattatggtgatgattgtacctccttttcacctgagctgtcagaaagctgagaggcaaacaggacactcaaccacagtaactgtctgtcttcatgttaagcacctctgcttactctttcctttaactttgactttccaattctgtttatattttattattaatttactgtatttttgttgtatgctgccctatatcctttaataaattcaattttaaaagatacagagtgtaattatataagtaaaagcacaaatttctctatagtacatgcaattaaatgtttctttgctgactcattaggcatgtagaaacttgcagcagacaggcgttgatataattagtacatttgtccccacccaagtctcatgttgaaatgtaatccacagtgttggaagtaaggcctggtgggaggtgtttagatcatgggggtagtttcctcatgaatggccatcctcttggtgataacggagttctcccaagatctgtttctttaaaagtgtgtagcaccaccccccatctctctctccggttcctgctttggccatgtgatgtgcctgctgccgctttgctttttgccatgtgtcaaagctccttgaggccttcccaggggcagataccattatcacttgcctttcctgtacagcctgcagaacttattttcttataaattacccagtctcaagtatttatttctagcaatggaagaattgcctaacacaggtgtcatgctgaatatcagtgaatcattttcacaagtacttaaatttaagaaccaactttccaaagaatagctctcttcttgagaggacagtcagtatttttccagatttgtctgtataagatgattgacctcctcagtcactctgtaaattcttcattgaaatagctccagggttttctgtctgttctgaatcactcttattgaagtaattcaacctgaacataaccctgagcatattttgagccagtcaaataattatgcataaggtttacatttttcagtgtaaacttgtcttgaaaagtaagacattaagtctagataaaaaacatagatgtgtttatatgtatttattatactatttatagatatctagctgcataaacaaacatttctgtagagtaaaaagaggaggcaaatgataaaattcaaaactgcatttcatttcataaagagtattttattcagaataggaaagaactgaagtgtacttatttgcttttctcaaaataaaacactgaattaattttacttgaaaatgttttcttcctaaataaagctaggttagccccatgttaataacttcagataatgcaaaggtatgaataagacatgttggctaacctactttacttgctacaatattaaaattctggtcaactattagctgtaaataataacactacctttatcagagaaaaatcacaaatcccctacatttcctggaatctatttgaagccatgtcaggatgcctcatttcacttgaggaaattatacacttgaaattattctctgatctatctccaaaatgagtttctaaaattggaagaacacccatggcttttcagtactcaatattcacaggccacatcaaaaagtcgggcagccttttaatgtgcttatgaagataaagtgtaaataaaatctaggtgccaatacatgccaatattaatatttttgtaaataaacataactctcatttgaaatagctatattgattatcagatgaaaatatacagtcttcaaccctctttcttctagaattgaagtaaatgacagcagttaatgagctcacaagatttaaacaggttagaccaaaagttctccactgataatcttaagctctgcagggaaataatgcttcctttaaaaaaagcagcaagcaataaaattcactacaagactttctgttctttagctctctcttaggagaacagaaagataactaaatctgtgcatagaaaatgcagtagaaaaaagtcatcttattatttcttgatatacgaaaggtcctcatatctcatttaaccctcgcaatatccctattacataggtagaataacgaaatgtaaaagactgcatttactgatcatttttcatttttaccaaaaaaaatgtatttacaaagaggctagagtcagaaaacctggaaggcttcttgctcactagtgaggccagttccagcagcctgaaggagcagagtttattcacaaacccctcctgcaaatattttctctcttgggggcccatttgggcaccttaaatttgcatctataagaagttagagggtgttaaaacaagcaaagtgaaaaactggaccaagtcccaaaaactttgacctgaaaatctaccttcagcagcacaaacgcacataaccagaaaatacacacttcactgtcatttcaagcaaaactaaggacaatttagttagtcaaaaatctaatcatagatcaataaattttctacttacttcagtaaataccttaaaaaattgttgttattgttgtcatcggctaccactgtggtaagtggtatactaacagtttctcatgtcgtatctcaatttatctttgtatattacagtgatgtgggtactattaatatcttagtagagataagggaattgggatgtagaagaaaaaaatctctacactcagcttgctctttaccatgtagtcaccatctcaaaattttagtatctctgcccttaagtgttggcaggtcacagagttctgtccctggctgcatacattgcatcatttccttgtgtggtcttatttccctccataccttcattgcctcatgtacactgatgacacccgtgtaaacttagtccatccacccactcacccacccagtctgtcctccacttgatccacagtaattagtgtttatataagaacatagcttctggctgggcacggtagctcacgcctgtaatcccagcactttgggaggccgaggcaggcggatcacgaggtcaggagacagagaccatcctggctaacatggtgaaaccccgtctctactaaaaatacaaaaaaaattagccaggtgtggtggcaggcgcctgtagtcccagctgctcaggaggctgaggcaggagaatggcgtgaacctgagaggcggagcttgcagtgagccgagatggcgcccctgcactccagcctgggcgacagagcgagatttcatctcaaaaaaaagaatatagcttcctagcctgaccacatttcccagcctcccttgcagctaagcaaagccatgtgagttcctgccaataaaatctgaacagtggtgttaagtgtaggccttcatgcattgggagttctctttctcattctctttctctccatgactggaactggagaaaaacaggaccaactttggaagacaagatatttaaaaggcaaagttgtctcatcattctggcccctggatgaacttgtgcagcagagctgcctggcagcatagactaggtcattggtctatgaaagagagataaactcccagcttatccaagccattgtattttgagttagcactttctttaattagtacacacacaaaatccatatctctagctgagttctgcctccgaagctcatattgcctcctgggtttctgcacatggaatacctgacaagaaccttaaatccagtatttccaaaatggaactactcaactctaaccactcccttcagtaaatggcttcctcactgtcagagtccaaatcagagtcaagaatgcttgcaacttccctgtcgttcactccccacagccaatttataacccagtcctgttcattctgcctctgacatatctttcacattcattccttcctctccatattaaatgccacaacctgaattccagcccctaccatcacatgatttatctgttagtttcctaccttaatttccctgccttaagacccaatcttcagcttaatttccccacctcaactcattctctacaatgccaatagcatgatgtttaagcttaaatctaaaattgttatttcgtaaggtactttttcaggtcaaaatattatcatggctttcacatccataaattttaagggcaaaatttgcaagtctctactaatagagtccaaaaggaaacattgtttgattgaatagacagaatagagaacaggaaactcacaattgaatgatgtcgagaaacagagtgaaagaaaagaagaatgcatttgtatacctgaaacaaaactggcaaaatagttcaagtcctgattcgatcaagcaaagcctgaagataaaaagggatcttcccccctaccaagcccaaattgatcctgcagggctttgaatgataaaacagataccaccgcaagtcacagtcaaccagatctcatcagcagctacttgcagaggagataatgaagtcagtagagagacaggagggagcatctttgactttatataaaagaaccctgagaatggaaattcttggggatattccatctaaataaccactgaacctgcaaactgcaaactgcctaccgttgactatctgagcaggaggctttacggatgtttatctgagaacaaagtttcattattaaaaaatcagaatcctatgactacattgtcctaaaccgtctttttatagtaatgcctcaaatttgtgaatatgtttccctttttatttggcaactattcgcagacttcagtaaaaaatgcccacatattatcaggacatacaggagtcttcagaatccaatccctgccttcggtatccctgtaaatgtggcccttctcacaccctgtgctccagctgtgctctcttgcttccagctctaactttgccccattatttcttggctgggaatgccctttttcgaccctgtgcccccctaatattttctgcacgtggcttacagctacttattctttaagattagaagcccaaagagttactaccactactatgtgttcccattggttatctcaatcataaagacaatagcaattaaggattgcctgctctgtatcaacctcctttttttggtgccccacttaaatattttctaattcctaccttttcttttagccactgatgtggggaatctgttctatgcagacttgaccaacttctatgttggtgtaactagccagtacctagctggaggtctaagctatgacttctcactccctgccttagccttctcttttaatacttgcccctaattttttgtttcaagtgtggcaatttacttggtctgaagtagaatcctactaataaccagagagctgggttgtctgggaaaaaaaatagttgaccttataactaggtggagcttgccagaaggccaagtccactcccaaccatggccttttattcccacaacactctgtcagatctccacttacggctcaggagtgatgaggaaacatttatttttaatatatttattatattaaatatttattataatatttaatttatttatatataatttaatttatatataatttaattacataattatttttataattatatataattatttttaattaattaattatatataattaattatatataattatatataattatatatataattaaatataattatttatataattatatgtaataatataattatatataattatatatataattaaatataattattatatatacttatatataattaaatatataaaaatatataattaaatatatataatttaattatataattattatattatattaaatatttattatatttcatttatttatatatataatttaatttatacatataatttaattaaattatatataataaatatattaaatatttattatatttattttaatatattaattatattaatatttaataatttaataattaatatgatatattactattaattaaatattaataaatatttaatatatttattatattaaatatttattataatagaatgttgtatatgaaaattacaaagcaaaagttatttctatcagtcaaaacaaacagacatactgtattggctcatctttctaattggtcaaagatgttagcaggaaaggagtgttaacaaaaagtgttgagaactaaaatattgcccagaaaaaataatattggttataaaacaaatatcatttgccaaggacagcagagtatagaggagacaggtgagagcagtatttctaatcaggatgagggctcagagtgtgaattcatgaactcaaacatcatacaacactcaacggagagaataaaaccctcaaacagcccatcccacatggtttaccactgatacagtttctctccatgaccaaactctgttcaggctccactgagttctttttcaaccgaaccttg

SEQ ID NO: 12700 - DNA, 5463 bp, Human
ttctaggtatatgttaacacagcagtcctcaacctttttggcaccagagactggttttgtggaagacaatttttttcatggacactggggaggggtggatagtttcaggatgaaactgtttcacttcagatcatcaggcattagattctcataaagagcatgcaattgtagatccatggcatgcgcagttcacaatacggtttgagctcttctgagactctaatgccactgctgatctgacaggaggtgtagctcaggcgataatgctcacttgccctctgctcacctctttctgtgcggctggttcctaacaggccaaggtccagcagcctgggaggttggggactcctgttttaacagataagagaagtctttttagctcaacagtcatatcactaggttagcagtgctttgaaaattctctggctgtgtcctctggcattcatcctgccaagttgctttaacaattctttcctgaggccctctgaggtgagaatattgaggcaaggtgattagaagggagccagtgtcagggtcatgtggaatgtctctgaggcctgtttagaggctgtgaagcaaggctctgtttgagaccctggatacagtttggtgccaacctcacctgaacacacagaaggctacagcccctgggtggatggtgggctgaagaacggttggggaagaggcatcggaaaaccttccttttttaacccatggcacctatagattgaatggtccctggactgaacggtcttgaacaggcagcattattttcaaggtgtgcctaaggtcatacacttttcttgctttctgctctcatttggcaactatggacaaccagacctagccagcactacctcattttttctaccccaccatctacaaaccaacccttttcctttgtgaagctcagtctgtttccaatttaacatatctggcctgatctttgtcttggtgccttgttttcccctaaaaaaagacagcctttgagaaaaaaatggctgccctaaaagccattagggcctagacctgttaccaagtctagagaggcacacagctgtttgctggcctaactgggagtagggtgagcatattctctagaactggcacttttcagatcccgagatatccacagagtgtagtcaaagggccttttaaaatgtgcatgctactcttattggaagaacttggtttcacttctgggaagatggcttacttacccatgggaaacaggctcccattatgaatagtacattcatgtgctaagatgtgttgacttttcaaaaagtgtcataggacatcagagcaggggtgcttccaagaaggtgtaatatcacttatatcaccagaaaccattttggataaccagggagttctactctgccttggccttctagcaggtgcctgagcactcagtcaccaaattcagcctgagcatcttctgaataagatgctctcctccgacaaggtgggaggggggtgaaaaggggggcggggggaaaaggaaaggaatgaggactagaaagataggcctgggtccctgtatatgggagtaacttccataaaatgtggacaaggggtctctgctgcggaaaggcgtctgccctctcccttgagcgccccaaggcagagctgccttagggggccaaatgctgtatctgggccaaagcctggcctgcagggcaggtggccagaacttggaaggaattctcttccgcagcccagggtccaggcttggccccagcaagctgccctgccagcgtctgctgcctggggcctcgcgcattccgagcccccgccccctccgcccgtctcccagcctcgcccccactcttgtccccttctcctccccccaccagctgtcccctttccctggagcagcgagacagccagagcctgggaagaggcggccgcgggccggagggggcgtggtggggaaggggaggaggggcgggagtgagggaataaggaggccccgccgtcggcgcccccagccactgcgcgctcgccggagagctgggtgctaccgctgtttccgctgctgagccctgcccgccggccggcccgctcgctagctcgcttcccctcgcccagggggaaaggtcagcagcgtcctggagccgccgtgtcactccccgaaagccatgaactgcagcgagagccagcggctgcgaacccttctgagccgcctgttgctcgagctgcaccaccggggtaatgccagcggcttgggcgctggccctcgtcccagcatgggcatgggggtcgtgcctgaccctttcgtgggccgcgaggtgaccagcgccaagggcgacgacgcctatctctacatcctgctcatcatgatcttctacgcctgcttggccggaggcctcatcctggcctacacccgctcccgtaagctcgtcgaggccaaggacgagccgtcccaggcttgcgccgagcacgaatgggccccgggaggcgccctgaccgccgacgccgaggctgccgcgggctcccaggccgagggccgccgccagcttgcctccgaggggctgcctgccctcgcccagggcgctgagcgggtctaaaaccacagccccagattgctggttcgcgccctcctcatctcgctcatccctgggcgcgcctcccaccttccacccccaactcccttccagggttcgcctcatctgaggcccagataatggtgagaggccaggagaccttgtctggaaggccctggaaggagaagcaccaccttacccattcgggccagtttctccctcttcacccctgcgcctccacccctaccccgcacatccaactgcactaaactgcctctgctctcttgtcttcagacagccctgacagcacgctccagccctctgggaactgaatccaacacgtccaacacttggcactgaactgaagcaatgcattctatcagaactctgggccgtctaactggcagctgctccaggggctgccagggactgctcactctgcagagccaacgggcttgccaggccgactgcagcagctccagcttccagttgccttagggacagagacaaaggaaatgaagagacctcagacatcttttccctccctctctctttcagcagggagctagcaggacactaggaccagtctgtgggatagaatgaacttaatgggggacggaagggggaggagtgctcaacggggagggaaatgatctatgactccaaccgtatgattttcttgcctccccagttttcatcccagtggtaacgcctgatttttggtagctatgccatcttctgctgaggattaccattactgggtgtatcaccccagtacttccaaatgcctctcctctattgattcagttgttattgcagtgtctgcttcatccgtggaacttgaggctcagatgccccctgctctgtaaccctggggaatgtcagaggcaggtaataaaggttgtttaaacaataacgcaagactcttctctcagagattccagccttaagacccagtaccatatggagaaggaatcctttttcttttgcttttggaaatgatgtttggatttgggggttgggtggttgtgatatttatatctatgtaaccagttccaatttgatatgtgtgattatgggtgaagaaaatgtttatatggctaaatgggttgttttttcaagtgtttcaaaagttatacctactttattacttatccctccttttttcttatttctgaagcactttcaaagatcacaatgcagtctttcaggatgcactttaaaaaacctttaaggcccatcccttttagctattatcaaacctaatttttagaagccaccttaataattgtttttattttactttttttgagacagagtctcactgtgtcacccaggctggagtacagtggcacaatcaaggcttactgaagcctctgcctcctgggttcaagcgattctcctgcctcagcctcccaagtagcctcctgagtagctgggattacagatgtgccccatcatgcccagttaatttttgtatttttagtagagacggggggtttcaccatgttggccaggaggttctcaaactcctgacctcaagtgatccgcctgtctcggcctcccaaagtgctgggattacaggtgtgagccactgcacctagccaataacttttttgaagtggcttattaaaagacaaggaagccaccaaatagtgtaaatctgaagtcaaagagaaaattcttgaactgagcaatcttaaccaatgatgggtaaagttagaggtgtgtgttgtattgatttattctccttgtctcaagaaggttgtcagaaacttccctgcttacagctgaaatgcttatatctgatgatggctgtttgggcttcatcaaccacacataaaatcacctcttagaagtaagccaatttgcttaaatatagctgggttctctgataatgatagcaggacaaatatattaccagtcacttaaatgcattgataacacacaaacctcattcaaggcattgggtcttaccttccagcccatctagcattttattggaactgttaataagttaagtgaacttacttttatttccaggattcactcattgaagctatactggccttgccccattggctcttctccagtcctcgttccagccataaggtcacccctgaaggtgagggccagggattgggcagcagtccaagacgatgacagaaagagaagggaagctgtgtgagccatttcagccaggcagggaggcctggggaggatgtggaggaagggcacaatatacagcaatgctgaggacatgtgacggggcggtcttcagtcctgtattctaagtaaaacaatgtcactcatttatctggcataatggggactcaaggttattattattaattttttaaattgagacggagtcttgctctgtcacccaggctggagtgcagtgtcgtgatcttggctcactgcaacctctgcctcccaggttcaagcgatcctcttgcctcagcctcccgagtagcagggctaaagcctgcgccaccacgctggctaatttttttttttttttttttttagtagagacggggattcatcatgttggccaggctggtctcaaactcctgacctcaagtgatctgcgcaccttggcctcccaaaatgttgggattacaggcgtgagccaccacgcccggcctcaaggttattttgataatgaagcataatcactgcttcaggtgttgaaattttgtaaacacatttgtaccattttcccatagacatttaaaagaatatattgccaaaaataaaagaagctgggagcagttaggacagtgctcataatacacattaatgtgccagctgtggaaaacaaatcccatggaaaatgttcctgcttttaaaaacattttaacctttttatgatgacttagggtacccatgaagaacatgtagcgagagt

SEQ ID NO: 12701 - DNA, 34422 bp, Human
agcaactaactgggtgagatttggcctagagggacctctaggcccctgctccacacagtggaagtaccatcagcccaccacataatgtccctgcctagcattgagcctgatttgtaatttaacaaggatttgtgtcattagttgtgtcccctttgcctcccctgccagtctggaaactttaagaggtcagaagctgtgtctagttttcgtttttatctcttagagatggagtttcactctgtttcccaggcctggagtgcagtggcgtgatctttgctcactgcagcctcgaactcctgggctcaagcgatcctcctgccccagccttcccagtagctggaactaaaggcacgtaccaccatgatcagattgtgtctttttttcaccagggcctgattggtcagggaaaatatttgttgaatacttgaataaatgatacccagacaaaaaaagtcagcttgaaatctggatctacctctgacactgagtgagtcaattggcctctttgtccctcagtttctttctgctgtaaagtggtgcagttcctctttttttcttttttagacgaagtctgactgcaacctctgcctcccaggttcaagtgattctcctgcctcagcctcccaagtagctgggattacaggcgcccaccaccatgcccggctaagttttgcatttttagtagagatggggtttcgccatgttggacaggctggtttccaactcctgacctcaggtaattcatccgccttggcctcccaaagtgttgggattacaggtgtgagccaccacgcccagcccagttcctccttcagccaaggctctcttgagaatgtaagggccaggtgtggtggctcacgcctgtaatcccagcactttgggaggccgatgcgggtggatctctctagcccaggagaccagcccagcctgggcaacatggcaagaccccatctcttaaaaaaaaaaaaaaaaaaagagggagtgggcaagagagaatgtatgtacagccattgggaaacaacccggaacaggactcaggaggtccttgctcctgtggactttacaggagacagacagtaaaggcacaagatgccttcttatggtactaagaagaaaatatgccgcatgatattgcagatgggggggcgggggcgtcacagaacgtgactttttttttttttttttgagacagagtcttgctctgtcgcccagactggagtgcagtggtgcagtctcgcctcactgccacctccgtctcctgggttcaagtgattctcctgcctcagcttcccaagtagctggaattacaggcgcccaccaccacgccaggctaatttttgtatttttagtagagatggggtttcactatgttggccaggctggtctcaaactcctgacctcaggtgatcctcccacctgggcctcccaaagtgctgggattaaaggcgtgagccactgcacccggcccagaaagttgacttctaagcgtttccccaaagtgtctattaggtatctttatgattcaataacccattcttacagaaattaattgtaagcctgggagcggtggctcacgcctgttatcccagcgctttgggaggctaaggcgggaggatcgcttgaggccaagagttcgagaccaccctgggcaacacagcgagacctccatacatctctaagcaaaaaaaaaaaaaaattcattgtaaaagcaattttctttttggttactgccatagggattttgtaactgagtcacaccgggccgaggcgggacctcattggctgcgaccgaccacgtgccgcagtcgccccggcggtcggggccccgcccctcggctaccgttctgtggatcaggggccgagctccgcccccggcgcgcggctgagtccctctctataaaaggagccggcggaggatgacgagcctttacgtcggcgcgtaacgagggggtgcgtgtgaggtcatcgcgcgggcgggcgggcggggtctggcggtttgaacgagacgaagacggaaccggagccggttgcgggcagtggacgcggttctgccgagagccggtgagccggctagcgggcccggggggtgcggctgggggggcggccgcgtgggccaaggccgggcgtgcgcgggcaggccctacgggcagcgccagggccgttccacacggcggtgctgttcgagccgggtgggggaagggcggggccgtcacccggcgcgcgcgggctgggcctgggggcgcgcgctgcgctctgctcagggggcggggtctcgggccggaagtgggctgctgctacgcggggtgggggtttctgggccgccgctgaggtgtggtccctgcgctgcagcgactggaggtcccagggtggttgggccctgggagggtgtgggcgaggtgggccgtcctgggagctctggggacgcacattgtgggaggccgtgttgcctgagggccgagagatcgggtggtggagtcagacctgggttgggttccgtgcggtgtgaccttggacaggtgctttaaccgctgtggatctcagcttcctcatctgtaaaacggggacagtaatactacccacattaaactcttagcgcgatgtatggcagaaagtaagccagctcttggactccctcctttcttcagtgtgtgtttattgaatgcccactaggtgttgggcaccgtgctaaaccctggctgttttcccgggaacaaagatttgctctccaggaatccacattatgatgagcaggaggacagtataacgggatggtatcaacagtgctagttcagtccctacttcacagttgccctcggatgctgcagggcagagcttgacctctgccccattttggggatgaggatcctggggcccattgagggaggttatgctaggccgggcatccgcttctccgatggcatgtctctaacagtagtaatgataatagcagctctttgttagttgggcacttgttttgtgtcaagcactgttaagtgctccatgtggctttgtgtcttttaatactaacactgtctttaagagagattctcttcttccttttttttttttttttgagacagagttttattctgttgcccaggcgtgcagtggcaccatcgctcactgcaacctccgcctcccgggttcaagcgattctcgtgcctcagcctcccgagtagtcgggattacaggcgcgcgccaccaagcccggctaattgttgtattttttagtagagacgaggtttcgccatgttggccaggctgttgtcgaactcctgacctcaagtgatctgtccgcctcggcctccaaagtgttgggattacaggtgtgagccaccgcgcctggcaagagagattactttcattttacaaataaggggtctgagactctgagaggcggagtgtcttatgcagcccagcaagtggctgaacccccacctgggacttcagtgtctaggctcttaacctctttattacactttctccctgaggtccagagctacacatccagatgtgccctttgtggtggtgcgtcaaagtgcctagcacagtttttggcacagagggaagcttaggacgtgatgtgccttttgcttaagtgttttcatgtagatttttgtttaatccttaccaccactttgtgcagagatactgttttacccattttacaggatgagccatttgtgatgcaggaagattaagtgacttgcccacggtcacataggtcctttctggtggcacctccttcccccactttacatagggcttattgtggtgccttgaaagtaatagagtgctttagagccagcgttgaatttgtataggtttgggatcttgctaggagagctgctgaaggaagagagattcctgggtaggtttgagggagctttttcatggtggtggtggaaacctggatcaggaagccttgtaagggtgagatttgtgtggtagtcatgggtcttccatggctgccaatgatggaattgtgaaggaagggtgagctggagctctgttttgattgtcaggaggagccaattaattgattgagtcggtggatgttcattgtacatccacagggtgcctaatccatgtatttagtggctgcagcgtttgtggagcacgtgggaccaggtattaatgtactgctaatgaaagttttaaattatatgatgatgaaaggccattaatgttttttgagctggggtgtggtcaggagacacacatggctttaccagctgcttagattttatagcagcatgatgcacacgatacagtatatataggaatgtcgccataatagattacaattgctcagctgggaccatgtcttttttgtttgaatgtctctggtacctgattttgcgcacagtattttgttcattcaaggattttaaacaagggaggcacttgctgtgatttgtgattcaggaaattctctctggtttgctgtgtaagaacagattgacacagacaaatttgaagactgttgcagtgcatctccgtgcgagatggtgctggcaggtctcaggcgcactgtttttggcattggagataggaggatgagtgagacaaggtccctaccctacatcttgtttgttaaatacctcttaaatttgatgccatgccaaatattttatgtaccttatctaatttaaacccttctatgacccttttcagataggtggctttaacttgtaagggaactgaggtacattgagtttaagtaacttgcctaagatcacacaactaatgagtgactgcctcacattcaaacccatgtcctcctggcttgaaatcctcagctgtttgcatcgagtggattgcttcctggcccaaatctggctcgagaatggttcagaaataacgagataatgacaattcattgtgggacttcctatcataaaggtttgaatgaattgctctggaaacatagggattaatttcccagtggagtcagtaactaaattgtgttggtgtcttgcataacatggttttatcagctgatttggggagtgtaacagtgttgatgatttgctttctgacaagtttatatagacacatttttctctctttgacgctgttctgccaacctgaaaataagtagtgagtgcttgctatgtgcaagatactatgaggtgcctgggagatgtgagggcacgcagacctggcaagttattgacctctacagacctcagtcaccccataaaaaggggactggatgggtggatttgcctcttctggctgtcacattctgtggcttggtgagtcaggaggcttgcagcagcttagtgcaggagactgatgtggaaagaccaactctagtcactaggtggagggaacgaagtaccgtaagagagcaaggggctgggatctcaggattgttccagattgctctgcatctttcccctgcccctccccactggtaatgttgctgtcttatgaaatgaagaaaattgttaagtgtctaggtcactatgaagtctctggtatttcatagtgtgtcctcatggtgactgctcagggatttgatttagatctggattagcctgcctttatcttgagtcttccctccctactgtctgttctctactagtagtcaatgtgatctttttcaaactgtaatgagagcaagattctaccgcacttaaaacctgaaagtgcctgggtgtggtggctcatgcctgtaatcccagcaccttgggaggctgaggcggaggattgtttgaggctgggccgcaaaatgagacctggtctctacaaaaaattaaaaaattagctgggcttggtggtgaccatctgtagtcccagctacttgggaagatgagtcaagaggatggcttgagcctgggaagtcagggctgcagtgagccgtgattgtggcattgcactccagcctgggtgacagagtgacaccctgcctcaaaaaacaaacccgacagtggatttcttaatagaataaaatcctaactccttctgttcccacctcaggctctgctctccttgctcactgggctggagagccctatctctagagcttcatgtggttgcttctttctctgatccttaagctcaactgttcatctcagagaggcttcctctgaccacattccgtaaaccccgttgcataagtggttggtatgaaatgatgtttgttggtgtatttggtcagtgtcagactttgcaccactagaatgtgaactccctgtggacaggcaccttgtctcttgcttttctgtatcctggtccctagaacagtgcctagcacgcggtagagctagtaaacatttgtagaatgagtgacggttgactacactggtgctcatagacaataacgcccacatttactagcatttgaaaattagactcattgctgtgtgtttattgttttgaatttgaaagcctagcagaaaagggagggaagagaatgtggaggctggggctgggcaggcttgcctgccaaccccagggcctctcttgtcctcacctgtaaaatgagggacatgaagtgaaccttgcagagggctgtcagggttaaacaacaagtgtctgtgaagtatctggcacttaggcccacagatgccctaccattgccaggtagctctgcagagaattaactacaaggattcttcacctgtaaggtcatttgatactgcctttttaatatctaggtattgaaaagctgatttactttttcaattatgaaagaatttatagttttttttttttttttggaaataggatctcactgcctcaacctcttggactcaggcgctcctcccacgtcagcctcccaaagtgctggtattacaggcatgtgccagtgtgcctggcctaggtatagtctttaaggaaaatttgggaagtagtgaaaactataaataggaattaataaaaacccatcgggccaggcgtggtggctcacgcctgtaatcccagcactttgggaggcctaggtgggtggatcacctgaggtcaggagttctagaccagcctggctaacatgctgaaatcctgtctctactaaaaatacaaaaattagccaggcatggtggcatgcgcctgtaatcccaggtacttgagaagctgaggcaggaaaatcacttgaacctgggaggcggaggttgcagtgagttgagatcgtgccattgcactccagtctgggcaccagagcaagactgtctcaaaaaaaaaaaaaaaagaaagaaacaaacaaacaaaaaaccattatctgaagaaaattgtaacattttgatatctttatgggtaactttgggctgatgttttctaaacagaaagcattctcgtttatgcatctgcctcccatcataaaagcacttactcatccctttatttagtgcctcttatagtttagaattgtatattaatcacattaaaatggggcctcaattttagtctggctggtgttgggcagttcatttcaggtcatgtttgtatgtggaaatccagattctgtggctggaatcttagtgtctctcgtttggcctcatggggaagaaggtgaggcttaaaaagtcaatgtacctaggctgggcgcagtggctcacacctgtaatcccagaactttgggaggccaaggtgagtggatcacctgaggccagtagttcaagaccagcctggccaacatggtgaaaccccatctctactaaaaatacaaaaattagctgggtgtggtggtacacgcctgtaatcccagctactcgggaggctgaggcaggagaattacttgaacttgggaggttgcagttgagtcgaggtcgtgccactgcactccagcctgggcgacagagtgagactctgtctcaaaataaaataaaataaaataaaataaaattgagtgttcctacaggtttgcttttggtgactctctaggaaacacttgaccttacttgcatgcctaatgtaacacaggcccttctcttttcttcccatgctttagaagatggcagtgaacgtatactcaacgtcagtgaccagtgataacctaagtcgacatgacatgctggcctggatcaatgagtctctgcagttgaatctgacaaagatcgaacagttgtgctcaggtaagagaaatctgctggatcatttttctaggaaagcctgtaggtttttcaggaatgtgaaggcctgtatctgactgcaaagccacacacagaggttcagggtctttgttagggccaccctgtttcttcctctcagccctgcctttgcttctgcttccaaaggaacttttttttttttttttttttttgacagagtctcgctctgttgcccaggctggagtgcagtggcgcgatctcggctcacttcaagctccgcttcccgggttcacaccattctcctgcctcagtctcctgagtagctgggactacaggcgcctgccaccacgcctggctaatttttttgtattttttttagtggagatggggtttcaccgtgttagccaggatggtcttgatctcctgacctcatgatctgcctgcctcggtctcccaacgtgctgagattacaggtgtgagccaccacgcccggcctttttttttttttttttttttttttgagatggggtctggcgctattgcccaggctggagtgcagtggtgcagtcttggctcactgcaaccttcgcctcccgggttcaagcgattctcctactttagcctcccaagtacctgggactacaggcgtgcatcaccacacctggctaatttttttgtatttttagtggagacggggtttcaccatgaggtcgaactcgtgacctcaaatgatctgcctgcctcagcctcccaaagtgctgggattacaggcatgagccaccatgcctggttggaactatacttaaataaagagtgtgctctggcctgcaggtccaccatcttctgctctagagactgcattctgaggcctgaagctcagccccgacttcttggtgtctattattgtgcatccagattgcatgttttatttgaggacagtaattgtattaactactgtctgctgttctagttttatgttcatcagtggcatttcttattcccaagaagtacaagatcaaagtctagcaaatatcatttcagccacaattttatggaactactgtttaacaataatttggcaaagatgtaatgatttaaagtctcggtgtggtggctcacgcctataatcccagcactttgggaggctgaggcaggcagatcacctgaggtcaggagttcaagaccagcttggccgacatggtgaaaccccgtctctactaaaagtacaaaaaaattagccgggggtggtggcaggcgcctgtaatcccagctgctctggaggctgaggcaggagaaacgcttgagcccgggaggtggaggttacagtgagccaagatcgcaccactgcactccagcctgggtgataagagcgagactccgtctcaaaaaaatgaaaaataagtagtgatttaaaagaagaacaaaaacatggtctctttctatgtatgctaatcgtatgacgtgggaaactagaaagaagaaaacaaaaaaatgccttataattccactattcaagccggctactgttcactcactaatcatgagccactgtgcctgccctggatcgatcttaaattactgccattgcttggccgggtgtggtggctcgtgcctgtaatctcagcactttgggaggccgaggcgggtggatcatgaggtcaggagtttgagaccagcctggccaacatagtgaagccccgtctctgctaaaaatacaaaaaattagccaggcttggtggcacgcacctgtagtccagctacccgggaggctgaggcaggagaatcgcttgaacctgggaggtggaggttgcagtgagccgagatcatgccactgcactccagcctgggtgacagagcgaggctctgtctcaaaaaaaaaaaaaatttattgccgttgcttataggattttttcttttttttttttgagttcagcttctgcccttccttattttatagctgggtcctagtctcggtcttagtttcattgacttgtcttgttatttccttggtgaggtgtatttaatcttggttttacggatggtcagatggaggctacgtgtgaagctgtacagtaacacagtggtgcccaagagttgtgtttattcagcattaattactttgctgatcatagacaacaggctgttagccttagatctgtgctgtgtcccccccaccattttctattagtttcctcattattcatttccctatccccatttgtgtgaggcttttaaagcacttgtttgacctgtgttctgtgactaatgtgaggatgaggtcatcctagttttcactggagccagctttttaccagcaattccctctaaaatttacctttttctgtaaatatattccaaagtctatttcacttagttaattggaaaatgtgatctttaatgtttagataagttgtatatgtgctgatcgggctctaggtttatctcattcaggcagagagctgttgtagacaggactgggcataaagaggcttcagtctgctctgagccatgtgacttttgacaagacccttaatgtcttagttcttcatctgtgaactggggcagcgatacctggcccacttgttggccagtgtgagaatcacctataataacagctttcagataactgactgtgtgccagaccctggaaatgagtgcaggtcatttgatgggggcacatcctccttttacagatgaggagactaaccctggggcacagcttatgtattacagaacctggttttgaaccagatctttctgagcacacagcccacatgcatcctgctgcatacttgttatatcttttatagaaacatttggaggggattaaacaaatgtaaattacaaatgtaaattacatatagttaattatagtgatactgtttcactataaagtctgtgaggtttgtcagttgttttttttttctttttgagactggaggctggagtgcagtggcgtgatctcggctcactgcaacctccgcctcccaggttcaagcgattctcctgcctcagactcctgaggagctgggattacaggtgcgtgccacctgtaatttttgtatttttactagagacggggtttcaccgtggtggtcaggctggtcttgaactcctgaccttgtgatccgcccacctcggcctcccaaagtgctaggattacaggtgtgagccaccgcgcctgggtggtatgtcagttttgtctcatgtctgctacttttcccaaataaagtgctttttctccctagaaaagggtaagtgcaggacacttaactgtgatttgtaaacaaacttgttcattcataactagtcttcttgaaagccgtataagatgtctcttggagtatgtagatggttgcattgtgtttcacattggtgtttagaaaatgaggtcttgcttccagtatgagagcagacaggatgagacacagacattgtctctctgaagaaggcccgctgccaggggtttggagtcagagaaagtgaggctcctcaactccttgtgcttactgaggcccaaggagaattccaggagcttttgatgctggtgccagatccttcctaacctcatctctgatgagcagaggatctagcagaccagagttctccactaaacacagctttacaaagtaggaatacatttcttccttgagagggcaaagtgctgaggtcctttgttaatctgcctgctgcctgtgaagtggccaaattttgtcagcagtgggctctcctacccccaacagtgagctgagcctttgcttggctctggtagagggagattaggcaaggataactttcagtgaaagatttggcaggttgtttcaagattcattaatacattctgtagtctccgtagtttggagagctagtcatcaagtattttggaaagatagtcatcatgaggaaaaacctggtcaaagagaatgatttttatgagagcttttttttgtcagaaagggagtactggttgcttttgtgaattgttcctgtgttgcattccatattcaggcccctctgcattttctcaagagcacagcttggtcctctgcacatgtagaggggtctcactgaatgtattcggctctccccttctcctccttgtcttctccctccagcctggcttcctttatgggttccttcgcagcaaaggtgttgatgttcccaggcaaatggtagattcctttctcctcagcttaatgtggggccccgacagcccttgagttcatgtaagacagcttggcgatcttgcttctgctgcactgctaatgacatggtcctcctgctctgggagtgtgttatcacacctgtaaccaggcctctcccagctcagatctggtctgatatttctgtttatgggatacttttgccctacctgtcattacttaaaatctcagctttgttttctcctcaggctagctcccttttccaggtactccatttggggccatgattccatctttcttccagtgtcccaggcctgagaagcatcttttgaggctaattcacagttttatttgtcttctgaaagagcttctagatccagccccttctcagattgctcactgctgctgcagtggcctcctgactgaacactaagttccctctaagttcccagcccccaccttcccttttgttatattgcataagtctgcagcctttctgagggactggttttatcaagtcacatttctgatcaaggaagtatctcttcaaactttttttttttttttgaggcggagtctcgctctgttgcccaggctggagatctccgctcactgcaagctccacctcccaggttctcaccattctccgcctcagcctcccaagtagctgggactacaggcgcccgccaccacacccggctaatttttttgtatttttagtagagacggggtttcaccgtgtttgccaggatggtctcgatctcctgacctcgtgatccgcctgcgtcggcctcccaaagtgctgggattacaggtgtgagccaccgcgcccagcctcttcaaacatttttgcctaagtcttcaagcacctccttgatttttcccttgctttacataaagcaaaccaaaacagaagataggaagctcattttcttctgattatgaatagttaggtcttcattaaaaaaaattaaaggccaggtgtggtagttcatgcctgtaatccagcactttgggaggccgaagtgagaggatcacctgagcccaggaatttgagatcagcctgggcaacatgacaaaaccttgtctctaaaaaagaaaaagaaacatgaagagaatcatactcgcataaaagtctatcaggaggactggatgccaatatttatgtaattgattctttctctttttagaaatagggaaataaataagaatgtttctttcttttttttttattcctgtacaattttggtaaccagtttcatgcataagttgttgactttttttttttttaactcctgtgcaattttggtaaccagtttcattcataagtcattgtctcttttttgttgttttttttttgagacggagtcttgctctgtctcccaggctggagtgcaatgaatggtgcgatctcagctcactgcaaccatcgcctctcgggttaaagcgattctcctgcctcgggttcccaagcagctgggactacaggcatacgccaccacgcctggccaatttttttgtatttttaatagagacgggatttcatcatgttggtcaggctggtctcgatctcctgacttcaggtgatctgcccgccttggccttccaaagtgttgggattacaggtgtgagccaccgcgcttggccaatttttcttttttttaattgtgtaaaatagtactgggtaaaataccactgtggatatagttgctgaatagattgtcttctatttgggtttttaaaaaaagttcgtccgtttcaaaaaaaaaaaaaaaaacaaaagaatgccctcagtgtacttttgttggatgagtaaataaatcagtcacctcagaaatcaaggccttaaccttctgaagatcctttcttaattaagaatgtcaccctggtcactgaagtgcccctgctctcgtttatgttgactttccaaaaataacggtaaccgaacatgctggaaccagcagagaactggttcggcctgacctcaagtaagttgaatatgcattttatggcagtcttgaattctgcagattacttattacttaaccactggtttagcttcccaagcttgttcctttggcaaattagccctggaagggcagtaaagtacacagtgaagcctgctgtgaattaggagagttcagtttgtcggcattagagaaataatcttcctggaaagtttaagcagtaataaaacactttttggaaaaaaaaatgggcaagtgggggaaggaatgaaatgggatgaaatattgcaataatttattacagtagtctcttttttttttttttttttgagacgaggtctctctctgtcccccaggctggagtgcagtgatgtgatcatggctcactgcagtccttgacctcttgggctcaagtgatcctccttcttcagcctcctgagtaactggaaccacaagggcatgccaacacgccaagctaattttggtattttttgtagagacagggtttcaccatgttgcccaggctgttctcgaactgctggactcaagtgatccacctgcttccctaagtgttgagattacaggcgtgagctacggtgcctggccttatcatagtagtctttatttatttatttttgagccagagtttcgcttttttttttttttttttttttttgagacagtgcagtggcctgagagaatcgcttgaactcaggaagtagaggttgcggtgagccgagatcacgccactgcactccagcttggcaacagagcgagactctgtctcaaaaaaaataaataaataaaaaattaatagaggaacacaaaaatgtcttctattcaactttgttaattaaatgacgggttggctgggtgctctacaaaaagaataaaaaactagttgggcgttggtggcacgtgcctatagtcccgctactccagaggctgaggtgggaggatcacttgagcctgggaggcagaagttgcagtgagctgagattgtgccactgcactccagcctgggcgacagtgagaccctgtttcgaaaagaaaagaaaagaaatgataggttaaatgtatttagagatgtaaaaagcccagggagacagacgtcttagggaaaaaaatgttttttaatctagatcaaggatggatcttggaaattgcctcctgaagaggagggtatatctttgtgaaaaatcagaaaatgtcacttttgttattttcttttctgtattttaggcattcatttttgtttctagtggtcattttattgtcatgatgattaccaataaagaacaggagttttaaaattttgtagaaacactccttttctccttgttataggcttctgggttgcaagtatgttgtagaatatatggggtgaaaaccacagtcttgttacaggttttagaaattgacttcacatgaagttagtgaagcttttggtttttgtaggtctacttcacaattttaaaaattgtatttggtttaagtgggtctgggaagaagttcaccctgcttctttaattgtatttttctgttgccgttgttctttcaggggctgcgtattgtcagtttatggacatgctgttccctggctccattgccttgaagaaagtgaaattccaagctaagctagaacacgagtacatccagaacttcaaaatactacaagcaggttttaagagaatgggtgttgacaaagtaagtaaacgttatcttttattgtggttaatgttccttaatgatcgttactaaggaggtagatgctagcttatgactttggacattttcttttttttcttaatttatctagttaacttttctcagttaacacagaatttactgggagcagtttgcccctaccttcttgcccctattccccttgcttgtttctttcttcatcgtctgtgaagttagtaactgtttagaggagtcagcctgtaaatttgtacagtgatttttatttttaaaaaattcctgtgtaatctctagtagtctggaatctaactctcttaatctggatttacttctgtaaaagcatactgtatgtagaatagttccagtagagaagattctaggccaggcgtggtggctcacacccgtaatcccagcactttggaggctgaggtggagaagattctagaaatacttgctttttatagaaggttacaaggaggctccgtggtgggtgctggaaaactcctttctgcccccaaaggtttttgaaggtaacagaaacatggtccaccaggcatggtttagcacaaacatttaatgtttagcacaaatattacctctgttttagtagataatagattaagtagtttatcccttcccccacccttgtgaagggtttatccttttaagccatttttggggggataactttttttttttatggcaaaggtagtaacacccccaattatcttgctggtgtctggtttttatttattttgaaatcagggtttttttttaattttagttttgtctctacaatatataaaataggcatttatagtataagaatatcacttaactttccaggcatagtttaaatagagttcatatacagtaattttgcattcattattatggaattttattttttgaatatggaaaatgtctaaagtatataaaagtaataatagtgtataaacaataaatagtaaatagtgtaatgatccctcatgtaactcaatggttagcatggccaattttgttttatatctaattctatcctatcctatgtattctgggttattgaagtgagtacagaggtaatatttgtgaatgtttcagtatcaagcaaagtaacttttaaaaattatatttgtcagaggggtggatatattattggatatattctttttataatacattgcaactggaatctttggagattaaaagatagttaaaagccaggcatggtggctcatgcctgtagtcctagctactctggaggttgaggcaggagcatcatttgaactcaggagtttgaggcagcagtgagctatgattgcagcataagactccagcctgggcaacagagcaagaccccatctctaaaaaagattaaaaagttaagttgtggccaacacttcagtgatttgaatacttgaaaacacagtattcttgtataatagaaatacttacagggtccttatgtatatttgttattttttgtgtgtgtgtttttattggtgttttttttttttttttgagatgaggtcttgctgtgttgccagtgctggtctaaattcctggactcaagcagtcctcaagatagctaggattgcaggtgggcagccctgcccccagcaagcatgttttaataggatttggaattacttggaaaacatgtcattttgtaaaaatttatcctgagactgattctgcatcttgatctattttcaggttagaattattcttttttcttttcttttcttttctttctttttttttgagacagagtctcactctgttgcccaggctggagtgcagtggtgcaatctcagctcactgcaacctccacctcccgggttcaagtgattctcgtgcctcagcctcctgagtagctgggattacagacgcccgccaccacacccggctaatttttgtatttttagtagagacagggtttcaccatattggccaggctggtctcgaactcctgacctcaagtgatctacctgccttgacctcccaaagtgttgggattacaggtgtgagccaccacgcccggcccagaattttcttgaacacagttcattgtagatgcctttggttggtttgtgcaatggatttttcttcccttttcttaaatggggtctctctctgtcacccaggctggagtgcagtggcacagtctcgactcactgcaacctctgtctcctgggctcaagcagtccaatctcagcctcccaaggagctgggaccataggcgcatgccaccacacctgcctaatttttttgtatttttggtagagcctaggtgtcaccatgttgcccaggctggtctcaaactcttgcccgccttggcctcccaaagtgctgggtttacaggcatgagccactgtgcctggcctgtgcagtggatttcatgctttgtgataggcattgtggccatgcaagttatatagcggacctactctttatagcataatgcacttttgtatcacgtcttacgatgtgcttggatggatgtgtgtatgtgacttatatggtacttgttccttttttgtttctgattccttttcatacatttgagagagtggggaggggttgggaagtgtaggtactcttgaaggcaaactgcatgaaacttgctttataaatttaggggcttagccctaaggtctctaaaatatttttttctccttttggcagagctttataatgaattgatgcatggactagtttgatgcttgccaaaagcctcttttttggggctaaacagttgtttttctctgcagataattcctgtggacaaattagtaaaaggaaagtttcaggacaattttgaattcgttcagtggttcaagaagtttttcgatgcaaactatgatggaaaagactatgaccctgtggctgccagacaaggtcaagaaactgcagtggctccttcccttgttgctccagctctgaataaaccgaagaaacctctcacttctagcagtgcaggtaaaaaaacaaccccaaaacgtttccaaaaaatagcgttccagatattcattcagcgttcaactagaatttttttcagtagccataggcttagggatcttaagaaatataatcccaggcatgtggccagagtatggattttggcatcaggcagataacggtgtgtgtccttaggtgtctgtagccctgtgtaagcaacttcaactctgccccacagtttcctcctctataaaatgggaattttaatacttgccccagagggtttttgaaacttgaacaagttactgtatgcagttttgccaaagctctagaaatccatcaggctagctcatgtaagagagcattagtttgttccaaaacaagggcatttttacagagccctaggatgggaagttataccagagctgaactccttgaaggaagtgtgtaggtctctcagggactgctcttggctgtctgtgttattctctctgtagaccagcttcctgtgtatactcacagcttccctacctgccctagaactttagctgctaggtgactttggcttgccatggtgctagcagagtcaggggcgggggtaggggagaggctgattttacataccttctcaaaagggtatgggcttggtagctttcccaagatgtgtttacattagtatagaatgtgtatattttggggcagggtagatactctacagatgctaatttcttcttttccagaggatggcaagaatattagttaaggtttcataatacctagagagaggcttgttcatctgatagagagggtaggttgagtgctttctaaatagcttaatggagagacaattcgcatgccatataattatatttttatatttaaagtataaagttaaacggtttttaatatatccaaagaattgtgtaactatcaccacaatcaattttagaacattttcatcactctgaaaagaaaccctgtgctgggcgcagtggctcatgcctgtaaatcccagcgctttgggaggctgaggcaggcagatcacttgaggtcaggagtttgagaccagtctggccaacatggtgaaaacccatctctactgaaatacaaaaattatctgggcatggtggtgcatgcctgtaatcccagctactcaggaggctgaggcaggagaatcgcttgaacccaggaggtggaggttgcagtgagccaagatcgcaccactacactgcagcctgggtgagagagacagacgctgtctcaagaaaaaaaatagaaagaaaccttgtacatagttaatagttgtcacttcccactttccccagctttaccccctccctccagccctaagcaaccacttatctgctttctgtctctggatttgccagttctaaacttttcctatacatggagtcatagagtatgtgatcttttgtgtctggcttcttttgctcagcctgctgttttcaaggttcatccatgccctagcatgtatcagtccttcattcttttttattgtggaataatattccattgcatgcctatacctcatttgattcagcagttcatggtcttttgcgttgtttcccactttatggcagataggaataatgctgctgtgaacgttcatatacggcttctgtgtggacctacaagttttgatttctctcagttacagacccaagagtatatactctgggagcagaattgctaattgctgtgccatgtgttaactctgtatttaaccttttgcagaactacctgttttccaaagtgcctcagctctttacattcccatcagcagggttcccgtttctctagatattgagtactttttattctttacctgtttagaatgggaaactacatagataaccccgtgcatttcatatttcagatgctgctaccagttgagtggagacgtgcattaagcatttagtctttgggataaacgtgctagagagagtcatccagaggaaatgcctattactgtgggtgaaaggccttgtgattatagtttggggtgttaggaagatgagatattttcaaacctggcatgtaatatgcaaactttacaaaataattgctaagtaggtgaatcatcagtgatatatataccttgaggtttagcccattcttgattaattttacttgtagataggttggctcctttactccttttttcttgtctttgtctgcttttggctgtaaatactgagagacgtctataaatactagtcagtgtgatgcttttctctcctcactcttctaaactccttctaaaaggtaagcagagatgaagattttaaagcaattcatgggaagagcaggctctcctgctcttatggattccctccctcttccactccaaggagtctgaggtgaggagttaggagggacctaactttccagatggggagcagtgggcacctggcaacagccgagactgtgtgctcatgtctagcgtgaagtttgcctttgctctacgaagctggatttggtttgtagatgtgttaactaaatcttagctgttgtaaccaacatgaaacaacctgtttgtggatttggtcagagctgggttaaggtggatcatctctgtgcaccagaatgactgtacccctttcagatggtagtcctgttcaccgcagtggagaaaagacctcactgaaggacttattcccagcatgaaacatcatgacagaaattggtacttaactctgctgccaggatagaaaccactcagtaggcaaatgtgggagcgttgtcttgcatgcgggggctctctagcattggttcccttcactgaacacctgtgcaaggcagatggtcacagcttctccatgttgtcttgtggattttttgtttgtttgggctggaattactccttttcaaaaacctgtgctctctttttcagctccccagaggcccatctcaacacagagaaccgctgcggctcctaaggctggccctggtgtggtgcgaaagaaccctggtgtgggcaacggagacgacgaggcagctgagttgatgcagcaggtgggcacccctgtgtttagcacgtgagtcacctcgggggataggatccttgcggtggccagggtgccttatccgtgttcttaaatgaacacctgccttgtttgcttgccagagcatgtgacacgtgtgagcctcaggtgctgtgcggggagcatgaacgtggagatgtaagagagagatcaggtgtgcctgggctctcttagtgtggcagaagcctgtgctcggaagccagtgcttagactagaatcctgttgaatgtttctggaatgctgccagggacctgggatttggagaatgaaagataaaggaggtctcctttttgaataatttaataaaaaggattccgcagtctctctgctgagtcctagactggggtcactggagattggaattcagagtggaactggtatgaaaagcctgtggctcttctagttctgttcttagtaattgggtgattcgaaatgtcttcttcaggagtaaatgtccttaaggcacctgtcagaggtctctgtggatcaaaacaagttttagacttttagacattttcccactaatccttgtaattggttggtttgcttgctttcagatgattctttttgttaattctattttttaaattttgttttattaaaaaagtttttttaataaaatagagatagggtctcactatggtgccaaggctggtctctaactcctgagctcaagtgatccccctgcctgagcctcccaaagtgctggagttacaggtgtgagtcaccacgcctggctccattgaaaaaatctgggatgctctgtgattccagtgagtttgggattgcatccttttacttttctaaaagccaagtcctgaaacttgagggaattgatttctaatgcagaacctctcatgacccacactcagacttctaagagatcaggacagtgagaacctgcccaaaaatcacatttcacttttttattttttattttctttttttgagacggagtcttgctgtgtcgcccaggctggagtgcagtggcgtgatctcagctcactgcaacctccgcctcccaggttcaagggattcttccgcctcagcctcccgagtagctgggactacagtcgtgcgccaccacgcctggctgatttttgtatttttagtagagacagggtttcaccatattggccaggctggtctccaactcctgacctcagatgatccacctgccttggcctcccagtgctgggattacaggcatgaaccactgcgcctggcccacatttcactttttcgttctttcatttgtgtgtgccccgtggtcttaggtgccttgggagtgtccaggtgactgggtcaccgtcctcatccttggagtgggtgtggctgacttgagcacccgctggggctgttactttgaagtacagaagcctcggagaacaaggagagacttcctgtaactatttcaagacatggatttcaaacacaggaagcagtttcagaaagaaatacgagagagtaaagagtggttaatgttgaggctgggtagcagcgacttgatctgtgctctccgagagagcgtgccaggttctgcagtgtggctgctctctgctcagctcttttttttttttaattattattattattatactttaagttttagggtacatgtgtacaacgtgcaggttagttacatatgtatacatgtgccatgctggtgcactgcacccactaactcgtcatctagcattaggtatatctcccaatgctatccctcccccctccccccaccgcacaacagtccccagagtgtgatgttccccttcctgtgtccatgtgttctcatccgctcagctcttatcctgggtgatggagcccaggcttggggttccatagattgagggagaagtaggagtgtctctgtcagttaacttctatctggacaagtcagcctctctgaacttactgcctcacgtgtgaagtggggctgacacttgctcacagcagttgagcagattatatgagctgaatgttaagtgcctggaatggtgtttgttgccaataccactgggataaatgtcagtggataaaagactgtgatgattatggttcttgttcatggtcttgatagagtagaataatgttctttaaaagttcacaggaaccagtttttttttttggcttgtgtgaaataatatgcgtaaatggtcataacaaaagtagccaacattttatttatttatttatttatttttatttttatttttttgacacggaatctcactctgtcgcccaggctggagtgcagtggcgcgatctttgctcactgcaagctccgcctcctgggttcacgccattctcctgcttcggcctccccagtagctgggactacaggcacccgccaccacgcctggctaagtttttgtatttttagtagagacgaggtttcaccgtgttagccaggatggtctcgatcttctggccttgtgatccatctgcctcagcctcctaaagtgctagcattacaggcgtgagccacagtgcccagccatagctaacattttaaaagtgcttatgtcatgcacagtgtaagcacttaatttcactttcgcagcaaccctgtgaggttttacacataaggataataaggcttggagaggttaaataacttgagctaggatttgaacccaggtatacctgtctccagaacctagatcagtcagtccctgctgaatggggaattgaggaagaggttatttgatttatctaaggtatacagatgtttcttttccttgcacccacctttggaaactgtaagtactcaccagataatgactctgggcaaattgctgctaagcgttgatgagagtaccaaggcatgggagatctgtcctagacctagacaggtttgatacacttggagaagatggacttggtgcctgcctgtgttcaagtcccagatgagggttacggaaggcaagaaccacaactcttatgggggagagtgtgattggggtctgaggaggcttccttccctgagagggtgaccagaattagctgctttggatggtcggtgttgtagaacttcaacagtcgaggttgggagggattgtggtcttgaagaggcttataactctgttgcatgtccatcggtgctggggaacattgagaggctaagtttgcagaggctgaaggtcactaaccaggtgctttgttgatcctggaaggctgggatcaaatgctcatacccagctggttcaaccctgacatagaagtactgtgtttggcctgcacagagttttatttatttatttatttatttattaaatataaaggatttgtctccaggttgtcaaagtccttcccttacctgttaccacctctcttggctcatttacattatctggcccctcctgaaagtttttgcatttgcagccctttgtaaatatggaaaatggagccacgtgggcttgtcaggctgtgggaaaaacagtgtatctgcacacactaccttgtggtattcgtatccttgggagatctgcaaagattctacattcctaagtcgtcctggagaaatttacttttagttgattttagtccaaagcagtgctgtccaatgaaggtagaaggtgagtcagaagtgtgagctacctgatttacatggtctagtagctacattaaaaagaataaaaagaaataggtaaaattaattttagcaacacatcatctaatatgtaaaaaataatactccagcatataatcaaatataaataatgatcaatgagctgttttacatttgaagactctgctaggtctttgaaatcaggtgtgtatgtgatacttgtagctcatctcagtggcactggccacgtttaagtgtttatatagacacatgtggttgatggctactgtggccagtgcaggcctgaaacactgacttggggcttcttaggttataactattgctttacctcaagataaggttctaagagtgaccttaattactagctacaggttttttttttttttttcttttggagatggagttttgctctgtcacacaggctggagtgcagtggcgtgagctcagctcactgcaacctctgtctctcaggttcaaatgatactcctgccccagcctcccaagtagctaggattataggtgcctgcctccacgcccagctaattcttgtatttttagtagagacagggtttcaccatgttggccaggccggtctcgaactcctgacctcaggtgatctggccgtcttggcctcccaaggtgctgggattacagatgtgagccactgcacctggccaagccacagatttttaataacctcatgaatacagacttgaaaggagtgccacgtgaaagccagtgtcttagtatatatttttttagtgatttagtgtttgttatgtgtgtatagttatgagcaatatcatggacagatgcaacttttggcctttataggtgggacccagaaggctgggtatctggtttggccttgataatttgttggacagagaaggttttaaagggtttgagagggtagcattagtgaaactagtgaaactaggtggataccaagctagcattcctttttttttttttttttttttttttttttttgtggcgtgatctcagctcactgcaacttccgcctcccgggttcaagtgattcccctgcctcaacctcctgagtaggtgggactacaggtgcacaccaccatgcccagctaatttttatatttttatagagacggggattcaccatgttggccaggatggtcttgatctcttgacctcgtgatccgcctgccttggcctcccaaagtgctgggattacaggcgtgagccactgcgcctggccagcattccttttcataagctctttcgacttcctttcttccttggtcattaatgccaccaggcatgtgattagaaggccccttccctgccttttggattgtggagctgtagctctgagtctgcttcccgctggggctggtcggctcttggcctgtgtatcccctgctctttggggctgttggtttcaggaaaggcagcaaactgcagcaaaagcagaggtggggacagtgagggaaaatggatgatttagctttgccggccaccaggcagtagctgtactgtatgtatgtatgtatgtatgtatgtatgtatgaatgaatgaatgaatgattgaatgagacagggtcttgctgtgtctcccagactagagtgtaatggtccatttatagcttactgcagccttgaactcctgggctcagacaatgttcctgcttcagcctcttaagtatctggtactataggcatacaccaccctacctggctaatttttagatttttttgtagagacaggttttgccatgttgcccaggctggtctcaagttcctggcctcaagcgatcctctcaccttgacctcccaaagctttgggattgcagatgtgagccacggcagctggcccctctagtactttattgaaactttcaattattttttatttctgtggctggtaaaggaatagtgaaaggctgtctagaactgtgattctggtttggtctaacaagactttgatgatgaactttgaaattcgttttgataaaattgtcctggtggtgtcacctgatcctcatctctggatgctttttgactgcaggttataaagagggtcctttctcctgggatgagacttgatctcctctgttgtgtttggtgtcttcatcaggctgtggggaagctagataagctgtttatttctgtttttaaatttttattatttattttttaaaaagatggagccttgctatgttgtcacaactggcttttaactcttgggctcaagcaattctcccgactcagcctctagagtagctgagacgcgtgcgccactccacctgacatgcttcagtttttgtggctgtgagttcagaaggctggactagatgatttctctggtcccttctggcttgtagaattcccttctgccgaggtcgttctcagtggctgtacctttgattttgttgctttactttccatgctgctctgtggccctgacctgtaaatacaggtttttgcaacttgcattcattgacagttaaatggaattcacttgtcatagatgtgaatacagtacactggaatgaagatgccccatggttaaagtacacacaggactatgagtgttataacttttattggtcttggctagatagagtcctggcctaaggactgagacagatttcttcatagcctcttaatgggaatcagagaccctcagtggggctcatggagggtcagagcactttccattgggcttccaaagagttccattgagccctttccagggtcctttctattgaccccctcatgcaatcagacctggacttgattgtccagtcccttggtaaggactcagtttatgattgtcagctaccttgctaggctgtaattgtctcaggcttccctagttttttctccttaatcctttttcagtccctgagaagcttctacatgtttcaaggggtagtctgctctttctgggagctgttaccgtcaaggttgctataaacaaatccatgttgtttatctgaggctgaagaaaattgacattaaactgatgtggtttttgtctgtgttggggtttgatcaaagaccacatctccttttgggttagaagtctgcctgatattttattgccatactaatgccaagcatctcaccctttttaatgtcttgtgcaggtcaacgtattgaaacttactgttgaagacttggagaaagagagggatttctacttcggaaagctacggaacattgaattgatttgccaggagaacgagggggaaaacgaccctgtattgcagaggattgtagacattctgtatgccacagatgtatgtgtttgacatgaggatattttctttccattttacatagaagggttggtgaactctgtgctgatgcttgttgtattccagtgttgcattcatcaaaagacttcatctttaacccctcaaagtcagccagagggcatctctgcccagctttagcttctgcctgaggtctgtgagcttttgaagaaggaataggacaaggaggtggctggcttgcccagcatctgtagtatgtggccactgataggtgatgagtgccacaaactgctcttagccagaagcaacccatgtcctcactccaccccacctcctattgcttggatccctcagcttcagttgctgcctccattttatcagggcccggggcatgcccggaaaagcaggcacatgctccctttttcacggcgtgcccacatatcacgtcatgtctgggtatgcctttctcctccctcctaggagtttgcctggttctcactccctcaaagtactctatgatcaagtttctttggatccatgtttattgcacagtcaaatctgttgatattaatcacgacatgttagttgatcagggaagactcatttttttctagatttaggattgttatccggctgtgtccactgtttaatggtgatgtttgtaattctgtgtgcctagcaaggtctgtaggatcaaactacaaacttctggtagtatgtgtagcactatgcaaatacaaggtagtaataatgctgttactgtcactgtccttgagacatatcttgtgaatttcaggggattaagacagatgactgaaaagttgataatctgttgaataaatctttaatttagagcttgctctgtgctatgtaatgaaaaaaagacaacgaagatatagggggtccttggtttagtctgagtattattttagtggagccacatcttaagtaagttcagctatagagatttagttaatagaaataagatggtggttgaaagagaagtctgattttacagcagaatagtatagtaatttcctgctctgagtccatgccagaatgccctggagtgagaatgaggtgtgtgggagtcatgaatctgctttttccttgtgcactcaatttttctgccactgatgttgggtcagtcttgctgttgtgaatattttgggtaaagcatggctcctaagtataacaaaaggaaggcataaaaggaaagctggctgcatagacagtttattgagagaagatgttagagtactgaactttacaggggacttcaggaatttttgagggaaatttttttttttttttagtgacggggatctcactttattgcccaggctggagtgcctggtggtgcgatcatggctcactgcagctttgacctcctgggtcaagcagtcctgcctcgaccccgctggggagtagctgggactacaggcatgtcccaccaggcttggctagtttttttttttttcgagacattgtctcactgtgttacccaggctggtcttgaacttctgggctcaagccttggccttccaaagtgctaggattacaggcatgagccatcacacctggccttctttcttctttaaaaaacagttttattgaagtataactgacataataaactgcacatatttaaaatgtacctttgatgacatgggtgaaattaccaccataatgaagacaatgtaaatatgcatcactttcaaaagtttgagggtaaatttgactgtgctcagtttttgtctttggtgagatgcaattctactacccaagaaataaaatagcagtcacctggcctgtatagagccaggaagaaccattgtttttaagaggctgtaagtatgaggaaagtgaactcacagtagaaatggatctttcagtggctttcccctctcattttcctatttcaggaaggctttgtgatacctgatgaagggggcccacaggaggagcaagaagagtattaacagcctggaccagcagagcaacatcggaattcttcactccaaatcatgtgcttaactgtaaaatactcccttttgttatccttagaggactcactggtttcttttcataagcaaaaagtacctcttcttaaagtgcactttgcagacgtttcactccttttccaataagtttgagttaggagcttttaccttgtagcagagcagtattaacatctagttggttcacctggaaaacagagaggctgaccgtggggctcaccatgcggatgcgggtcacactgaatgctggagagatgttatgtaatatgctgaggtggcgacctcagtggagaaatgtaaagactgaattgaattttaagctaatgtgaaatcagagaatgttgtaataagtaaatgccttaagagtatttaaaatatgcttccacatttcaaaatataaaatgtaacatgacaagagattttgcgtttgacattgtgtctgggaaggaagggccagaccttggaacctttggaacctgctgtcaacaggtcttacagggctgcttgaaccctcataggcctaggctttggtctaaaaggaacatttaaaaagttgccctgtaaagttatttggtgtcattgaccaattgcatcccagctaaaaagcaagaggcatcgttgcctggataatagaggatgtgtttcagccctgagatgttacagttgaagagcttggttttcattgagcatttctctatttttccagttatccccgaaatttctatgtattatattttttggggaagtgaggtgtgcccagttttttaatctaacaactacttttggggacttgcccacatctctgggatttgaatggggattgtatcccattttactgtcttttaggtttacatttaccacgtttctcttctctgctccccttgcccactggggactcctctttggctccttgaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttaaaatacttcattccttaactctccctcatttgctttgcccacagcctattcagttcctttgtttggcaggattctgcaaaatgtgtctcacccactactgagattgttcagcccctgatgtatttgtattgatttgtttctggtggtagcttgtcctgaaatgtgtgtagaaagcaagtattttatgataaaaatgttgtgtagtgcatgctctgtgtggaattcagaggaaaacccagattcagtgattaacaatgccaaaaaatgcaagtaactagccattgttcaaatgacagtggtgctatttctcttttgtggccttttagacttttgttgccctaaaattccattttattgggaacccattttccacctggtctttcttgacagggtttttttctactttaaacagtttctaaataaaattctgtatttcaagagtatcatgtcttctgaaatttgtcttgccctgggtatatgctgttaggttcaagtgatgggaaaccagtgcttctttcttcagtgaggactgatcttttcacatcctttactgatttttcagatgtgcttatttcttcttcttcttcttttttttttttttttttttgagatggagtcttggtctgtcgcccaggctggagtgcagtggcatgatctcggctcactgcaacctctgcctcccaggttcaaacagttctctgcctcagcctcccaagtagctgggattataggcacccaccaccacgcccggctaatttttgtgtatttttagtagagatggggtttcaccatcttggccaggctgatcttgaactcctgacctcgtggtccacccacctcagcctcccaaagtgctgggattacaggcgtaagccaccgtgctcggtcagatgtgcttatttctaagctgacttcttttttcttcattcacattatattgcacagcctcctgctttttaaaattctcgttgctgtaagaggtttttcctctcggaagtccaaggcctggcctatctgctgtgaagccttttcagggcatttccttctgagaaatatagcaggacagtgcttggcagatgactgtggggagattttgtttttttttttttctgaaggtgtgattctttcttcctttcttttttgagacagggtctccctctgttgcccagtctggagtgcagtggcatgatcttggctcactgcagccttgccctcttgggttcaagcgatcctcccacctcagcctcgtgagtagtggggactacaggcatgcaccaccatgcccagctaaactttgtattttttgtagagatggggtccccttatgttgcccaggcttgtcttgaactcctgggctcaagtgatcctcccaccttgacctcctaaagtgctgggattacaggtgtgagccactgcacccagccctgaaagtatgtttcaaagtcagttaacatgatcttaatctataaaataatctaaaattgtcaccatttttttctcccttataaaattatatgctattagaaatgagttcaaaaggagacttgctgccattttctgtcagaaataaagttaaatgggcagaggtagtgtgttgtaggatatgtagagtcatggttatggatgctctataaacccaacctgatgatcttgacaagggttgcacccatagttaatggtatgatacctcccttaaagtgttaaataccttcagaaggaatttgacaccatatgtattggtcatctacaagaagataccttccaggagtgcaaggagtttgtgaagatactgttggctactgtcaattgagaagttaccttggtaaagagagaagccaaaactgtgggtatctgaccaagtgcattgacctggctcttgaatttgaagcacatacagtctttgctgcttggtttgcttggcaggttctgtgtttcatgaaggataggtaaacaaatgggttctctggctcaatttggatcattgttcatgctgatgattctcaaactgatgggcttcagaatcacatggggaacttgtttgacataatgtatttataaaaattcatcaccagagattctgagtttggaggttgaaaacctgcattttaatttgggccttatctacatgtctgcaattttaaataataattctggcaaggggaacatcagacttgagtcctcttgcaggtctctcctgctttgtgagttttgagctatttgacctctcttgttcttacatgcaagacagagatgatgattttggctgacgtgcctccctcactgggtacttgttgggattagaaggagctgatggaccaaaaaaaaacagcaccacaaagctaaaaagctctgtacagacaagaggcattatttatggcacaagttcttcagatctggtctgaaattctgtttatagattagaaaaagcttaggacagggc

SEQ ID NO: 12702 - DNA, 60572 bp, Human
tttccccaagaaaatgggcttagttggggtgctttggcaccaatagtcctgcggcggaatctgtgggagctagacagggagatttggaagagaatgctaggttgtgagctcttgcttttgagttgtttgaagagaatgctgcatctctggcatgtcaacaagcccagcagaatccagtaacgttcaccaagaaggcttgattagagctggttaggggatgatcaggatggttaggtgtgaagagcttacgctgattatggagggtatgggagtcacggggttggtacccagtgaggaaatttaccttagtagaaacatttgggatagtgtagaagagagaagagctagaggcgaggattcaggaaatagagaatgccagagtctcaattaacaggatggaaagctaaggagatgaaagacttataatagtagcatagtactaaaagacaaactatgtgtaaaggtattagaaatggggactgggactctgaggcagttaggccagagaaaagaagaaggaaaagatttgtcttcatttgattcaattacataagcatttctcagaatctgctatgtgtcacatgctgtggtggatgctgagggagctgatgaaaaagacagaattcctgcccaccagggtcacatagtctggagacacagacacgtaaacaaatgacgatagtgtaaggtgtgtgtaagaaaggaggaatgtacagggttggtacaaaggtgacctcaaggcatccatgggaatcagggctgagggaggaagagccagaagacatcagcacaaagagaaccaagatgctgaagtcacagggggaaagaacatactggagccccgggcagagcagtgctggacaaggacagcaagtgtggagaggaaagggagatccagaagaaccgaggagatccataacagcatgcttggaggaggaaattcgggaaaacgaatggacatgtcagagggagctagttatgaggaagtggactgcaaaccagatagtgagcaagatgaagaaatgaggtgtttatccttgcaatgggagagagacaataaggctgacaaaaactcaagtggtctgtggatagacgatttcgttagctcgatttaagggtaaagggcacactctctggtaggagatgaaaggggatgtttaaaacaggtagaaaaaaattgggccgggcgcggtgtctcacgcctgtaatcccaccactttgggaagccgaggcaggtggatcacctgaggttaggagttcgagaccagcctggccgacatgatgaaacccctgtctctactaataatacaaaaactttgccaggcattgtggcgcacgcctgtaatcccagctactcgggaggctgaggcaggagaattgcttgaacccaggaggcagaggttgcagtgagccaagatcgcgccagtgcactctagcctgggcgacaagagtgaaactccgtcccaaaaaaaaagaaaaaaaattgaatttgggaattagagaaaaagactgtgattggaacccacacaccaagagaggagataaaacccagccttagctcttccatgtcgctgaaagagaagaaaacgtctctttttccttttccgtagccataaaagatgaaaatccgtcatccagctactgaaatcaggtgcacacggttgttcctcctgtgatgagacagggcggagggattgttaccctgttgccagggaaaaaggaaggggctgttcccagttgctatggtgacgaggtaggcgcgttccctcggtaccgccgcacacgtctgaagcggtctcttctcctcgttgctacggcaacgcagtgggcctgttcctgtcgccccccgcctcccgccgcaatcgctaaggcaaggtggaggtaggggctgtcctcccgcggctcagttgccttggagacggcgggtgccctggccccgccccgctcggactgacagcggcggccgcatcgcgcctgcgcagtgccctcgtcccccgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactgtgagtccgggccgaggcgacggacgccgtggggctgagtcagcgggaggccagggcccgggctggggggaggggaacccggcatccaccgcccctgcctccccacccgcactcccgcatcccgaccgcgccttccccgcgccggtcaaccccctccatccctgtcgccgggttccctccggccttggcggcccggcctccccagccactccccctccccttccctcccctccccttccctccgtctctccgggtccaccttgaggctccttccccactagacgtggccaccgcacctctgccctgggctgatattttctccaaactacctcccgtccgcccttatcccttctccctcctcctcactcctcctaggcctgacatctcccggcctctctggatctccccagtgatgtgccagaaaaagagtgacaggagagcgaggggagacttgggggagggggaacatcgggccaggcccagcctgggggcctcgggtttcttccccacacgctcctgcctggctggtttggggaagcaggtctggacagttctcactggctgctcagagcttgcagggctttccgaatagatttggctgggaagggttcagccccatcgtgatcatctagcgtttaatgaacgcggctagtgcctggtggccttctagtgggctgagctactgcccggccggtgttgcggagcggggagtagaagtagtggagggaagggagaagaggttgcgtttgggagctccaagttcctgcgcttccggtgtggtgttgtgaataagcatcttgcggaactctttaaaatgcttttttttttttttaaatcgcactacaaccctggtataatgtgaggtttggaaaaaggcctgataccatccataggaagtgcttactgtttatatatgaaggggctgtggcaggacttgatcttggattcctgtaaattaactaattggatagtagtgagtttttaacataacgtgtgcagagttgagaggaaggagaaaaatcgaagcttctccatggtgtaggtgtgaggcctgtacactgtgcctcctccagctgtgtgtctttgtggggctgtcaccagataggggttctagcatatttggacaattccctgggttatgtttgctacccctccacctgcccatcttgcagtccctgttcttggaatagaagagggtcccaaacagttttctttttccagaagaactgagttgaagtcagagttagtgcccagagccagaaactcttaataaacatgtctcaacttgagggcccctaactactatatgacctcattgtcagcttcttttttatttggcttccaaatttcagtgtgcttttagaaagcacgtgtaaatataagccagatctaccgcacaagaggctttgggatttttactccagatggtaaaaggaacgcatggtccatttctaaaaatcatggtgaaggagccactcatttggagtttccggggttgcaaacaatgagaaataactatttcactctttactttgctcaatcatggcctattggcagcctcctcatagccactccctgcccccatgcccatcagattagtttacagtagccaagacggctgtcgccctagttttaaacatagagatgaagttcaggaaaactatagcccccatccagcagggcagtttcttctgtttcgaatgccagactggggtttggtgggatgcacctgcctgtggtgcagtgggaactgtggggcctgagagtggcattccttctgtgtggtcctgtgtcacatagctcaccaaaatacccgagcagggcaggagcagacagctgtactggagagctgctcctcctgggctgagtgtattttgggaatcagcgatattactggggtggagggttgtgaattaaggaggaagaaaatgtgtcaaggctagatagatcaggagggtgtaagtaaaatgttcctttccagtttgctatgggatagtacattttcagaggatcagagtagtttttatatggattaatttgcctttgaaatccataccagtgttttatgagataatgatggaatgccttttaaactgctactatgaggaaacaggactaatacttgtcttatacattgcctatccagctgttgctgaatgtaattgttaagatcaaggagagggacatgatttgaaccaagttagacctaaatctatgtaatggtattgaggttttgtaggactgtattcttgattctaagacacaccagcaatttaccaatagcttttaggtaaaataatctaatgctaccagatcaaaatatatatgctgattccaaggtgcatcctcattttagaaacattaaaaccctcgggaaatggcaagacttgagggagggatttgtgaatcttggaactgagaaagaatgctattgatagtattcctgtgtgatgatgccgtttctgacctaccgtcctgagagtgcatgcattgtgaagctgagtttcttctagtccttcctgcacgccagcacacattgtggggttgtatttgtaagatgactggctggagttaggcatagtaggaggctattgaacggaggaaagttcccatatgagaatccaacccagggtcttaatgtggtactctccagaaactgagccaactaactggcagcaaacgtcttatgagctattcctgaatttagccgagtaacatttgtcagaagccgaacagaaaatatagttttttttttttttttttgagacggagtctcgctctgtcgcccaggccggactgcggactgcagtggcgcaatctcggctcactgcaagctccgcttcccggggttcacgccattctcctgcctcagcctcccgagtagctgggactacaggcgcccgccaccgcgcccggctaattttttgtatttttagtagagacggggtttcaccttgttagccaggatggtctccatctcctgacctcatgatccacccgcctcggcctcccaaagtgctgggactacaggcgtgagccaccgcgcctggccagaaaatatagttttttaaaacagaatgcatctgccctgatttgcttacagatacatttgtaaaggtcccaaggcacatgtctccctcgcttaggatgttagcactggaggtgaccccagatggtatagtttaatgccctcatttctaaagttgacacaagacaccaagagttaaatgacttacctaaggtcacccaacccatgcagaacgtatgtaaaaacactttgtaaactgtgtacactaggcagatgaatgttggtggttattagtggctgagtcaggattagatctccagatttccagactagagttattcttcaacaccacattgcctcatccctcataatgttccaaagggttttaataaaaataatttagtagtccgtaattagccctgtaggcaagggcttgttttgtcatctgagatgctgcacagccaggcaaaattttgtgtcaaactgtctaactaaatatttattcttgccactttaaaaataatattttttatcacacattctgacttcaggaaggtctttctttttttaatttgcatcaactaacagaaaagcaaatgtgaagttgggtatttgaagtcttttctacttcttatctgtgagactgccgcattccagaaagcaaggtggagaggcagatggggctgagaggaggagcgtgcacattgggcagctgcgggcttatcttccacctctcagaatggaaccttttgtagtttctgggagccataaggacttctaaaccctctccttgggaagcgcggaggcagcctgacctctggaagcaggcagacttgagttcagatccccatccagccatctcctggctgtgtggccttgggtgagttatgttacctctgaatgccagtttcctcatttataaccctggaataataactatctgttttacagggttgttgtgaagattaaatgaaagggagtatgtagagtgcttgcttcataagaaatagcaatgattattttatattgactaaagcataaaatagcaaataatggtttcaaaattgtttcgtgatttaggtccatcttggactctcagttttgtagcccccatctctcagcacccctctcggtatttgacacgaacagagaaaaggtttgtaccgggaagacccggcacttgcattattatttcaactgccaaaaccggagtatatgaaatgtatctttgctccatgtattcagccaacctgaaagactggcaggacaggagcatttgactttaggaggcacagatgtggtgtgcttgggtgtgtggtgggggtggctagttctccagcagggaggccagtctggggagtggtcttcatttgaaatagaaaagctgctgagctcttgcttgtgagggacacacatgtggtctttattgacttcctcaactggtagaggtatagatttcatcggtgactttgctaaaatcagcttctgcatccgtgagatccagggggcaagggaaaggagctattcatcttaagagggaaaccttgccagtgagcagaggtaaagggaggtcattttggatggagagaattacagactggctcaaggcagaaactactgagtaattaaagaaccagggcaagctgttcaggtgcaagagcaaaagtgaatttaaattcctagataaatttcagtagggaaggaaatacccatgtatagacatctaaagattgaaaagaaacgcaataatgtttacctctgggaggtgggatttgggtgtggggaagggaaaaggagactcaaaggggaacttttactttatatgtttttgtatttgacttgttataagaagcatgtatgctttagtcatttaatgaagaccaaatagaatgggtagtgattgttgttcagtaaatacattttggtacaaaagaagcagctgcctttacttggagcctcccatgcctggggcaaatagggtttgacagcttcaagcaggcccaggcagtttgcaccaaatcaagctcttaagtgagggcaggaccctccaaagtggctgcttcccggtcagcccagggtacttaactgaccacctaccccatcaactcttcctagtcttttcactcccctcttgagaatagtcccctccatctgttgaccagctaaaataatcataattattctaataagctaattttcagctattgatgaaaatggcatctgactatatgaccttcatgaaaaattcctgcctcttagttaatgtcaagagggcttgaagtttaaagggacccaagctgaaatgctggcacactgtgtagctaagttctaggtcagacctggctggtacagcacatctttcacataatgactgattaactgcttctggtaggaattactggtaaactctgataaaatccttaaggattgttcagcttttaattttgtcgtaagttggccagctgtattttctagccagatgtcatgtttattatagaaagatgacacacctatcatttggacatgtgctttgggttgcttacccaggagttaggatgggttatgctgagtaattcacattccatcacccagtcttccctttggccaagagtacaatttcgtgtgacagttagccaagtttcgtgaagcatgctgtggccacggatggtttttcttgtgcacagagttgactggccaatactagcataagcctagatcttgcactcactagcaccatgccctaccagctttgctaaactgaccagatgttgttagtcaactttttagcataacgtcagtgttttaggctctggatgcttcatttgcctcaagtaaataaggacttgtcctatctaaaatgctttaactccatgcaaaatgattttttccctgaaactatttcctagatataggagatacataccacttgtgtgatacatttaaaataactgagcaagaagcatggcttcaaatctgccttgtagcttgactatatataaaaaagcttaaaaggatgtatatccttagaccagaaagtgccattctagcaatatttagaaaatcagaggtgtgtacagaaataattgtaaaagatttattaatgcaacattactagtaatatcaaacattgaaaacaaccaaaagtgccagcaactgaggattggtcaggctcgcccaaataaaatactgcatggcattaaaaacatttggagaagaatattaataccagaacttttaatatcagtgaaaaaagcaggatgaaaaatagtatgccaaggaaaaaaccatatttataaagaaaaacatgaaaaagatactagaagagcatgtgccaagtcataagtgattgagtaatgggattaaaaacgaatggctttccttagtgcttgttggtgttttctaagcttttctgcattaagcaactataacttaattatgacattttaaaaccagtgacttctagattccatgtagtagagcaatctttagagtcttctttgcctcttccttttactgtttacatgtatcggaaggttttagtaaaaccttgtataccacagggctctgttttgggtggccttcttttcccaggtgtcttttcagattctctgtattcccagttctccagtgttccaggggccttttttgagggttttgctcattttttggtgtggatgtgcacctgtctgaattgtctgtttcaaaagactctgcccaggcccactacagttgccttcctccctttgccctttgtcaccttccgttcagccatgagctcagaggccctttttccttccagggatagagagggttgggtgcccacctgtggccacccgatgggcagagccctatgtagacataggctaggccactccccctgtgccacaccaggtccatggagctgctgactgtgttggtagggcctggccgggcagctgtcctctggcctcatctttcccatccacacacacacactgtacattgcctagatggcccagtccagtggactgatacctgccttcaaccagtggtggagtctgcccagctctgagcactgagaaaggggcactttggcctcctcctgaggatccgggacttcgagttgaagaacatatggcctgtcacatagctcgaactgtgctgtgataaatgtttgctaagcaggatctgcctcttcctccaaatggtctggctacccaaatacttgtcctagatggggtggaggccttccctgctgctggaattattagtgagcaagtctttgggtatggctggctggagagactccaccactcggagagagtgattgtgggagaaacagtcatcttatcttgagggcattgtggtcctggtcaccttgtaatttatatggtgttctctgactggtaagaaatgaaatcttaactgcttctgagtcagcaagatcatagttgggtctaaggtgtgtgttgccatgtgaaaggggcaggtcttagaccactagatgaaattagatacctttcccatgtgaggagtgtttcacgcaggcttatctccagtggcataatgtgtgctgtgtagccaggcctttccgcagcaccagactcttggcagccagccaccctccacccccacccgcttccctgaaggttattgacacttacctgggactctgatttggtccttgatttgttctgattttagatgcttagagctcatagctgaaagctctcagtttaggcatcctattaacactcttaagtgacaggatcactgctaagtacagagatgtgttatgctggccccaaaatagcaaggtacagtgtcttgagacaacttgataagacttctattaccccaaaagtatagttcccaggtttacagattattcatataaatttgcatatcatcttcacaagacatgtaagcatgctctcagcacgtattcttcatcaagccctttctctgttttgtattgttagtcactatgggatataaaggaaatgagactcaacccttgtccatgaggaggctgtaatgtgtgtggaagacaagatggatatatggaatgattagtgcatatgacaatattgcatgtcagaaacacatctttggtgccttattctataagacacagtgtcagcccttaaggaattcagctaatattctggcaaaagagttggacacaaaactgtatgtcactgtaacatgaggggatggaaccttatcagctatgggaaagggtgctttggtaagccagaaggaagagtcaccctgagcctgtgagaaccagaaagacttcagagatgaagacacactggagctgggtgtgcaggttgatgtggagactcatcagaggacagctgaggaagagaggcaaaagaaatgaaaagaacagtgcattgggtgtcactggtactacagagtctaaattccaaaagggtgctgagaggaaaataatcattgtgaactggagtaatcagaaaagacttcagtctaggtgcaatggctcacgcctgtcataccaacactttgggaggccaaggggggaggatcacttgaggccaggagttcaagaccagcctcagcaacatagcgagaccccatctacaaaaattgtttttaaattagccgggcatggtggcatatacctatagtcccagctactagggaagccaaggcaggaggatggcttgagcccaggagtttgaggctgcagtgaactatgatcatgccattgcactccagcctgggtggcagagtaagggccaatctctattaaaaaaagacaagacttcacaaaggaagcagaacctgaccttgtctcaaggatgagcaggctgtgagttgacagaacaccagagagggcttttcaggaggcaaggtacagcatcagcaaaggaatggccgtgggaaggggtgtggtggggtttgtaggcagggcagccttaccagactgaggatgtgtgctggttttgagtttggagaatattggtgacattaaccagaaattaggaagtttgaagagacagtttggaaaggagttgctttttagacacagagagctaaaaacaacgtgactgtgggttgcaggacatccaagttgagtgatctcatagaaccggaagctgagggtcaggttgtggatggagctgtagagtgggagtcagcagcacagaggagggctggattccctcaaaggaatctctccagaggtcttgcatgcagagtacaaagaccagagccccaagtaataagctttgagaactgtccatagttaggaaaaaaggaacaagatggtgggaaattaggatgattcagcagcaagggaagagaaaatgtctggaagagagtttcagtgctgctgatttaactagatttaaggatttaactagaaggcagtcatgatgattgcttagggtatccattcagtaaaacactggagtggtttaaggggaaaattgacagagaaaaatagaagcaatggctggtcaccagagaatggcagcagggagggaaagaaagtagtaaccagaagaagcaatcgaatcaaatattttatttttgtaaaataattctattctttatcagcaaacatataaaattgtagtatgtggttcttaaaatatattttgtgtattaaaatgtgcttcatctgcagacttctctatattgacataatccatatatttgtaacttcacatatttcattcctttggtggtatcccatcatattgataccagtatgcttaacctcaatctgttgttgggcagttggagtattttgcaagtgtaaatatctctgatttgaacattactgtacaagtgacatttttttcttttgtggattatttattcatggtatattccataaagtgaattacagaggtgcaaagggtacgattttttaaataagctttttatacaacgttcttcatggtgatctaaccaactttcaattagagtaaaagtttggtattgacgaagaatcattttttataagaaggaggtctgagcatgtttaatggcagaagggaaaaggagttatccaaagaaaatagtacacagacaagagagaaataaagcaaaaaggaatgatctttaggatcccagggaaaggttcctttgaagagaagagggcatggctctttctacccctgacttttagggtgaagtccaggatagattactggggttcctcctaagaaaagacctttctttctttagtaaaatagagccaaggccacttgctgaggtgggggagggagagggttggtggggaattgagttcttgaaggtctgaattacccacagtgagaaataagtctgggcatatgagagatgaataaaggtcttattgtgaatgctgcattggacctatgaattcataatgggctgagtctttaaagtcctctggccagagaagcagcagtgagtggggacgggcaccaggaatgggtgttgcttggcatgttcagggcaaggtttctgaggagtcaaaacttaagatgcagtgaagtagctggccctaaggccggaggtagaggaagggccacaagttgaagacaggcgctggttgtcagccagaatgaggaggcagaggaattacaggggccagtgggaacggaaaacaggtttagaatatgagggatgagcagtaaggaggccactgacagaggaagattttcatattaaaatttggcagaggcttcttttacttttgttcatctttgtataatgtttacgtttctaacacagacgtgtaaccactaacatttcttaaaggaatatttgaaatctcaggagtcgagctgtgccttccgggtgtggctggattgctgagatggatgaaggagaaatgaagatggagctggatcatggagcctaccttgaaaaggtgctgggcctctaaggagcctccacgtgtcagccagtggcttctgtggtctcagcttgtcacaaaagagtggcacccagccagcagccctcctccacctacactccagtagtgttcaaaatccaaggaggcccatcttcccaggcttgacagtcgactcttagatgtgctgttgcgtgagtctggtggtttccaactctctgagcagatccctactgagccatgcctctctggcctctgtgagtgaaggttcttcctccagacagatagagtcccttgctaggaatgcagttttgtgagtggagcttgggttctactcattttgtgagggttccagccctcatctcctccacaaggtgctttgtgcagtgtacaaagtgtacaactgtttataacagccctgtttctctcttgcctattatgaaacttggcctaaagtcctttcctcctctgacccctctctttctcatgtcctcctagatcattcactttgactctgaccctgtctaacaccctgggttgtggtctttattccacctgctggattcacattactttcatgctgcacaactgaagccatttacacagctcaccatgcaaagcagccacaggggctgatagcaggggacttaactaggtgggaatatgtggaaagtcaggtgcaggagtcaacctgtggaaacggaaaagctagggctgctttctttccagggccttacactgacattaccttgcctggacattttgtagtcccgtttcatgaaagccaggacctaagcagaagtatggctccctgccagtccctaccaggaaggaacaaacagcttgcagtacaggcctcaagccaggtggggcaggagcaaaagtgcattgtgttgcctgtggaattaaatggactctctgtaaacacagcctcctgccactgttcttttctctttccacctagtcagcctacctgagaataattagcccttggcctataattaggtagaatgattattttactactgtttatccatttcactagataactagcttcatgaggcagggaccatgtgagacctagcagtatctggggctcaacaaataattgcagaatgaatggatttctaaggcatatttgttgctgtccatccttaatgctatgaaatggtacctaggagtgagtatatagtgaccatagtaactaacgaaaaagccctcacatttgtccctaatggacaagagtgccagcaaaagcaatgttttggacttctcaaagtcaaaactcagagactctcaagatttggagtagcattgaaaattaggaaggcccaacccagctcctgtcagagggaaatggaaagacatgagaggaagatcccactaccgctaccactatcctgttcaataaagcctcacttgggcagagttaagcttccagtaagacagagacagagatagacattcagagacggaacccaccacataatctgtgcttgcataaattaaaaatcaaatgtgtagtggagcctttccgaagggtgcatttcccactctcctaggtatggatgactagatcttccaggagcccactgggttccaagcttaggctccagaactccttttctccatgcagcacccccaaccctgcctagcaactctccccaagtactgctctgcttcccctgtggcttctcagacatgcaagcctctgattgaacttctcctggcctggaaggcttgatttttcaggacccagcaaggcactgctctggcctcgtggctgtcccaggatgtgttaggaggtcataacacaagaggactcatgcctctgaggccctctcgaagggtattgagaactcagtgataatgcaggccctgtcaagggtacttaagaagatcccatttgtacctttatctttaaaattcatcatttgaactcagatggttctcccagtatctagctgttctgtggaaattatgttgcttgccacctagagcagatgacctctttgggaggcattaggaaataactagttgttttaaagctcccagagctgttagctaaaagatcttatatattcctttcagcttggttttctggaattgacagccttttctaattccaaagaggctgcctgtcagcttccttaagaagcttcccaagatacccattgaaggcccaaggcaagcaaagagaaacaactgagaagcctttgactccaggtgtccctgggtagcagctgcccctcaccccgtcccttccccttgttggggatgtgaggtttggaaagaacttcctcagatgactgccaagtccacagttattcctctgaagaacactcgagaatttttgcatcacttgtctcaccctcaccctaataatgtttgtgtccatgcattagctttcccatgaatttaaatatatttatatattattctcaaaatcattacgaccttgcccatattttcagagaaacttgtaagagtgttatgtgtttaatgcctttagtgtatagtcataatcaaaaaccccttgctggatgacaaatataattcaaaattgcttttagaattaaatatttatgaattaaaacattgcagaaatgcacaatgcaaaaagtagaagtcctccataactctgtcccccaaagagaatcactgccactattttgttgaatattccaacttttttctacacacatactaacatattattttttttaaacatggaatctaactatttttcatttgtagaaaaattggaaaagatagtaaagagtaagtgagaaaattagaactacttttaattctaccactcagacagcagtggcaccagggggtggtttgggtgggctttagcactgccctcttcctgaaagctgccccaaggaaacatatgctccaaatacaaatgtgtccttcttctgcatatgcagcttcaagactttcttctagctccctcttcccaccagattaccaaccctaagcccctccatacagaaagctcgttgccaccattgcttttcactgtggtgaacatattactccattttcttccagtcgcacataaatcttttaactaaggatcatattcatttatagtttttacagtagtcatatcaagttccagtgtaaattacatgcagaacgcacttcccattgccccaggtaacattagttttgattttgtccccagtagcactatttccaagacatgtcagggaactgttttgaactcacccctaggagatgctttcactgtgccagtggagagctgaaacataggggcaatgacttgtttaagatcaaaatgaaactctgccttagctaaacttacccacaggtgtctaaatgcccaagatcattggctgaactgcctgagtttactgcagcatttgggaaggagtagaagggacatccctaggtcctgaattcttcctttttctttagcctcaatatcatttgcttagtaccgtttaggtagatggtgcttcggccctgagagagattgttaagacatgtgctgttgaaactcttcttcccttttggggaaggatgttggcctttcctcaagtcaggcagaatcctacctgggccatcttcccagctcctgagataattcacaatattctcattccaaattctgttctgtgcatctcatttctccatgtgcaaagacttagccagagagcattctggcagcatagatctgagttggtgaagctattcctatagcagtaatgtggcagaagcaggccctggagaccctccccacttgctcaggtgtggcccagaccagtgctgtaccatactgccatggccacagggcaaccaccataactcagagcaacccctggagaatgagagagcagcctaggaagtcccagtgagaggagacctaatcagccaggtattcatttcttactgctgcctaacaaattactgtgagagttctaatcccccagaactggtaaatattcctttataggacaaaagaataggtattaccttatatggcaataagtgttaattaagttaaggatcttgagagagaggtttatcctggattatctgggtgggccctaaatgcaatcatatgtatctttataagcaggaggacagaggggtgttgagagagaagagacagtgtggccacagaagcagagattggagtgacctgaagccaccagaagctggaagagaggcagggagcagattcccccaagagccttcagagggagggcagccctaccgatgctgtgatgctggacttctggcctccagaccagtgagagaatgacctttgttgttttcagccacccagtttgtggtcatttgtcacagtaggcacaggaaactaatccagtgtgccaaaatcaaggtgttggcaaggctgtgtttcttctggagcctccaggagaaaatccgcgtctttgcctcctccatcctctaaaggctgcccacattcactggctcctggcagcgcatcactctgcttccatcatcactgttctctgactgacccttctgcttccccttataaggaccctggtgattacactgggcccactcagataatccaggataatcttcccatcacagaaaccttaatcacatctgcaaagtcccttttgccatttaagatgacatatttatatgttccagggattaggacacggacatctttgagaacctaccatagtctgtaagcctaaatggtatgggtatgttcaaattagatgctactccctgaatcttgagaaaagcagtatcaaaggaaacacttctttatacagaagtggtatccatggaatgtattacctgcacaggttctctcaggcagaaaacatggaaagctacgtcagctgcaacagaaagatgggggtatgaatgtgagctaggcaagatgaggttctccctgtaagttttcgaggtgagagcgtgggggagggtcttctacagcactcacctttggtccttctcaggcagactaagctggatgggcctttggtttgggccagtaagggtattccgtgcagccatcaatcatagcactggtgcctgtggagacaccggccactggagaagatccagaggatgaatcacagcagtagacatggtatggggattagaggtaatggggcatgcttgtttgaatggagagtgagagggctgtgggagatgctatggaagatggaaatggtgcttgtggagtgttggttggagggagagtgggaagctgaggagccaccgtgtgaaagagtttccacctagaggtaagaactcaggagggagtgccccggtaatagctacccttgaagtcagacggaattacttgaagcggtttggcttcacatcaagaccatcaaaagccaagttcccattctgctcctgcctatctctctagctctggaaaaaatgatttcttcctcagaagtaaataaaatttcctccttgtatatcagtgtaatgtgggaataaaaaaataaaaaatttcctccttgaagaggatgaaaaagcattaattattaatgtttattttcatatttacagatgaaagacatgctgagttcaaagaggtagagttgcgactgaggaagagaattaactctcagcattaaaattatccactagaaaatatttatgcctgttttgaaaagtctggctgggcgcggtggctcacgcttttaatcccagcactttgggaggctgaggcaggtggatcacctgaggtcaggagttcaagaccagcctggccaacatagtgaaaccctgtttctactaaaaatacaaaaaaatagctgggcatggtggcaggcacctgtaatcccagctactcgggaggctgagacaggagaattgcttgaacctgggaggcggaggttgcagtgagccgagatcgcgccattgcactccagcctgggaaacaagagcaaaattccatctcaaaaaacaaaaaaagaaagaaagaaaaagtttctaggggttgaatacaaagttggagaatttcaaaaagagatctgacaatcaataaagggatcagagaagaatcttattaggacagaaatgtttgtgttcctaaccacccagactcatttctaggacaaggcattagacaaaggtgtcagcaagcagccacctcctacatgcttgtgaaacactatgagaaattatggtgcatgcctcggaaacttgccagataattaatggcttaattctgcttcagctcttcttttcataacacaaaggtctgagactccaattaatgaatttcactttaaaaagaagtttgttgaatacttgctctagtttaaagcatgaagttcaaggtaggggacacaaaaagaacccattctcctggggccacctctctagacaacactagctcctaagcaggcgggcctgctggaggccaggttctaactgccagagccattgctacatggtgtgtcccttggcccactgtgagcagccacagcaaagtgataccattgtcttcatgggaccagcatcctgacctgctagaaggggaggctcctccctgacagtttttaaatacaaggacattccagcatctcattattctgtgatggtgtgaggtaatatctgtcctagtctctagcttgttttttttcaacttgtatatcagagcgtcaagaacactgcatacatttagctgcttttaaaaatgttggcagaagaaaccagttagctaagtggtcattaatagctgcaactcatcattgaaatttttcagcaaatttttttatatttgttctgcaagttgttttatctcatcacaacattctggaatccaaccagaaaggagactgaagtttctggagatgagggaaaactgcaatgtaaaactcatgctttgccctgactcagcttaatagtcagtccactgactgattaacagtgacaagaacagtgctggtaaatggggaaatcgtgtgtgtgttctctagagcggggttctcaagtgtagtcctgctgctgactcaccaggaaagccagcgaaaaatgcagactctgaagccccagcccacaactgtccctctctgagggtggcccaaggaatctgcattagtaataggccagtcacctatgtgtaccctaagttttgggaacctcttccctagagggggtttcctccttgaggtatgtggagttgatcttggcttgaaaacctttacccaaagccaaaagtggcccctgacactccttggcagaaaaactctcctgcttctctctttgtatccccttggacgcagagaagagttgtgctccagctcagcacctctgtgtgtggtgaagtcccagtttattattcattcttgctgcccgacaggtagacagcatcaccacctcagctttttcataatagccacgtaattccagcaccaatgtatcccacattgataaagaagccaagccttggaatgccaccatttcacctttcactgtgtgatggcattctgaagtttttcttggcactcgaagaagaaaaggctatgtagaatttctgatggctgttttgcagaacatccagaaacacccgctaggctccaaagccctaggcagtccctgtttagttgtggtcagggaaagaaatgactcgtctctgcatgagctgggtgctgtgcaggatgctttccatacactgcctcgattaataagaaagtgatccggagtccgtgcaatgcaagggaaaggacaataacagcagaaactgaatgaaaggcaggcttgaattctgttctgagctgtggtgtgactcatcagggtaggaaagtcggttccccagtgcctctatgtatccttctgtaaaatgaggttattgctgttcccatcgcccaatcatcaggtcagagttgggaatactttgaacttcccagatgaaaggtgatataaaactacaaagtgaagagctggtgtagaggagggtgctacaaaactaaaactgagatggctaagtgacagcaaaatctaaggatgtcaggatgctccactctgctgccaggagactctccggacttcgtttgccttgcttgtcttatgaaggatggtgtgaatactcactatcacataaggaggggcagcctagtgtggtggttaagagaaaagactttggggtcactgacctgttgaatcagaatattgagttaggagatggagaagctgcagttttaagaaatttccagctgtgtgtggtagctcaggcctgtaatcctagcactttgagaagccgaggtgggacgattacttgaggccaggagctcaagacaagcctagacaacatagtgagaccctgtctctacaaaaaatcttaaaattatctgggtacagtggtgcgtgcctgaagtcccagctacttggggagctgaggcgggaggaacgctggagcccaggagtgtgaggctgcagtgagcctgaaccattgccctccagcctgggcgacaaagcaagactgtcttgaaaacaaacaaaaaattcccaagtgattttgatgcagaccaaagtttgaagaacagtgtagctcccctggactcctgatggttcccaaggaagctgtgtatttccacaccccctcctatgcgccccatgctctccccgctccctgagccgctttccactcagtccttcctatgcatgcatcagaagcatcatcttttgggtttgcttccactaagtgaactcccactcttccttcaaaactaggttacacatcacttcttgcccaaaacttttcctgaacctttgcagaggaatgaatccttctcagataccaaagaataccatgcaaccatcaaagagaatgagggatggaaaactaaccatatttttagaggagaaaaaaaaactcacaatatttctattttgattcagtttttcttaaatgactgtacaaataggtatatatagtttgaatatgtatatagaaaggtctgaggaatatacatacctggtaacaggaaacttttaaattttatgcacctctgtgttttttaaatctacatactatttttataattttttgaatttaataacaattagagtaattaccaagagagtaattgcttaaataattacagggaagaatcaactgctgttatagctctagtatatcatgttatggttgcatgtgtcttcctgcactgttcagctgtgagctcctgaatggcaaggccttcaggctattctgcctgtcaccagtgcccagcatttccctgacactcagtgggtgcgcaccacgtacttactgaacttaagagatccacggccgggcagtctcatgcctgtaatcccagcactttgggaggccgaggcgggcggatcacgaggtctgcagattgagaccatcctggctaacatggtgaaaccccgtctctactaaaaatacaaaaaaattagccaggcgtggtggtgggcgcctgtagtcccagctgctctggaggctgaggcaggagaatggtgtgaaccgggaaggcagagcttgcagtgagccgagttcgtgccactgcactccagcctgggcgacagagtgagactccatcccaaaaaaaaagagatccaaacagattgtagggaagcttagtcaatcagtcccaggggaggtcgggtctgccactgaggtacagcctgtggtcagttggtatgtctggtcctagtggaaagacaatagcaggaaggaagtgatagtggtggctggaccaatactgcctacagcctcaccacaaaagaaacagtttggtggtggtgatagggagaagaggactttgttggtgacaattggctacaaatggtctgtgggtcactgccgcttgctttctcaaatccctactccagttctatcagctgtgtctgcctgccccgaggtagtccctactctttttctaaacaatagaattccacattcattttatagagccccacataaataaaagaaattggcctattttcacacagtttatctcctttctatttccatcccttcagaatcctgtaatcatgagattgcctaaatggtctctctggaaggccctggcaacgtctaggcacgcatcctgtcttgcatttgtagatcagattctcagactccaaattgggccagatgtaaatgggtaacaactgtctgtgttctctctatcccactaaaagcatcgggcattcctcctctccttctcttattgaaataacttgcgtaaatcatgctagactttgcaccttgacctccttaggccacacgtggaaattgattccctgcctttcaccaccaccaccacacactcatatactttgtgccagattcctaagagagattgaatgtgtataattttttaatctcatgattttggaaaatcagaaactgttactactccataactaagggagaagaataaaagaggtatgttcatatttattatatttatatctaagtgctatagcaataccttttgacaaaaatataattttaaagtcacattttaggagaagcgtagtactcattctcactgactaatgttaccagataatttttttttttttttgagatggagtttcgctcttgttgcccaggctggagtgcagtggtacgatctcatctcactgcagcctccacctccctggttcaagcgattctcctgcctcagcctcccaagtagctgggtttacaggcatgcaccaccacgcctggctaattttgtaattttagtagagatggggtttctccacattgatcaggctggtcttgaactcccgacgtcaggtgatccacccgcctcagcctcccaaagtgctgggattacaggcatgaaccactgcacccggcccagataattttttttttttttttaaatcctgacctatactaagagtttggaatggatatttgaggggaggagaagacaggtcactcagcaaacatgaagcacctacttcagccatgctttggaatttaaaaatgacaaatgtaagatactgcctcatccctgcccttgaattcatgttatagttttaacacaccccactgcaatcatgaaatgtggtatacattccataaaactagaatcaaataggatcaattgcatcttactcattgatatccttgtgaagactgtgtaggccagaagtgagaagatgatttgaaacccttctgtttcctacatggagtgttgattctgtataatgtgttgcttctctcctgagaaatccagtgttctgttttatttcctattgcacatgttgtacttccatgccctttttatattctgctactttccctagtttcagtttagtcatagggattgtatagctcccacttttcctttctctggaaataccatgcatgttttaactggaagaccctgatgaggtaaaatattaggacgttattagccaggcgcagtggctcacccctgtaatcccagcactttggaagccaaggtgggcaggtcacctgaggtcaggagtttgagactagcctggccaacatgatgaaaccccatctctactaaaaatacaaaaacttagccgggagtggtggtgcacacctgtaatccctgctactcgggaggctgaggcaggagagttgcttgaacccaggaggtggagattgcagtaagccgagattgcgccactgtactccagcctgggcaacaagagtggaactcatctcaagaaaaataaaaaaaattaggacattattaaaataaaaccagaaactggtttgttaaagctcctttcttaaccatctgttctatcatcagtcacttcaggctgtttggtgtcaaaattacagagtcccccaccatattacaccagtttctctacttagagctaagtccttctccaggtcacagaaagaagttgttccagggatagaaaaaattcctgttgagggaaagttctggggaggtcgggaggatgtgtagctcctgcctgatgtccctaacacttcaggtggtgactaaactcttggtatggatgtgactccctccccatgagattgccaggttgaagaccagctgaggagtcatctgcccccttctcagccttaccaactcgatttttgctggatttaggaaataggacagttctggttctttatcctactactgtaggccctacttggccatgaccattgattgtgtccaaaagttcatgcctggcaggaaagcaagaactcatgatggatgtcttgagaaccatgcttccttgagtaggagatggcgctctccccccagacagagactaattgagaagactgacattaaggaatgctaccagaataccccagaatttgacttgagccctaatctttgtgtgtgggagctgtccaacatttcagcatacttttgcatttgcctactttgaaagaaacatgataataatctggctgtcttgactgttttactgtgtgccatgttctgaggaaactgacacaattcaggatctagtctctcaggtattttgatctgataacttaattatcagcttttcttgaggtcaccaagccctgagaaaactgacttacatttatttgcttaggcacatttgtaccagaaagtcaatttaataaatatacttcttccctgtatcatggtggcttgaaaatcagaaaggtaatcagagcttgatttataagcatgaaatcagagcaaatacagttggaagttaagaaattatgtgttatccacaccatggttcaagcttgattaattctcctctctctaccagaggagacatcattcatcctagtgaccagaataccaattccagctaagcagagtggtccattggacagtgttacagttgcactaacatagttttcctttctaactatctttttctctagattccataataagccatcccctttttataattgccattacaatcagcttctacatcatgacatcgttacagtttgccaagtttgtagcttattttgcactgataaattttaagtaagtcctgctctgtgacatctaggaagacattgtagttttatttacaatatctccaaatcactctatttctcctgataggtaatcctgtctataacatgtagatacttattaactcattagcagggattggcagacattttcctttcttcttcttcttcttctttttttttttttttttttaagaaatgagtgatgtcttactctgtctatcacccaggctggagtgcagcagcaggatcatggctcactgcaaccttgaactcttgggctcaagtgatcttcctgcctcagcctcccgagtacctaggactacaggcacaagccaccatgcccagctaattttgttgttgttgttgctcaagacggaatctcactatgttgcccaagatggcagacattttttgtaagggccagatagtaaatattgtatgctttgctggccatattgtctcaagtcaaaactactctactctgctgttgtaaagtgaaagcagctatagacactaggtaaatgaatgggtgtggttgtgttccagtaaaacatcttgaccaaaagggaggctctagctcataatttgccagcccctgcttattagtcataatcacagaggggactctattctttcctggttttgctgcagtcctattttgtcctagatattaataggttgtttaaatcttcaaaagtagtttccactctcccctaaaagaactcagaatcctcagagaaatgccttgcttcaagaccgaggcagggaaactgcaagttgatcctggaacaaattattcttctagaaagtaaggaacttaccaaagaatgatgggatgtgtcaacaagactcaagagccagctgtaaggggctcccactgtggccaccaatactgggacactatgaacatcaaaataaatgataataatgtattataaccctttgaataaaataatcatctatgagtttatactggcctaaataaataaaagaaaaaataaatggaggaggaagggatagcttttcctttatgatggagttaaaagttaagaacagttcttaagtaggttggaggccaaatcagaatggggactttttcaaatacctgagggtctttctaagagaggtgtgtgtgtgtgtgtgtgtgtgtgtgtgtgtgtgtgtgtgtgtgtgtgtgtgtatgtgtgtgtgttttggaaaagctccccacaagatactaatgggccttttctgtttggggactactgatattccggccacagaagacagtggaaagatagcagagggaagtatgtcttcagcttgcttggcccattcatatctgcctatcgcctctattccttgttatcctcatcaatctatttggccatcttggaacctggtgtgagtccaaaaggaggagctcctgcttctggggtttgttcttgggtacccatagaaacagatgagacattagaagataggaattttattttattttattttattttattttattttattttattttatttatttttgaaacaaggtcttactctgttgcccgggctggagtacagtggtgagatcatagctcactgcagcctggatctcccgggctccagcttgatcctccccactcagcctcccgaataactgggaatacaggtgtgcaccaccttgccccactaatcttttttatttttagtagagatgaaggcctcactatgttgcccacactggtcttgaattcctgggctcaagcgatattcctgcctcatctcccaaagtgctgggattacaggtgtgagccatcacacccagccaacaggagttttcttaactagcagagactaaccatacaaggtttccttgttaaacccttcaccagggccgggcgcggtggtttaagcctgtaatcccatcactttgggaggctgaggcgggcagatcatgaggtcaggagatcgagaccacagtgaaaccccgtctctactaaaaatacaaaaaattagccgggcgccgtggtgggcgcctgtagtcccagctactcgggaggctgaggcaggagaatggcgtgaacctgagaatggcgtgaacctgggaggcggagcttgcagtgggccaagatcacacctctgcattccaacctgggcgacagagcgagactccatcccaaaataaatagataaataaataaataaataaaaataaacccttcacctgaggaacagaaaaatacctggagggaaagtatctagtgaagaaacggctctcactttccaggggatcttcaagagagaaaagacaagcccattagcagagaaattaaagtcaagttgtgaagtaagcatttaaaatatttttattctattttgaactagtgtagatatctggagaccaaagttgtaaaatacatgatatgtgatccctgacttcaaggcacttatctttttgggaagatatttgaaaaaaaaattaaatggcaatagtagaaattagcagtccccaacctttttggcaccaaggttttgtggaagacagtttttcccatggatggggtagagggtgggggttggtttcagaatgaaatttccacctcagatcatcaggcattacttagatcaagcttgtccaatccgcagcccatgggtcgcatgcagcccaggacagctttgaatgtggcccaacacaaatttgtaaactttcttaaaacatggagtttttttgtgatttttttttttagctcatgagctgtcctttgtgttagcgtatgttatgtgtggcccaagacaattcttcttcccgtgtgacccagggaagcccaaagattggacagccctgagttagatcctcatacagaacacgcagcctagattcctcaaatgcacagttcacaatagggtttgcgcttctgtgaggatctggtgccgccgctgatctgacaggaggtggagctcaggcgggaatgctcgctgttgctgtgcagcctggttcctaacattccacggacccgtactagtccacagcctgggggttgggaatccctggtagaaaggatagtttggtaatccctggtagaaaggatagtttggtaacttaaatgttgtgtagcagggtacatatatgcttaatcctcaagtgaattatgtaaactcaatattcactaaatgtagaggagtaaggaattgctgaaggctagagaggtcaacgaagacagaataatagaattgttgcatctattagaagggaccttaagaagtcatctaaacataaaatctcagctagtccagccttcagtctggttcttgaccccgatagggcatgcccacagggtgtcatcagcttgaagacctgccatggtgggacctcaccctttcctggggtagacatgctgcctttaaccatgttaaagctgtcagttaactgctttaactgaagcagtactgggaatgtttgtcttcagtgggtcaacatctgtttttctgtatcttcaacactttggtcacagttttacaaacgctgtggtcacagaaaataagtgtaatccctattcttcctctgggcccttaagtcattaaaggcagttctcatgtcatgctgagtttttcttctgtctctaagctaaccccttagtttctccaccaggtccttggctgaccgagattggagcatatccactccactcactgtcatggtctttctctttaaacaggcctgcttgtgaatgttattctaaaagtttgctgcacagaactgaagtcagtattacaggtgtcatctgacaagcccagaggggaggaatattatcactttcctcattctagaagaaggactttataaccagatatctagtttcaaatcagttctgttctcactggctgtgttaccttgagcatgttacctaagctctctgagcctcagttcagttctgctaatatctgagaacattctatgtgctggacaccatgccatacaatagggctgaaaaaaatcccagccctggggaagctcctagtgacgtggaagaaatagacatacttctgtgttagaagtatctccacacagtattacagaagtacccagaaggctaggctaacccagcccagaggaacaggctgggagtcaggaaaaactttccaggggagttgacactggagagagtacatgccagtgtaaaatccttatgtcttttgcacacagttttgcaaaccttatatcttctgccaaatatcttccatttgttttttaagatacaaatgcagaacctagtatgtgtttatttggagtggtttagcttcttcctatagcctgtcacagcactttggaatcctgattctgtcagctagtgctcacagaaatggtgggacatgagcttggccttgaaaggaggagagcattccagtacaagccaaggcggggagggattcagtattagggagactggcaggaggaagaacaacagtctgactgaagtgaggggcttggggttggagacatcagagaaagggtttggggaagaaggaagtggaattgatcctacagatgtttggtcttgatcctacagaatagagatatagagagccattggtgcttaggggaagggggtaactaaagcagtgtttttggaaagtttgtcttgcaatgagtagcaggaaaagttgaaagaatagggaccagaggcaggaatactatccagtcacaaaatggcaacaacctggacaaggatgatgtcagtgagaatggaagggacaagatgaatgagaaaaatcaatgacttgatgacaagttggccaaagcaagagaggcaggattagggtccaactacatgcacttttttcttctttctttccttctttctttttttttttttttttttttttttttgagatggagtttcgctgttgtcacccaggctggagtgcagtgcagtggtgtgatctcggctcactgcaacctcctcctcctgggttcaagcgattctcctgcctcagcctcctgagtagctgggattacaggcatgtgccaccacacccagctaattttgtatttttagtagagacgggtttctccatgttggtcaggctggtctcgaactcctgacctcagatgttccacctgccttggcctcccaaagtgctgggattacaggcgtgagctactgtgcccagcccaactacatgcacttttaatgtgactgacatctcatagatttttttttggcagatttttttaaccattttagtggataatacaaatttgaaatacaaattagttctaatattttaccataaaacatttcattttttccacattatcattattaaggtttccatttcaattctgaatatagttctcaatattttacaactgcagtaaggaagaaaaaatattgttttcaaactacttatctttctaccaattctcagttgttggttcttaaaaaatgacttcacaaaaatttttaagatgctaataacaaatttccacttaaatatatggatggctgattttacaaataaatgtacgggtttgtgttactattatgctctccctagataacaaaacaataaaagaaattttagtaatatcaagtaagtactgaccaggtgagtactgtgagacagtgtcatgaaaaggttcttaggggttgaaagacatggtttctgctcagaggactcaccgcggagcaaaggagagagacccgtggacagataagtacaaggcaggctcctgtgagaaatgacagaggtatgaggctgtggaggcccagaatgttctccattatgacccgatgaggagggaggagggaagtggaaagaggaacaagggtagaagagaaaggagaaaagtgaaagacttaaaaacaaggagggaaaagaatgaagaagaaagagttacaaggaaaataacttgccattttttacacctaataatgtatgaagtactttcagattggttatttcatttgattctgccaagaaggcaagagatgagagacaggaggaggaggagggaagcaaggcccatgaccaggagaaggagctgcaccacaaagagctcagagcccctctggcctcctaggccggtgcagctgccggtgtccgctggtgaaggtggacctcagtggccctagttagaagccagtgggaccttgtaaaaccagggctccagctgggaagtctgaacctcctggacagaaagcaacagaagccttaaagtagttatcttggcaactattgtcaaggactcattgctgcctgaccacaagatttatccaattatttatctaccttgttttattttttaatatttttttctcatcacgaaagtaagacatattcgctgtagaaaattttgaaaattcagataaacccaaatatgaaaataaaatcccatataaccgtaccatcagacagaaccacaattataattttagaatatacttcacatttttcttcaacaactgttggtatatttttgttctgtaatacaatcatacattgcttaatgatgggatacattccgagaaatgtgtcttgtgattttgccattgtgcaaacatcatagagtgtactcacccaaacctagatggtattgcctactacatacctagactgtatggcatagcctattgctcctaggctacaaacttgtacagcatgtgactgcactggatactgtaggcaattggaacataatggttagtattcgggtatctaaatatatggtctgggtatggtggctcatgcctgtaatcccagcactttaggaggttgaggcggcaggatcacttgagtccaggagttagagacagcagtgagccatgattgtaccactgaactccagtgtgggtgagacagagtgagatcccatcattcatagatagatagatagatagataactgatagataggcatataattgatagataggtacgtagatctaaacatagaaagggtacggtgaactatgattgcaccactgcactccagcctaggaaacaaatcaagaccccttcattaattcattcattcactcataaataaataaatgcatatatacacacatacgtacatacatgtatacatacatacattaaacagaaagggtacagtaaaaatacagcataatcttatggaaccactgtcgtacatgcagtctgttgttgatgtaaacattgtgatgcggtgcgtgactgtgttttcccccggcttcatggactgtaaacatctttccatgtgttttatcaattgggattgtgttttgaaacaagtaacagcaaaccctgtcaacagtggcttgaacaaataatggggtattttgctcgtgaggcaggagtctgaaagtaggaggtctaggctagtggaacagctcaaggacgttgccaaggacactcctgctgtcttaggcggctgtgttgctttacggtctcaaggtggctcttaactctcagggaggctgagaaagcaggcattttgtgttactggcctctctattggagacaggtaaggaagaagggtgttgggatgggagctgagtcacccagccagcagtgccagcatcattacatattctagaacatccctcttttcagagtggcattgtttggatgtgtcacaatttatttaacaattcattgttggacatttcggtggtttccagtttttcattattgtaaacatgctaatatctaaagttttacacatatctataattagtgattcagtataaaattcctagaagtggaattaaggtcaaagagtatataaaatctaaaggcttttaatcttttttttttttttaaccaaactgctctccaaaatggctgtactaaactatattctcaccaatcatgtttaaaagaacccatttccctgtaccctcaaaaccaggttttttgttctgtcattaagctgttataccatgcccattagtgtgggtttaactttgtattagccctgaccagactctgaactgcccatcttggaacccagagcagttgcacccttctgtgttgcacctgggggtgtgggtctgcaggctgtcctgtatgtccaggcaggctggtggggcccttgtgctgatgggcactgcagaggacccatgatgtttcttgtgagcatgcacctcgctcatctattcttgttttgaaagtcctttctgccactgtgaagtcatcatttgtcccacctgagtcctaattcaaggccatcctggcttgtcttagattgagatgcacctgggaactggcctctttcgatacagtgcaccccacatcctcactcgttgctcttactggcctacctcaggtataatggccttacaggtctgtgtcatcatctgtaacagagaaggctgagaagatggtgtcagtagattctggggacattttaatctattaagctgcttttgagacgtactacagtttcctgaggaggtggccaaaagagtgagtgatccctatgcatcaacactctatgaagtaattactaactggtgagcagttagccactacgtacggcccttctcatccagtgaggagtcagccatgggtgagacagaaggagtccctgaactgcaatcctctggccagattctctatatgcacacagtggtgtttcaatattcatgagtgtaggcagatagtcacgagtaaacaaatgagcaatgaatccaaatgagcaagacaggctgaatgcagaacacaggccaaagccccagaccacatcactacccctctaaaatcagaaaaaaaaatcagaattctgattccaggagggaaatgataaggactctatttcaatgctcccttcaggaccttaccctgatctcttgagaggtgacaccctcaagagagaagcaccatcttagggaatcagctgtctacgagcttttctcatagccatggctttacgcttctctgtcagttaccatcaccacttggaaagggaaactacaatttatgaagcatctgttatcgatccagctaatgctgggaaggtgatacctgaccagtcactactgtcaaacttccagctcacggcttctacccagatccctcactttccccatgagagggtgctgctcagtatggcatccacaaaatcagtccctcacacaacttacttatttaacaatatcacagtccccatccccttctccttacctaatttcattgttaccggccccatgtcaaagattatttaaaactccccggctgtcaaaattccattaacaacctctgacctataaccgtcactcactgaattgacacgtgtgaggttctgtgcggatgctccacttgagttagcttgaaccttcacaacagtccggcagcataggtattttagaattattagtaatgttgagcatgtttcacatgtttgttggccatttacacttccccttccatgagtcatctgtcaagaggctctgtgcccacgagccatacacataatgatgtccaaaaagcgcttctattttactgtaagaaactcaggcaaagagaggccgcctttgcccagaggatctctcatgcctgggaggtcgtgagaggcagagctggagttgggtgctgtggagtccttttcaccacctttttcatgcaccatgctgcccgtccacatagctcaatgtgcctgtttatttcttaggaaatacaccacagggctactatttaggtagtgcaattaaagtttactttctgaattctctatttcccctatctttagcagaaaacttgggaaagcctaagtcattttccacttcttagccccttcctcctccccctcattttctaggcaaaaatatgataagagagtagcttggataatgtctagctttgttttggttctctggtgatgtgaatttttcccattgttaccaaactcccactttttccacgtcgaaatacatttcatgatagctggagtatggcaacagcactcctgagttacaggcatgcgccaccatgcccagctaatttctatttttgtaaagatagggtctcactatgttgcctaggctaaaaccttctgataaggatattttctagtatctcatgtttagagcaaattactagaatatcaaggatctagtaaaaaaaaaaaaaaaaaagtaaatgccatggatatgtctgggatcagtacagatttatcccaggatactagatctttagtagaaggcatgaatggtgagaattcctcagcaggatttccggatgtttgttagacatgagcacacagatgacttgtgggttctcaaactcgacagcccaaaacagttcacagaagagtaaatatatatgggtaataaacatagaaatatgttctccctcactagtaatcaaagaaacattattttaaagataaaaaaatacttctctttcaatcaacacactttttaaaataataacaatgttggtgttgaaatgagcactcataaacttctggggaaaaaatgaaaggtacagcctttatggaagctgttagtccttaaaaaatatatcatgccctttgacccagtaattccctgcccaaggaagtagtcacagatttagacaaaaattgaatgttcaaatatattaattccaggactatcaaaaatcaaaatgcccagcaactaaagctaatgtaaggatagcatggaatattatgccccatggaagatgatgcttcctaatatccttaattattctttgaagtgtccacagcataatcttaagtgagctcgtggtcttcactgcactctcaaacctgctcttcctgcagttttctccatccttccagtggcttgggcaagaaactttggggtcatctttgacctctctcacatctcatagtgctctgcagcaaatcctcagtcccacattttgtaagattctccctactttccaggccttctgcaaagcatgaactgcaaaggctcgaggaggaaagaaagcaacactgaactcccttgagtggttagggttttggttcctaaattaaggcacagttttccttttccttgaattaattatctaactcttcctcctagggcagaatcaatgggccaaatggcctcattgagaacatgacatccaaagggagagtggcaggagtcaaagtattattataatgaatagaaataggtgagggagaaagtaatgggatttcattggtggcaaccctacttgctgagaattgttgtatattttcagtgagcaacaaatattgtacagcatggaggaccatcaaatttaaaagagaccttaaaaccaagagtgtgtcggccgggcgcggtggctcacgcctgtaatcccagcactttgggaggccgaggtgggcggatcacgaggtcaggagatcgagatcatccttgctaacacggtgaaaccccgtctctactaaaaatacaaaaaattagccgggcacagtggcgggcgcctgtagtcccagctactcgggaggctgaggcaggagaatggcgtgaacccgggaggcgtagctggcactgagccaagattgcaccactgcactctagcctgggtgacagagcgagaccccgtctcaaaaataaaaacaaaaacaaaaacaaaaaaaaaacaagtgtgtggaagccattagcttagctgctgtggctattagacaagtaggctttgccattgggtgaagagagacttagtagactattgatgtctgataattcccattattggggaggaaatgtaatttcttcttaaccttcataagttcatagttgggacagacccctgtaacaaaagacagatcagcaaaagaaaaacaagcaaagtttttttattttgtttttctcttcagatacagggtctcactctgtcactaaggctggggtgccgtggcatgatcacagctcattgaagccttgaactcctgggctcaagcaattcttcctcctcagcctcccaagtagctgggactacaggcatgtgccaccacgtcccactattttttttaaaattttttgtagagacggggtcatgctatgttgcccaggctggtcttgaactcctgacctcaagcagtcctcccgccccagactcccaaaccactgagattataggcatgagccaccatgcctggccaagcaagtttattaatgtgtggagggcacagaatgcaggagaaaccccaatgaaaggcaacttcaaggcagtggcgtcaaactctggcttatatgccatcttcagaaaagaacaatacatttgtagagaaataacaggacagaagaaagcaattttaggcttccaaaagggggaaactgtgggaagttagatacatgggaagaaaccaatggtgtaaggtttgtttacagattcctctggtgctgtgtctgggctgataagaactatctccagtaaagaagaatttatatcctgtctttaggcagaaaagcaggagaatagagctcatcctctatttgctgctctttaattacttttagctcaaaaataagtcaaataggcatattttggggtgacatattctggttttcctttaccttgaagttgagtcataacaccaaaggttcgtctatatcttgcatgtacaaataggtagaaaggtttatgctaattaggtgagcccagattggcaggttgttgaagggctaatttaactcacaaaaggccttttcgtgtttagaatcccaaggaagaagtttggacttggttaagttatcctgtgattattttagaaaagttgtaaacctgctatcctcattagcccggattcttcttaattgtgtcttagaagtaattgggaaagttttgaatggcctgtggtctgtcagaagtaaaggatttactgccctgggataaattatgttctgcataacgaactttattttgacaatattttagtttccctttgaaaaccttatgccctttctgaaagaaaacagtagatagctggaacagtcttggagcttatctttagaacacagcaaaaggtcatccacatgtcaaacaacagtagaataacagatatttaaggtccttgaggttgtcattcaggacttgtgaaaagtacagagggggcccctgttaatctttggggcatcacagtccaagtatactgttaatgttcccaggagaaggcaaacaaatattgcctattttgatctaaaggaatactaaaaaaagtaaaatacatatctacaactgtaaaatatgcagcttcaggaagcgctggagataaagaagtatttgattctactcagagaatgactattctatttatgacctcaaggtcctgagcagatgtctatccccacctattgagttttttgactgggagggtagggatgttacgaggacttgtttaaaatatgatgagtcctttctctatcatgcttttgactatctcagtccttctttagctctggtttagagggtattgtgcaagtttgggtagaaatttagatggatgtttctgaatctttatggattcagccccaataatcctacagacaattggatgtttgaaactttgtcctctttctgttctaaagtgcctctcaaacaattttgttcatcaaagcttccttgactagtgactgtaattctaaattatccttggtgaaattatggcatctggaaaaataaggccacaaattttagtgatagcgtaaatgcatttaagaagcgagagtcttctgggctgggcacagtggcgcatgcctgtaatcccggctacttggaaggctgaggaggaggatcgcttgagcctagaagttcaagaccagactgggcaacatagtgagacttcatctcaaaaataaataattaaaaattaaagttatgaaatttattttaaaaagaagaaaaaatctgaatttggattttttggagggaaaaagaagcaggaatcttatgaagcaggagtacaggtttaggattaaactgagacaaagccataattctaggaacagtcagtccagagtaactcaggtttaactcctcctgccctaagcaaatgcctgggccttccaactacaaactccaagcagattaacagttcctagaggacagaaaggtttggagaggagaactctcccagagccagacttccatggacaaagcaagagaagactgaggaaagttctcatagggtgtatttgtaatcacccaaaactggagacaaccctgacatcctcagtgggtgaatgagtagactgtggtacatccatacgtgtgccattgtttggaatactactcagcaataaagaggaaccattaatccgtgcaacaacttggatggaagttaaaggcgctatgctgagaagaaaaaaagccagtctcaaaaggttactggatgatttcatgtatataacgttgacaaaatgacaaaattatagagtaatggggaacaggtctgtggtggccaggggatagggttgggggggagggcacagctataaaggggtagcatgagggagtttctttgagattatagaacaggtctgtattctggtagggtggtgattccatgaatccatccatgtgataaaatttcatggagtatatgccaaaaaaaagagtgcatgtaaaaactgatgaaatccaaataaggtctgtagtttacttacaaatgtgccaatgtggatttcctggttttaataattgttatgtaagatgttactgggggaagctggatgagtagacatgaaatacatgagaattatttgttctgttttgcaactgtgagtctaaaatcatttcaaagtacaaaagtttacagaaaattggagggactctcttgggaatctcttcagcttttactagaaaagataatataaaatcctctgcagaattataaattgaatgcagtttctaagcactgtaatttcatttgttgtaattttgatttggaaattattttaactatagtattagcaatattttgtattgttgactaaaatactgtgtacctgaaaagaaaatcctctggagagtttcccttctagataaaataactccttaacaatggcatacagagctactggtgatgtggctttcgtctgcctttttagccacatcaccttctgccccaacatgactctgggatgagctacttgcagtcctttccttcctccccatgcattcccctttcctcttaactcttacctgcctgatgagtttctccttcaagacccagttcaaaccatgtttcctttacaaagctttccctgatgcaggaagcagagttgctccagcagctcctgtatctggagttggagcatgatgtgttgccctttggttatttcgttcagttgtccagctctcacctaagttcattaatttctcgagggcccagagtgggttcatttcttcctataggtcctgtgctggcacaggggctggcacacagcattgggtgctgaagcacacactccacaaatggtgatgagtgactgattgaatctgaggctctgcaatgtccttagaaagcaattttgtctattcttcctgccttaatacagtaattttccacaaaaccaaacattaaaaagggctctgattaaccacagttaaacaaagttaatcaatatgtacaacattattttccaaacattcaacttagttaagactttattatataaacacatttcttatcttgcttttcatttgtgatacagtgttgtgagtagctggagaaagatcgtgagtcgcactcatgggtcttcttggacagataaaatctagaacttgagggtaggatatggagtctgaagggggatgggtgagatgttgagataaggagcacaagcctacttttaatctgtatttctttttttttttttttttttgagatggagtttcactctttgttgcccaggctggggtgcagtggtgtgatattggctcactgcaacctccacctcccgggttcaagccattatcctatctcagcctcccaagaagctgagattacaggtgcgtgtcaccatacccagctaatttttgtatttttagtaggggtggggttttgccatgttggccaggctggtctcgaactcctgacctcaggtgatccacctgtctcggcctcccaaagtgctgggattacaggcatgagccacagcacccgggcccaatctatatttcatttcaaattttaactgaaagaaccaaaatgctctccaccctgcaggcagtcactcactatctacctgaagtgctgcagcagacacacatggctgtgatgacaaatgcctgatgtccctctccagcttcctcctgggcaagtgatcaaggactccacaatcatctgcaggtctagctgctgtccccacactccaacaaaatgactcagagtttcatcatttcttattgcacaatttaatgaccatatcgccacctctggtctggtagcttcattaaacagggcagatgacctcctctttgaaagtgggccctcccttggctcctaagacatcaccttctctccacctcctctattttcatcgcgtccctaacattcctccaggactgagtcattggtcttatgctctttttttaaaataaaagtaataataaatatgtttcccatgtccagaatttcccattttctcctcgctgctttctggcatcctgtcatctttaaaggcccaattaggtgccaccttcctccagaaaccctctaactgctgatccccctctcatctttttcatgtgcctggaacacttaaaagccaaaggtgctttcactatttagcacttcatatattctgctttgtggcgtcccttgttattttataaattactcttacctcttcaaccaaagaaaagctccttaataaagacaagacccatgccttgaaatgatcccatgtcctcatgatgcctcactgggtgttgagcattttgtcagtggtcagtaagcacttgctggtcgagattaaggcaatgctaggccggacctggtggctcatgcctgtaatcctagcactttgggaggctgaggcaggtggatcacttgaggtcaggagttcaagaccagcctggccaatacggtgaaacctcatctctactaaaaatacaaaaattagctgggtgtggtggcacacacctgtaatcccagctattcgggaggctgaggcaggaggattgcttgaaccagggaggtataggttgcagtgagctgagatcatgccattgtactccagcctgggcaacaaagcgagactccatctcaaaaaaaaaaaaaaaaaaagaaagagagaggttaaggcaatgctgcaatgtcttgaaaaaataagtataaagaagaaaactgggccaggcatggtggctcatgcctgtaatcccaacactttgggaggccgaggcaggcagatcacaaggtaaaaagtttgagaccagcctggccaatatggtggccccatctctactaagaatacaaaaattagccaagcatggtgatggacgcctgtaatcccagctactcgggaggctgaggcaggagaattgcttgaacctgggaggtggaggttgcagtgagccgagatcatgccactgcactccagcctgggtgacagagcaagactccatctcaaaaaaaaaaaaaagaagaagaagaagaagaaatcctctgaaattccctttccctcctcctaattctcaaggggtgaaatctgggcaagtcatcctgctctagagctgtgaaaaatcaaatcgtccttcctgcaccagtgtggtggtgtggaaagagcatgggatttgtgttcatttggccaggttcagctctgatcttgccagtggttgatcttgaacttggaaaagtcactggaatcctcatccttcatttcctcaaaagcaaaattgaggtaacaactcaaaggctttctggagctggatgctgtaatccacaagagtggcatttctggtgggaatttcgggcactatggtagggcaggagagaagctatctgcaggccttctggaagctctccagtgcatgtccccactggggtgggggctgactgtctccacgtggggttagtcctgcagaacaggcaggtagagtagagtctgagggcatgaggaaaggcagtctactggagagggcacagagagttcaacaaacactgaaacttaagtttgtcctggacatcttcagcatccgactttctggtggaaagcttaaagtataaatgactgtgccctctcaaaagggcacagaagtaaaactgggaggattttgggaggggactggatgtggggtgaaaggtatggtgagagcagagaagaggggcctgagcctggggtcaggggaaagtaggctaaacaattcacaggatgcagacatttcagagaagggtgacacatcacttggccctgaacaacaactataagccagacagtccaaagagacatagttccaaaggaacataaagtgacatggcttgttatgtgtccccagagacatggatgtgcttttggaacttgaaggataattaaaaaaacatcagacccaccagggctgctgcaaacatgacagttcccttcccaacacgtcatggcagctgctgcagctcccttccctctatcctgaggctagccacagatgggccagcagcccacccccagagcagaccaagcagagaggtgctcccaggagttaccaggttccactctcggaaccatcttaaaatcctgttctgggaaatccagcagcaccatgttatatgcattagagggagactgtttaaatcccttgccaaggttcccaaggcttcgtgctgcatctgtttgcgtgtagccagggagtgcagctagcattctcctctccttgcttctccatgtagccagtggcacctcctcagggtcaacaaacaagaaataaaagcagaaaaccacactttctgagtccacctgccatctgaaccccccaaaccctagtttaacctctcccattcattcattcattcattcaataaatatataggtactgagaagctattgtgcactgagccctgagccagtactaattgagggaagaaatgggcaacatagcttcaaaagcacagctctgtctttctgcctgaggcagcagagagtggatacccaaggctgtccctactctctccctgctcaggaccctgatcagagggtctgtgggaattgggtcagggtgcaggaaagaagatgttgagtcagatatgtctatgtcagtgatcttgcctatcagtaaaggttgctcagcccccaaagcagcgtgatggtgaacctttggctcctgccagcggtactcattatccttccaacagccccatgctcaatcataccatcattctgatgcttcatgagaactgaggcttggatatcttcgcctacttgcttgtgtctcacaggcagcgaatggcaaagcctgtagccaagtcacactgtctgccttctgctgggagccttggattgatgggtgactccatggacatttgttgacctaaaaagtaggtgtttgaggaactgaaagatctccagcaaagaacgtttagaaagaaaatattgcctatctgcccacctagatgaaccctactgaaatggattgattttagcgatgagaaattttgtttactatactgcagggtttccgttaaccctcgaagttatggtcagatagggtgacctagccagaacctaccccaaggactccttccctggctagcagctacagggatgtggcaccattatcccaaccagcctggggagagccttagtaagagttcagatcattattcagcaggacatgtccaggatcccagtggctggaacttcagcagggctcagggtcttagagttgtgacctaaaagtgttgtgagaacaaaatcctggaggagtttcagtccctacctgaacccacagccgtccagatccctgtcctggatgtgtgggagggggcgcatgctgggctccaggccaaccctgcaaatactccacttgccccgtctctgcattgattaatccagctttgagaggctgagcctctcaatgaatcaggtccttgctcagccataagaagaaggtgattggccaggtctgccagggctttgtgacccgctggcttgctccccagcccctcagaacccctcagccccacctgcacatactgcctccatgcaagcccagaataacctggatgtgtgactcacaggggtaggggtagcaattttgcagattttccaaacaggtgacttcagcccccgggcctgggcaggaaggggtagcccagtgacaatgggcatagtcccacttcaggaacgggaaacgtgttggctggctctgtggagttctctctcttctgatcccacagcatctgttccagttgtcttggccggtaggatggcgtctacaaagcaggctatatgggaaatctggagctggggagggattgtggtcagagcccagctttgggaagcccatgtggctgtctcaaggcaaagcagcagagaaaagttctgtagtctgtctcctttctggactggcatttccatggtctgagaccagaggctggctgtgtgtcaggcacctactcctcgaacaaatgcccttagattctcactgtctgtccccgcgatgctgacagcacttgccaaatacatactgaatgtcaggctctgtgctcagcactgtgtacacatggctcacttaatcctcataactgttctgtgaggtgggagctgtcactgtcctcactttatagatgaggacactgagacctaaagtcaagtcagacagctaggacatggtacaactaggatttgaacccacctgatgtgcctggagatctagtgttcttaagcactacctttctggagcttgctggaggcatgctggccacctccttcaggactggtagacctggtgtgtctttcatagccacgctgggcagagggtggaggcctggaaactgcagggggttcttccagggaccagccagaacagggctaaacttggggtaaaaagagctctagagaattagagaagactgagggcccctaaattacccttaagacatatttgtggaagacagatttaaaaacaaaaagccaaaattagatttaggctggtgataaggtcattaaataatagaatgtgaaatttcagttgtgcagacttattggccatctttatgatttaagaatataagtgcctagatctaagtgcagtcctaatcgcctgggaaggaagcagatggtctctagaaacccttctgaccatgggttagtgggatttggtcttgatgaccatttttaaggcctcagtctgcagaatgaccagcagcttcccctcccgcaatgagagctgtaattgcctttcccagttgcctgtgaatgcaccatgaaccttacagtcctagtataggaaatgactcagcaaaatcaccagattaaacctcctcaacttttctttcccttggctccattcctgatagcaggagtcgaggcccttcagagcaggctttccccaaagccacgttgtcggtctgatcctcgaatggggatccgcctggatgatgacatgccacaatccaatcagggtctgtttctcctgacagtcacatgtgccaaagatcatggtagaaacatgtggatggggttggaagacactgctactacatctcttgggacagagcctgccccctccgagtggctacctaccattctctccggggaggtgaaggagctcttgggaacaagtgtgttattattaagagtttcgtcaggttatgtctttttttttttttttttttttaagatggagtgtcgctcttttgcccaggctggagtgcagtggcgctatcttggctcactgcaagctccgcctcccgggttcacgccattctcctgcctcagcctcctgagtagctgggactacaagtgcccgccactgtgcccggctaattttttgtatttttagtagagacggggtttcaccgtgttagccaagatggtctggatctcctgacctcatgatccgcccacctcggcctcccaaagtgctgggattacaggcgtgagccaccgcgcctggcaggttatgtctttgctgtaattggaggcagctggtccacttagaccctgatgcttgggcaaatactttatacacctctgcccccagcagctggtctggtgtgagtccaggcccaagtcaacccccaatgcaaaagccaatcagaagttggacctctttggtgagttcaaactgtggttttaggggatacggaggctggcttagttcagtccaggatcttagaacagccccaatgctccaggcccctcagccagcccagcttttagaggctcccaatttgagctctaaactgagctctggaaagggggtttgggggatgggggatacatttaaaggagtttttgctcaggacctgggtgccacctgctggccatgtttagttctacttacagagccaaagctacgagaggaaaattaaaagggcatcctgccctccccaatgtgatgtttgctcaaaggaaacaaggaggctgttacttcatgctgccctagcaggtgcagcagagaattcctgcagagacccctgggtgccctggatgagtcctcctgagccaaatggacccccactagggcagagtgtagcaccagttgtgaggacctgagcgagtcctgagtagggactgaagctgtgttcctgctactagctacctgcttccccagaagccccatagtgggtaacagcatgattcgttgctgggtcctgaaaggagccattttttccagcttccttcacacaggcactgctgccactcatgggaccctagagtcagaccgaaggtatggaaaatgccctcccttcatcaggcattgacaagactgggtcaatgctgagaagacctgggcatttttcaagccgctatgtggctcttagtgactcttgggagccctaaaagcaaggcctttagttgtgttctaaactccagggaaactggagattttccctgtgtgccaaggactggctagtattttccccccagataagtggcagaacatcccaatgttccagcctttgccattgcaacaaaagccagtaaatcacagctaagtatgcatatcaaatgaaggctgtggttctcatacagggctgtgcaccagaatcatctgggctattctttaaaattatgtgtgtgtgtgtgtgtaaaatatgtgcatataacatataatgtatatataatatatcatacacacacacacttgggctgcactgtagcctcttgaagtctctgcaggagaagccagtggactctcctagtaaagaatctctgcaatgcatggaagaggcctgaaccattagcaggtccaatcctgtggaaccaggaaagctgcccccaggctggaagacccttgaggctcaaatgatttcaatcaaaaactggaggatatatttggactaagaccattgcctttccttttcttcagtagtcaccccttgaaattcatacactttaagcagaacaaagtccctaaagtggctcggaaactcccagggccaacctaagactactccttgcccccagaaccacccaagaccagatcagcccctctgaggcctgtcagccacagctggcccagaatcactctgccccaggggcctcatagggaaatgagtctctgagcctgtggaacactcctgcagagtcattctggacagttcccggaatagctggtgccctctgcaccagctcctggccgtcctctgcaccctccctggggacctggcagagtctgaccactgtggccctggggtcattcacatccatctctctacctctgcatgccctctccttccctattcttgtggcacttgctgtttctagcacactttggggcatttggttatactgttctcatgtgtgcattactctccccaataagattatgaactccttgaggacagggacaaatcttttcaatttcttgcagtccacaactaaataatactcatcaaaatcagatgccctttccttgaccctacccactctgccccttcggcaagcttagcatccatccacccatccactcctcctcctgttactttaggtgcatcctgggaactcagaaacactcccctgactccagtctgcaattccactccaccaatatggttaggcagttattatccaccaagaactggtgtagaacccgaaagtgaatggaacagagcctgaccattgaagagcttacagtcaggtggaaggggcaggcacacacatttttatttatttatttatttatttatttattttttttttggagatggattctggctctgtcacccaggctggagtacagtggcatgatcttggctcactgcaacactccacctctgggttcaagcaattctcctgcctcagcctccctagtagctaggattacaggcctggctaattttagtagagacagggttttgccatgttggccaggctggtcttgaactcctggcttaggtgatcggcacccccctcagcctcccaaagtgctggcattacaggcatgagccaccgcacccgctctcacacacatgatttcaacagaccatgtgggatgccatgaagagccgtgcccagggtgctgtaggatcatgggcacatgtctcccacagagggggtcagaaaaagtcccctggagctaaagcagagtcctgaggctgagtgctgggggagggaggatggcggggggatggtggggggatggcagggggatggcagggggacccaggccagaaggtgatgagacatgattcagaaagaggagaggacacgaggcatcactcaatggttcaacgttactgaacgtcttgcctgtgacaggcctggataccccactcttggcttcaagacatggggcgcaggcatttaaacaagtccaatggtgagcgcaagggccaagatgcagggcagtgggcgcagagacgttgtggaggaggaaactcaagtgcagtcaacattactctcggaaagctctgaaattgccaggtcttgagtctttaggcgctcccaagacaataattcatttctgtttctcttggctttttggccccgcctggcctccctttgcctgggcaatgaaggacaaggtttatttttcaaaggaggaagaactaggaataaagaagagggttttctctcatgatttttcttcaaagcattcatttaagttaaacatgctctgtcctatgtacttggggtcaggggtgggaacgtaagtggcacacagctctgcagatgccttgctgagcctccctgtctaaagcagtactactcaaacaggactgtgcctgcagatcctccgggcatcttggtcaaaggcagtttctcatttagttaggtctgggggaggacaagagaattggaatttctaaccagctgatccccatatagtcccactgcgcaggtctggggccacaattgagaaccatggaacagagaatgaatgaactttggggtggggacggcattccagacagagggtgagtaggaagctgcctatagctcctaactggggaatcaaagtaggagataaggctgaagaggtggggtccccttatgagtttgataagtggtcaggaggagtcacatgataacagcagatgcctgcgacaggcagggaaatattctttctgtaagaatataaggtgtataagatgtatcttatttcacagagacactttacatattaaacctgaagaaatattcttcactcactccagaaacacatgtcctcacaattctcggaaaacacagtccttttgacctatcttgtttttccatttctgataaagatgtggttacaagaaatatgtccttttcttaacagcgcaagtcagttagcagcagcagctgacccttggcctctggggtgggaaggaggctcactgctggctccactccaactgctggtttcagtgcgggagcatagggtcagagtggccaaaagaagccagaaatcccaagttgttaaacatctgaactttaaaatattgggcactaattcaaaactgtttccaacactatgagtgctgaacagtttaagtctgcaaggcaaattcggccaaggagtgtctcttttatgactgctggctgaaaggacttgaagtgggggagggcggtggccagacctgcttttaggtagattctgactacagcaatgtcaaggatggattaagaggagggagagactggaggctggaaggccttttaggaggctcctgctagcctgggctagagagaaaatacagtcagcccttcacatccgtgggatccacatctgtggattcaatcaaataccgatcaaaaatattcaggaaaaaaaaaggattgttgcattgcttacagacttttttttcatgtcatgatttcctaaacaatacagtataacaactatttacatcgaagtgacatggtagtaggtattataagtaatctagagatgatttaaatcatacaggaggatgtgtgtaggttaactgtaaatactacatcattttatataagggacttgactgtgcattgactttggtatggggagatgttctggaacaaattccctcatgaataccaagggacaacggtatgcataaatcctgagggtaagcagaaaagggcgaattgaggaagtcgggttccaggacttgaggaatgacttgataggtgcatgagggagagtaagctgtctgggatgaccccgcaggtttctaaggtggtgattaattgctggtgatgacattcactgggataatgaatacaggagccagaagcatattctaaggaaaggttgtggacaagcagaatttagatgcctctgcatcagccacaggaatgtggagtctgaagtcggagcagaggcaaaggttagctggctttctaaaacacaaatctggtcaggttactgtcgcttaaaaccctctaatggcttcctgtcatccaaatagaaagtccagattcctccttctggtaaacaagggcctggcaacctgtccctgccaacctcattgtgccacaccccaacagaaaaatctgctccccgggcctgctccacgactcagagtgcccggaataagctctgcctttgttcttgctagtccctgtggctgaaatgccttccacccatccctttttatgtctggaaaattcctattcttctcaggctccaacatctctgctctgaagccttcgctgaccctgcccagcagatgcgctcacacccttctttgtgctgtccctgaacatttatgtgcctgtttcactgcctcatcactccctactgaggggatctgcctgtctgtaaatgcctcaaggcagaggccatttcttaattaacttggaattactggctcctggtgcacgtctagcatatagtagatgctcatgaaatgtctaaggaataaagaccctccctctggggataaactgcgaggccaatctggagggaatgtttcttacttcccagtatcatacagcccctctctcttgacagctaaggagctacatgaggccccagtgctgacctcacctttcttcttgctttccagctggggtatggccgtcaatgtgtactccacatctgtgaccagtgaaaatctgagtcgccatgatatgcttgcatgggtcaacgactccctgcacctcaactataccaagatagaacagctttgttcaggtaggaggctgggaatatgggaagtggccctgctggaaggaaaggaaagaaaggtcggaaggcagagcagccacaacagggaatatacagtcatgcatggctgaatgactgatgtggccagagaaatgcatccttaggcgatgttgttgttgtgtgaacatcacagagtgtatttacacaaacctggatggtgtagcctactacacacctcggctatatggtatagcctactactcctaggctaaaaacatggacagcatgtttctgtactaaatactgcagacagttttaacacatggtaagtatttgcacatctaaacatacctaaacatagaaaaggtgataataaaataaaaacatggtattataatcctgtaggaccaccatcatatatgtggttcatcgttgaccaaaccatcgttatgcagcccatagctgtagcttgtgattagattaaggaggagagctggaggccctgaactagtcagactgtctggagctgaagtcaagaaatggaagcagggaaagagaagagcaggagaggcaccatgaaggactgcagggaaaggaggagcggggagctgagagccaggatggcagcagagccacaggtctgaccacacctctctgggtccagctctcagctcttctggtggtgcaaccttgggcaagtcactatactgccctaggcctcagttttctcatccataagatggagatagtatcaccaactaactagagttcctgttgggattgccctacctacatgcagtgtttggtgtggtgctggttcataatacgcatcaataaatagtcattgcttttattcttggaaagctggggggattctggccatgtctatcctgaaagtaggactggtccctggcccagaacaaggagagagaagaggagacggggtttggggaagtgagagagagcagctcacagaaggagagcagcaagacccctcagccagccatccttctccacaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaagtaggtgcctgcgctctggggggccctgaggagcagtgtgaccctggggaagaagaggacccaccagcccaggcaactggggctgctggggtcattccggtgctcgtgcctccctccacctcccgactctccagagggaattttccccctgctcaaggcacaatggaaaagcccacaacacttgccatgccatcatgacaacattcctttcccttcctcctctctggaccctgcccaccccaacactgagctctgtgcaccgctcctgtgaagttccacctctctctgtctctgtagggcccaagaaagtgtctctgctcactctactgcctcggtggctgcagacccccagcccacacgcaggcagtagagccaagggacgcctccccacacagttcttccacacggtgcctgtagagaagggatgcctctggatctgacactagggcctaccagcctacctgtctgctctggtgccgtgggaggggggcaagtggagaaggtggaggacgctgcagcccaggggctggctttcctgagagcagtggccctcagcagaggaaggcggtcctacagcagcaggtggctaaagtactctgcttatgtggtctatttcagatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcaggtaacgtgcccgagccgggggagggagcgtggggggccgggccggcaggcctctatagccaggagtgccccctgggccacggcccggccctgccagcctggaggagacttgttatcacggagttcggatgacgccgcctgctggccagttagaccgggggagtgaaagtagtgggtgagagagctccacaaattggtctaagaggagagccaccagcaccagccatggtggcaactggggtaggaggcccaaggcactttgtttcatagcacgagctaacttgtttgcctcaagatgatggggcagcaaggtggcttggtttctccatccaggtgcatccagaccaagagcctggtgccagcaccacagccccttcttgccccctgccccctggatggccaggggcaggagttgccaagctggatcacacctttccccactctaaaggcccaatagtcctaagtcctcaaaagatgagtctctagaaacgaggctttgtctgggtcctggaggggaagggagaaaagcaatagggcctttgggaagcagcagcgttgggaggggaagggagaggagcagccccagcccgcgtcggaccccgtcatagcagagccacctcctctgtctgcactgctgttctgcctgggcctgccccactcgcccgcccgcttgctttgcactagaagcagcccgctctgtctagggaggtgcagtcgctagtgagcaagtcgccacggcatgctggctgcgctggggaggagctggggtccctgatttggccaccactgtgcagatacctggtccagcccagcagagggcaaaagagcccatcctgacacagggcccctggaggggcagccacccagggacaatggctttgggctggggcttctgttaggaaagaccctgtgccagctgcctttcctctagctatgagtacgagagggtcccgcacccttccaactctacttccccaaatttgcgtcctaatttctctcctctatccctcaggccagctctctccctgccccaacacctcacaccttgtttagttccctatagtttctgctctcccgggctcgccaaagggctgcccagctgctggagtgtccatgtggccaagactcggggcctagctgtagatgcccttcctggggtgggggcaggggggtgagagtgcctgcctgtcgcatgggcctgcccccgcagtcctcacaccaggctgtctcctgccacgtgcgctgtgggctcacgtggacttacctgactcttttcctctgggcagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacaggtgagtgggatgggtaagggtagctgagatagccctgtcaccaaagccaggcccttggggtgtctgcagggacgagaggagggcaggcaggggaacctgaggtggggacctctggcttgaacatcactttgtccccaagcagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggtgagcactcccaggcccattgggccctccccagtctggcctggccctaagaccagaagcgcgatagggccagaagggaccgtggagaacatttactgatgagagagaggtgaagtcactagcccagggtcacccattagcagggctcctggactcctgaccccttgctcttcagctacttacagaacctgagaagccctgcctggcctgcctggcccaccactttcctctctctcccaccctccaggaaggattcgcaccccctgaggacgatgagattgaagagcatcaacaagaagaccaggacgagtactgagggcggccgcagccctggctgactgcacagcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagtacatgccatgtgtccctcaactgagccacagtccaggtccagtgctttccacctcccatgcaccgctctctccggaggtgatagcggcagcacagcctcactgtcaccctcccacaggcctggaaaccaccaccagctctgggctcagagcccagctccagcctagccccaatgcccaacactggtggtagggctctgagggcaggtaggggccccaaccccccgtcactgaggaggaactaggtctgggcccgtggccatgacaagggacagccggtgaagcggctgtggggcaccgtggtggcctggccaagaggtgcttcgtttcagtctcctttgggtcagggggactgcatgtcatcccccacctgttgtcaaagctcatacaactcatcatagtgattcagctggggacaagggctcacgtgacagagagagctgggatggccacaaagagcaaggagttctgagtgctgaagcccgggacagcaacatccaaggggttccttctgtagagcaggctccagtgggaacagggaatcaggaacccttccacatcacctgcacagccccagtcctggcatgtgcctaacaaaaggccatactaaccgatgtcccagaagcccagcagagaccaagagtgcagaaatgaatgtgagagccttggggtcatctagaccagcccccggtttactgatgaggggtcagaggcccacgtgcatgactcaatcaccgtggctgaaacctggactagaactcacacttcttgacttgaggttcagggctcatccccaaagaccactgaggttcccccagctgcaggacagcgctggtttcctcaccaccctgagtatggtcaacatgcagatggggccgtgtctcttctgtggccccaccccatggccccttttgagaccaccaccatttctctcatgacaccaggttcaagccttaaataagcaattcatatctgtttattcctcaatcacctccaccaccccttttgactcccccccccacatacatagacacttctgccttattctatctctgttctcctccagcaagttccttgcctgcttttacttatcgtgatgattttaattcccttgcctaatttttaaaggcttttccccatgattacaggtagataccatgaaaggataggccaggccgagacctcaccctgaaggtaaagtgggtgtgggaggcagaacagtgcctcccccaatgtccacgtcacaatccccagaagctgtgaatatgtgggttacatggcaaaagggaattaagctgcctgtgggccaggtgcggtggctcacgcctgtaatcccagcacttttggaggccaaagcgggaggatcacttgagcccaggagttcaagacttccctgagcaacatagggaaacaccatctctacaaaaaataaaatttgaagggcgttgtggcacgtgcctgtagtcccagctactcaggaggctgaagcagaaggatcacttgagcccagttgttgttaaggctgcagtgagccatgattgctccactgtaccccagcctgggcaacagactgaaaccctgtctcaaaaaaaaaaaaaaaagaaaaaaaagttgcagatggaattcaggaagttaatctgctgaccttaaaatagggagagtgtcctggtttatccaggtgggtccaatgtcatcgcaaacgtttataagagtggaagcaggaggcagaaagggtcagagtgggcagggtgtggtggctcatgtctgtaatcccaccattttgggaggccaaggcaggaggatcacttgagcgcaggagttggagactagcctggacaacagcgagaccccatctttacaaaaaatagaaaaattagccgagcatggtactacatgcctgtagtcccagctacttgggaggctgagatggaaggatcatttgagccctggaggtcaagggtgcagtgagccataatcatgtcactgcacttcagcctgggcaacagagcaagatcctgtctcaga

SEQ ID NO: 12703 - DNA, 8939 bp, Human
agttactgtaaggtccacaaagtttagttaaaaatttcagtgtggggttataccccatctccaatatcaaaggccaaataaatctgggaaatacggggttaaatcaagttcaacatgatcttttgctacaaacattctcagagatagagccattagtacagtagtatttccctataaactgaaagtggattagattgttttcctcccccaaacatctctttgcatcttgagcctgggcttcaagggagacaatcctggaaatattgccatggattgtgaattacttggggttatcagtttttttttcttttgagacggagtttcgctcttgttgctcaggctgtggtgcaatggtgtgatctcggctcacctcaacctccacctcccaggttcaagcgattcacctgcctcagcctcccgagcagctgagatcacaggcatgcgccgccacgcgcagctaattttgtatttttagtacagacggggtttctccatgttggtcaggctggtctcagactgccgacctcaggtgatctgcccgcctcagcctcccaaagtgctgggattacaggcgtgagccaccgcgcctggtggggttatcaattttttttccattaattaaaatactggaaagcagccgaatcattaatgaataagtccttcaggtctaaagtaaaatgagcacaaaacaactgctgaaaatctgaaccaggttagatctaaatgaattgtttttaaatacaagaaaaaatggaaatgcagtattttaaatatgttgcttttcatgtgttattaatcatgtgagtactattaacatctccatgttacagatgagatatgtgagacaccaaagcttaaatactttccaagaggtcattaagctacagaatagtggaaccaggatctagcattgaagcctggacccctaattattatacgacactgcttgtctgtacttctgaataaaaatcagtgcttcagtagtttgatggaaatatatcgtggctctagtaattcagagtaacagaataaaaccttgttctccgcagagtatctacagccctaagcagaagactagtttataattctggctctgacactaaactttcaaggtcggttacctaatcattccgggcctcagtttcctcaggagaaaagtgggatgaaattatacctatgcgacctacctcgcggggggtgtaaattaactttgcgtgcacctttccacttcgcaggtttcacgtatcttaaatggtggttaatgttgttcaatgaaatgagatcacgtgaagtggggaaaagactgaaaaccacagaagcccgcgcaaactttactgttttaactgttaacacccaaacaggctcctgggcctcgccaccagccagcagtcctcgcgcaagaagggcattgctagctaaactgaactagcgccttccctccgtcttgccgcgggcgacgggccacgtacggagagctgaggactcactggcagagcggacaggagacacccaagcccaaaggccacaggtccaaggcctcacggcgaggctgacgcttctgctccagaaacaacttacggataaaaactcagcttccggtctttattgtttcgtccccggcggttcttacaacaaatcgctgcgcaatagcggggcatgactcgggtgaggcccctggagaccggggccggcgacggatgcagggcggccctcctcactgaggatgcgccacaggtccaggcctctcgagcccctgcgcctgcgctagcattctgccgggaaagccgcctcgtctgtcgactcacttccgcctcctccggtttaagcaccgccttttcgggggttgaagccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggtgagggacgaggccggggtcgtggggaggggagttcggagggtccccgtagcccaggcctgtctttgtgagctgacttggcctcggtgtccgccacggtcgccgcagggacaatgggctgcatgtttttggccgagagaatggaagaacggagacagccgcatcacagaatcgtgttttgggttgtggcgccggctttcacgggcgccggattagagcccgggtctcgggcagcttctgcggcggggcctgggcgggcagggaaagtgccagtcgcctttaggtgaaggttggagggtctagcccagccgcccaccgaggctggggaataaggcacgggctgctggctggcggggccgtcttggggatgagaagtctgtacaatacaaaactagtctgctaaaaaaaaatcattagatgtccaccttgagaccgtggaataacgtctgctgaaccagtgaggcgcctccctgtcagttttagatccgccctttgactagggagcaacctgcagttgacgcagcgtccatgggacacactgttgtgttccttaaaccgagaagtggttcttgattcttggtacccgtgactacgagtaactctctggaaataagtaatctacctgcctgctaattactctcaggaaaggccgctggagaggaagccaggcaatttccacaaaccgtagtgtttttcgtcagccttattatggcattataggttactaaggactctggtggtcccgtattcaaaaaacaggatccatcccttcgttttgaatctcaagtcattgaatacatattgtcaagaattctaagttaacatttctttaatggtttaaaggtaaaagaaatattttaactactgagtttgtgaaagtaagaatctgccttaaccacagtacaaactatcaaagttcatttttctggcagctttagcagaaatcttaaattctgttcatcatgagttttaaacaatatttagccatgcttcctggttaaacatttgggatcttacatttgggaaaaagacaacattctattgtattgtcagtattagtattgtgatattaagattctctatttgcagtccttggctcacctgctgaaatgaaagctgaatttttggagcgagattaataatactaatttagatatactgggctatttaccttggtgcgccaccttttttttttaatgttttttttttctgtgaagttaaatacattattactttcaggatatgaagtcttgaaaggaaagttgggatcttatattatttggttttctttttttttcttacaatgcttgcatatgatgaatcttcaatataaactggttaaaagtcagttattgataattttctatctcctctgtgtatggccagagtattagtagacagacaaagccaagaattatttttgttctcaataaggttaagccagtttgagagttataaaactaaaagtgaaattacatgtggacaggtaatagatactgtatgcttactattttgatactgcattaggtttaccttgtgttggatttcttttaaaagaaaaacgttttaagattagctccatccataacatttttttttcttttctgttttaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaaggtaaataaatgacaatctctgaagtgtcatgggtattaactagtaaggagaatgatagctaagaagtgtttgtatttgaaggttttgtggagatgggaggtggagtgggatttatgtataaatattgggtgattctctgagattattttcttatcacagatgctttgattcctgaataaatatatgaaagaataatagataattttattggtatacgtatctaaaaatattgaaaatctattctatattatttataagatcactgttgcttctatgacaaaaaagaattttaggtacccaaaattcttatcaactaacttatgaaacagaatattttacattttaaacattaaagacttaaaaattaaactagactctaaagtgctttattcacttgatctgcttttcaaagccatatttgtcttcaaagaaaaaattggaacaaattttgacttcagactagctctaaaacaaattgcacctgctgagcattcagtaattattgttggatggaggtaactgagtagggagttagaattaaacagtttactttagtaaggaggtgcaaaatcttaattcctattaattggttatagttgatggtttaattttttaatacaattaatgatttcacacgaataatatgaagattaaagaactctgattgttgcccacatgtttatttgtagtaatggtaacatttaataactttattgagtattgcagatggcattgtgccaactgctgataactcagcagttaataagacagtttctgctttattttataattttgattaacttgatgcttatatttgtagtgttttgcttttatttctgatgcgaaattcttccctaaaataatagtattcagttcacttgcttgaagagatttgaatatatgtaattttgaatattttaccttcagttactaaaaatatttttgtcactttcagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggttttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccatatgagtattaatcctatggatacatattaaaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaattttgggctgaggattatctgtagcctattttaaaaaaaatcaagttttgagacattccagtaatatataaagcagaagagtgtggcttgggagataaatcagaaaaaccacaatcaggatgtcctggagaagctttaaggattggatttgggtgagggtgcagaattcattcatattaatttattgaagaactgcattggaaagctctgctcttagctactccctccaggtaaacagttgttaacaaaagtaactttttcctcaggcaagggactaaacaagtcttgaaagaatggggttatttgggggaagacttacccattgagggtattagggtgtgaggtgaaggcagagtaaaggtgaagtgaattttcacttgaaggtcaagggggtgctggtgagaaatggcagcactcccagagtaaagcctccttatgttggcttggtgggaaacaatttctctgcatgcagaccacatactcacctgtgggtacctgctggttaaaaaaccctgacaatttagccgggtgtgatgacatgcacccataatcccagatactctggaagctgaggtgggaggagttgaaggctgcagtgagctatgattggccactgcctgacaatttactgagaaccatcgcttctattcaaaaaggaggtctaatgcagacacataactgctgaagaaactgcttttctcagctatctgtgcaatttgatctaatccttcataaacacatactgatgtccaaagaatgtcagacatttaaggaaaactgatagctaggaaaagaagccccaatgattagccctgacaatgtaattcagagattgaatttaagattctagtatcagatttttttaatagaatattgcatcaacagataaggacagttcttgtcttaacctgcttacttcaggatttctttaatgatggtgtcagaacagatgaagtaatgtgaacttacatttggtttacatttacatctaacaaccaaagtcaatgggaggtaacagatgtgtggtacatgtgtttcctaccatgcaggcctactttttcctttgaaattcatattcttcctcatatctcaactttgttactcaactccctcgcaaacttctctccagaggttgccctaatgtggagctacctaaatttattgtgcagttctttttactgttactcattatgatacaccgtaactggtgagcaggatggtgggggtgattacattcttatggaaaaagacaagcaataaccatatgaataaattataaactgataaagtatggaaaaaaaatgtagcacaggagaggagaattgtgagggcaggcaggttgaggatgtgttgcaatttttgacaggattgtcagtgttggcctcattgagaaggtaaatttgagcagatgcttgaagggaattgtttgtactgaaggtggaagcatatgtgggaagttgtaggaatggcaaagaagtgcgcataactggaggccagtgagcaaaccagagtagaaggagatgaattcatagataagaggggttgaaagcagccctacagatcacctagggccttgccaacctttgtaaaggatttgattttggaatgtgatatggtggctgagcttggagcagataaatgacttgatctttaaatcattttaaaagggtcactccacgtgctttgttcagaatagacagaggggcaatggtggaacaaggagagagtttggaggctatttcagtattctaggatgagaaattgttgcagcttgtgcatcgcacgagggtggcagcagtggaagtggtaggaagtggttggattccagatgtattctgcaagtacagctaccaggatttgcttatggattagatgtaggtgtgaaagacagaggagaaaactatgattctaagcttcatgttctgagtaactggaaatacagagttgcctttaagatgggagaggctgcagaaagaaatttaggaggaaaaatcagaagt

SEQ ID NO: 12704 - DNA, 33155 bp, Human
gaagttttaggatcactcaaaaattgagagtaaagtacagggatttcccacacatacatagcctctcctgttatcaaaatcccccaacagtgtggtacatctgttacaattgagcttccttgttttattttttaacccttcttatgttattacacatggctatttttcatctatctttattagctatctcctttgttaccttcccctcccgcactgatgttttagcccagtggcccaacatagctgataagaagcagactttcattccaggttcattttcccgatttagtgttgagggtgcgggtagatgaagttttgttttgtttgttttgttttagagaagtgtattgctttaaaacagggagagatagtctgacgtactgaaaggaggtgggtctttaaagttagcgaaaggtaggtaggagccttacttttgcctttggcaagtttattgaccactataagcctcagccttatctgtaaaataagttggataatgcccatctggaggagctcttgggaagattgaagcatggaaagcacctctctggaaggttcaaggaaagggaactagaattatgggtgacagaattccctggctttccaatgctttactgtaggtcgaatgagcactcctagcaggctggcctcatgccacttcagagtctctagcctgcaggctgggggctgggtatggacacgatacctggaagggaacacatataacttccatcagtgatcctggaaaggctcgacaaatcacccattcattcattctgtgtgtatgtgtgtgtgtgtgtgtgagagagagagagagagacagagtctcactctgtcacccaggctggaatgcagtggtgcaatctcggctcactgcaacctctatctcccaagttcaagtgattctcccatctcagccccccgagtagctgggattacaggagcccgccaccactcccggctaatttttgtatttttagtagagacaaggtttcaccaagttggccaggctggtctcgaactcctgacctcaggtgatccgcccaccttggcttcccaaagtgctgggattacaggcatgaaccacagcacctggcccattcattcatttttatttgaacttctcttccaggaagccctctgagtttaggtttagcgacaggaccctgattcaagtcaactcgtttatttgaaagctgcctggataaaaataaaataaaataaaaaataaactggaggataacataaaaggatccttgcagaggattcctccttttgtggatctcactgaatctcagagttagaagacgctcagagatctcaactccctcaagggtcagacaaggacaggtttttcattctgccctggatcctctcacaatagcctcgcgggagctggccctcaaaatgatgaaggaataaatgaaaggagggatggagaaattaatgatgaagaaaaaatgaatgaggtagggctgcttgtttgctgctattttcttcacaatgcttttaagatttcctggtccatctcctccttcaccacttctctccctccctcgatctcttctccaacttgtctcttacagaagggcgccgcgttcccgcgctcctccccttcccctcgccccgcccctccccagcgaggccccgcctcgccgcccgagcccggcgggaatgaatggcagcgtagccgccgcgccgctcggggtgccgattggctgaccggcgcgctgacgcgccggcgaccgcgggtgcacgcaggcgaacagagccggcgggggcggagccgggctccggggcggggcgcaggagccccggggcggaggagccggggaggcgggaggcgggaggcgggaggtgttggggccgttgaagcggcctccctcccgcccccagccgcccggtctggccccagccctgtcccgacccccggcctggcccactccgaccctacccggccgaagggttccgctggacacgcaggcggcctccggagcagcccaagcccatgagggccgcgcgcccggccgccggtgctgacgagacggagctcctggcccccgaggaggagcagaggatcaatgcggttcaagaatcgattccagcggtgagagggatggcgtcccggtcccgctgcccgtgtcagaagcgggttcccaaatcccgccgttaagcgcacggctcccggctcctcacctggattcatcctgggtggatcccgcaccttggccagggatcagttccctggggattccccaccctgctgtccctgggcgatccccttcctccaaggatgggagctcctgcctcacccgggtctcccctcgcgatctgcggacctcagatggattcccggccccgggactccaagcctgtcctccttcccggggatccctttgctcctggggctcaccctcccgacccccatacaggctgggctctggctctctctgggaacccgaaccccagccccgggcaccgcccccgagtcctccgacctggctttggcctccatccctttacctccagggtgggggtctcccggggcgcgcggaacggggtggcgccctgcggagagatttgtcgtaaagcggggtgctaggcattttgggtgctttgtgaacggccctagcaacagggaaactgaggcacgctccgccagcttagccctgcctggccgtgtaggggccttgctggttctccagctgaacgtcccagggcggtgctatttttgggctctgcgaaggggcatgttagctttcgggtggcgagacctgctgtggaggcgccggtgttaggaaacgaggaggaggaaccgtggaggcgccaccggaaggctggccgactgctcattcactgtagagctggtggaaatgccgggctggggggcgccgtggccttactcccctctggggctccaccgtctaacaatggatggaggttagcccatgactctgagaggaactccgggcttttcttttctgtttaagtgggtgaaagttcacctctccagggcatatggtaactgcatccctttgtgtgaattcccggaccttcaccaccagcatgtttgctgggggtgcagtgacaggggaaattttaagaaatgcatgaaatcttccaagaaggttgttgagtttttagacactaccttttatttcagaattttaaagtacacattttttttttctttccaatctccatgccctcactgccctctcacccatctcattcctcccccagtcccaaagggtaaaggaggcaacaaatgcacagaagagttgccatggtctgggccaccaggaaggggatcagcttgaagacttggattgacttctgaatatattgcttatcagtcagggtgttgaatgcctggcactgttcccccagtggaacttcataccggtgtgtctaagggcaaaatggaaccgtagtgttctgactttagaacctgatgtcagaaatgaagaccggaggggcttttagagagaatgtaacatgcactccagtcatgatcagtgaagccctgtgcatgcggtttgatttggttttacttctctacacgtctgtgctcttcctgttttcagagaacagtggcaatattctgtgaaattgccccttccttgtttgattaagagtttgtcattcttacctatacctttggatcctctaaaaagaaaaaaaacaaacaaaccctgttcaattatttgttgcacaaacgttaaaactgttaaaacaacaacaacaacaacttcatttaggatgctaccctctcagcttattgaactgactttttaattatttttgctggacactgatctctccattccttattagcacagttgtaatgtgatttttgcgctattattcacttaaaaactaaaaatacaggtattttcttttggtgtggcatagactgtaattttcttgggggcttgtgtgtttctcaatggatatttaacagtttctttcttgatgacatctagatctaccctgattttctttgaagatttgtgtgatctcataatttcttggttttctatcataagctaggttggaaacatagttctaagcatcaattttaacttggaaataaagcctataaacaaaaagtaatgtaatgagaatgtcctgatttttgtggttcacacattaaaatgctgagagtagtactattctgcatcttttaatgctgtgttcatgatatatctttctgagcattcccaggtaggtaaattgcaaaggaactggagggagagacacactgtctttgaagggagacatgcttcctccctcctgatagatttattgggactggatggaggagcatgaggagggtttatgcaatgatggcttcttaacaaacttaggatgtgaaaaatttcactggaacacagaggcatattttatcttcctcattttatgtttcacacttgagtatccccaagatacctacacacacatagacaaacacaaagtcatcctctccccttcatagcatctctgattgatggcaataactgctaatatttattgagtgccatttatctatgccaggcactggctgggcacttgtatattactcatcctcaactataactctggaagacataaatgttatacccatttaatagaagagtaaataggtttagagaatgaaagggaacttgcccatagtcacacagctaggaaggggtagacccaagagttcaacttcatgtctgtctctcaaccagtcatgctgctagctcacctctttctctctcttaactctctgcccacaccacatctgtgtgtgggcacacagatcttataggcataagatccacagagctctactgtatcttcttgttggtgtgtactcatttcaacagtcttgcaaccaaaaatccaaggaaaaagaagcccttttcctcagccccaacctcatgatcatgcagctagcttcaaaactggatatgtgggaaagcattttaatctacagtattagaagtcttacagggctacctattgtcttttttcccatgttcttaaagcactaaatcataggcatggggtagtctccttatatatgccatcttcctttatttaataattaagtcaagattggcactattgacagtagacacttttcctgaacaaatatgctcagtcataaaggggagctaatagtaagaggggtccacttatacgttgcaacataaatgatgttgaaggggcccttggaatatccgttgtcttggattttaagtgtttttgtgtgtgtgtgagattcggggttctcttggttccaaggctgcctgtttctcttacttacagaacctgctgtgtccacagtaaaactaattgactatgggatatctttgttaagacaaaatagttcagcagtagctggaatgtctttctattcattcaacaattattaagctctagcaataagctgggcattgtacttcagtttggtaatggaaaggtgaacaagacagccttcatggaattcacactacagtgggaaaagatgaaataaaaaataagctaaaacaaatcaaagtcttaccaattgtgacatagggctctggttggatggggagggttgaaatgatacttcagttaggatagtctggaaaacctctcttgaggaggtgacatctgagctgagctgaaaggatgagaagagagctgagcattctggagaatatcctagacagaagtaaacagcaagtacacatgcccagaggcagacacaaccttgatgtgtttaaggagcagaaaggaggtggtatagccagaggatggagagagagaaagatgccaccctgagactggaggggtagtgaggcccagaccactcagggcttgtgggcctctgaacactgtgttacagtgctatcgtaagcactttgggaagccagaggcagactttaagctgggattggggtgtgtgatgtgatctgggttttttgttgttgtttgtttttgagacagggtcttgttctgtcacccagactggagtgcagtggtgccatcacaactcactgttgcagccttgacctccgaggctcaagcagtccttctacctcagtcagaagtagctggggctacaggcatacactaccacacctggctaatttttacatttttttgtgtgtgtagagatgggatctcactataccgcctaggctggtcttaaactcttgggctcaagcaacctcccgcctcagctccccaaaagtgctgggattacaggtgtgagccaccatgcccagcccctcatctgtttctaatggaaaactgtagctgctatgtaaagaagagagtctgtactgggtcaagcaggaagactagttaagagactttgtatttgtacagacctgagatgttaggtctttatttaaggtaggagacgcggagctgggattacaggtgcacaccaccacaccaggctaatttttgtatttttgtagagatggagtttctctatgttggccaggctggtcttgaactcctgacctcaagtgatgaggtggacttatttgaaatatattttgaaggtagtgttgatggtacttgcactcggagaatgaggaacacttgtgggatttgatctactgagatcagcctctgagatctgctggtgggttgcagatctactcagtgggcacagtgctttaggttgaatttaaagtgtgttagtgtgctaaggagtgttcccaggtctctgatctgttctttccctccatggttttgaaattctgtcatggcatgggagaggggtatgggggaaggaggaggtgataagaacgttgggcaagggggaaggcaggagagttttgaaagagaaagtgaaggaatgagtaaaaaaactctgcctaactagtagctttattaagtgcagctcccactcccaggactgaatcaccttccttcaaaccctctagagcttgttggttactcaagcattgagtaaccattagggccactccgctttaaatagagatgtcttccataaatggatgctgttttccataaccagcacttgaacctttcccattcttttttcggggaagagatgaaggccagagtgtgggagttgatttacattttacatctgcttttccatttaggttttaggagtgatttcttcaggaggctgtggaggaggcttgattgcaccctggcaggttagagagaaatgggaaaattgtattgtactttcccagcagaacaattatgctgtctatcctactgagccccagatttagagaattgcttccaggatagttacccttatctttccctattgcccgtgtcttaccctgtgcatcaggatagagtgccttaagtcaccatgggtgggatatttttctgtataactttctacttttattttttaatgtgaattattccaggtgatcagggactaagctgtcacaaacatggccatccagtttatttgtttttaggagaaaatgtgaaagtctatccctgttgctgggtaatggcttgactatttttagattgggctgccagagatataaattgctattttagtctgcagcctggtggtgggtagacaaatcctacttactgcaccctacacagagcacattcaatttcatctaactacagccatcttggggccttgctctttagccttgaaaattcctaatagggtatgctacttatagctctgttgttatgtctcaggacaatgatgtggtatatcctccaattcttgggacacttttaaagcattcttcccaagagtgtaattattttcttttttgctaataagagctgtatagcaacactcttgtctcttaggaaattagtaaaattatttaaaatattatcaggggagaaaagatgatgcttaataatagttaactatatttgagaatagcttggataaattttgaagctactaactgtatatttctctttaacagttggttttcaaaccatctggtagattatactcagtaagtacatattttgtacactagttaaatatcttaacccatcagtgggccaagtgaaatatcttcactgtcccaaattcattccccagtggattttccacctgaactatctgtattgtgttaatagtggctgccactttatttttatttatttgatctaacgataacaggctcttcctaactcagggaaagagtattggctggtcttttattaataaacttggcactctctaaaatggcttggtcatgcgttttagccaatttttggcaacttggttctaccatttggttcagccctgtaccattttttattttgtgtatgaataaggtaatgagtagttagaactcattagtggcacaaaataccaacccccaacccccattcacacttctttaaactagcttgagcaaaaggattatttattgtgcaaagcctgttgacgtcttacagactcttaagcacaggagtgcagtggacctctgcaacctgaatgctgttgaaatttttttttttttttacgtccgtctgtttctgtgcatctacctctttcttcttttattcagacagctgcttttttctctcctgagaaaaaaaggattaattagactaatccagagtccctcatgaaacctgttgtgggtatgggttgggtttttggtggggagggcatcctcactcagcatactgaaatggaagaatgctatcctctctttaggttctgtggtattcatgcttttctctgtactactgatggtcacaaagttagcctaaagggaagtgcggaatatgggcatatgtctatatatgtaacagattttgatatttagatacgtacacacatttgtgtgtatatatgaattttatagccaaaagaatcaggtagtagtcatgtgtttggtttttgaagcagactttttgatttcaggaagaacaaaggtgaaaacatacctccggttttaagttgcctagaggtagccaggtgtcatttatttaagctgtctggtaatacaatatagggaaactagtgggacaggcctgttaatcatgggatgtagggtttaaagatgtgcctatataaagctttataaattttaagagagaaaatagaaactttgtttttcaaatgtagtgtatcccttttcactaaatgacaataaaatttagaaaaattcgttttttttttctagttgtaccgtgtgtgtgtgtgtgtgtgtgtgtgtgtgtgtgtgtgtgaatggaggaggagggttccagttgaaggggtggatatggtttctctttgcttttggttgtagaagtttgcttttggttatggaaggtttttcttttgaataaactgaaagaaggcttaatctaataaactagggtatttgcttaaggatcattgctattggctcagtttactcctctttagtggctttggctttattaccgcaactgggtatttccaccagtcacttctttgcgtagaatagaccacatacccactggtgggtttcctcattgttcttcacacactttgagtttttcttacatgtgttctttttgtttttacaggttcatgaaccatcgagctccagccaatggccgctacaagccaacttgctatgaacatgctgctaactgttacacacacgcagtgagtacaagttttccaccattgccatcctttccacggggctttggtgggaggaaggggtagttatctctagtaacctcagcacaattagttggatttacccatctgtgaccttatctaccaggaaatcagttctgggtcgtgtcaccagaaactatgtaagcatgtagaatgctttgtgtgttctaacctacagtcagctctgtcctggattcgctttctccaacaagatattctttaaaggaataataatagtatgtaccctagttatagaaaaaccaaagacacctatttatgaagactgtcacccctagaatgaaatgaatcgccttttcaagacaatcaactgtgttcatttggcaaagagagttcacagtttgttgaaaaagatgctttttaaaattaagtgatcctctgaaatggggaggggagccatagcctcccactcctacagtggccattgcttcccagaggagatgttattccatattggtgaagaaaaagccgatgtgatccctaaattttttgttaatttttttctgctttgtaaaagcaaaacatgcttattataagaaactttaaaaatactgaaaaatatataagaaaaacaaaactaaccagaaataaactgttaacacttcggtgcatttctttgtgtgtgtgtttgtgtgtatgtgtgtgtgtatatgtgtgtctctgtgttgggggtgtttgtgaatatgtatgtattttcagttttcctgttaatgtgacattaatggcatttcttatgtcattataaattttttactttacctgtggtttcattattcccttgcatttagtgacattgagggaaaaatagtggctgggatacagtctgaaaacaagaaatagagaaaagaccagtttgcttctttaacaatgagtgtttggaacaggctagtttaactgtggtagtcactgttggtacaatacaatggttcagatattgaaacacacagcttacctttaggaataatatttactcggatgaacctgaataaaccttaacttgtctcttctgagtgtgtcacaggttaaggaacacttgtgtaaacttaagtaaagggagacctgacaaaacccccatattaatttttttagaacagaaaatataatcttattaaaccgtatcttgaatttttggatttcagggaccagtaatatttctaacacagacaaaacacccctattgtcatcatttcattgaagagaagatactttaacatgaaaagtagtaaggacatgatctcaagataaagggcattcctttaaatgaaatacattttgttttatgaaaaactttattgtacttaaatgtacttaaatcctctgaaataggaaggcgagccatagactctcacccctacagtggccattgcttcccggaggagatgcaattgtatttaatgttctaattttgcttgggccaacgaaaacttcagcatctgaaaaactcatgccagtctcatctaggggatttaatagtctgttgcaaggtgacaaatgtaggtttggggagaaaaaagataagcaaattgctaacatttgtattctttgtcaagtatgcttactctaatatctaataaagtagtttattctcctgggagcttctgtcattgtaagatgtttactagtcatagtcatacacatatgactagacattaaagtttgtgaccatgtggactatgaaatatgatgcagaaagcaaatctctctaaaattctcaagattttttgaataggtgggccttggaaatggtttgctcttgcttacttaaaaggctctgttaaaaatgaagtgaccccaaaactcttacattctgcagtagctctcaaattggtggaatgtacagatccaaactgaaaatcagggtatataacttcaacaactgactttttgtatgtgtgtgttgctatgtacattataatacctattacttgatttgttcaattatcctgtcctgaaatattgagatttcaattgcaataggacagatattttaaaatgaggacctccctgaaaaatctgagtatatgcttggctgttttttgaaatggggtctcactctgcctcccaggttggagttcagtggtacaatcatggctcactgtagcctcaacctttcaggcccaagcagtcttcccacctcagcctgccaaatagctgggactacaggtgtttgccaccatgcctggcgaattttttaaatttttgtagatacagagtcttgctgtgttgcccaggctggtctggaactccagggctcaagcgattctcctgcctcagcctcccaaagtgctgggattacagtcatgagctaccacaccctgcctgcttggcatttgaatattttaagtaattactctaaatcagattataaagtagaatgaaacatgtccttatttaatgaaattaggataaaaaaaaaaaaccatctgttttgcaacagctgaatgatgttgcatccttgatggcttaattgtatccccactggttggcacaattcctggaccctgagtggtattacctgctttccagtgtagcagctaacttcatctggctctcgttatgattatccaggagagacaaatacttgctctaagattattttactaaaattgttcctggtaaagctctgtatttttagtaaaagactcaattccataaaagccagaatattccattcaccattctttatctttccctcagttcctcattgttccggccatcgtgggcagtgccctcctccatcggctgtctgatgactgctgggaaaagataacagcatggatttatggaatgggactctgtgccctcttcatcgtttctacagtatttcacattgtatcatggaaaaagagccacttaaggtacagtggatgacatgctgtttcaacagatccaaatagttgactcaacgtgtttggtacccttccaagctggcatgctttagtcaagtagggcaaagagtagacatttttctgccttgtagactagaatactatcccattattcaggacttgttctttggactggatgaagttttaggactcctccccagcaggcatctaagaaggtaggcctttgctcagtaaccccaaacaaaacctaactgattccccaggacttaccacttaaaaacctgagagctattttccagtactatcaagcacactaaggatatgatgagagcagcagctatggggtagtgacaaagcacactgagcttggagtcagcaggcaggctttgaggcccagccctgctctttaattttgggtaaatcacttgaccttgtggagcctcagtatctgtatcactaaaatgagaataataatacctgagtcacacagtcagtgtgataggtgaatgagataaggtacttgaaaataacttgaaaattacaaaagaccctatgagtgtgtgaggtatgaaggtatacttatagtttgcgtttaccattttgcaaagtttagctttcagaattaagtcttgtgtatattattcaaacagagttcacgtattttgctattaatagtcaagcactttcaaaacaatactatagctcttggcctgccaatgagaagaacgtaaacgctttcctcctctgagtgaaggattgattttggagcaccacaccatttaggtgggaatggtttgcttgtgaaatggattctgcacaaccctaaagggcaaaacttcttttcaaaaaaggaagtttcagagcagactatgagcaatttaaagaaatactcgaatatgccttttggttttaaagaacgtccaaaaaaaactcaaactattcaaacaatctgatatttaaaatatatgctccttttacaagcaggatttgagatttatgagatgattactggtttcctcacatgcagaatcctagagttttagagctgggaggatctttagaaatcatctaattcaaatcacttcatttttatttgggggaactgaggctcagagaagtggcctgacttgtctgagtcagtgaaactggcaaaatctgattattccaagacctctgactccaagtcctagtttttttcaccatatcttttacaatattgcatatagcttgcagtctgctaccttttcctgtaaggtgacagtttcctgggcttaaaataaaaccacagcattgaatcacaagggcactttgggacacactcacaagagaaccacaaaagtgcctgtcctggctccttaggacacactgtcgcagcgcccagaggccagtttagatgcaaagtactatattaccttcttggcacaatttagtgcttgtggttgtttcagcaaacttggcttcgatgtctagattttggatcaataaaaagttgtaggtacctacttcagtattctgggtctccctgccagaggtgtaatagaaactagattctctttaactttgaatagcattgctagaatcatatgccatgtgtagatttttgctcctcattaaaatttctaaatatcaaaaaagccttatttaagtaaaagtgagaagggaatttgcatttattatgtggtaggtgctcctgtgtgctaggtactatgctagatacatggcctacattatctcatttaatgttcacacatactccatgagaaagatcttatttccactttacctatgaggtaagtgagagtcagagaggtcggtggcagattttggataagattccaggtctgttgtctacctactctaacagcgtatgacaatctagaaaacagaattagaaaggcccaaaaccttgctagaaatcacagtcatccaaggagttttaaaaacttattctccttcctccaccctctatctcacctcctagcacttcagaatcttctgaactggaggccatcactgtattttgtaagctccccaggggatgatatgcagtcaagtttgaaaagcattgacgtaatgtttgcttctttagacctatggcataaagtatcatctatgggtatgctatagcttctgatgactagtagactgaaacccattctttctcacaaatgtatttttcattcctttaaaactttttttttatttttaatttttgtggatacacggtaggtatatatatttatggaatacatttttgttttttttgagacagactatcactctgttgcccagactgtagtgcagtggtgcgatctcagctcactgccacctccgcctcctgggttcaagtgattcttgtgcttcagccatccgagtagcttggactacaggcgtgcgccaccacacctggctaatttttgtatttttagtagagacagtgtttcactgtgttggccaggctggtctcaaattcctgacctcaagtgatccacctgcctcagcctcccaaagtgctgtgattattgctgtgagccaccatgcccaggctttatggggtatgttttttcacttactcacacaagtctttattatttgctttggtcaatgttacgtgtagggggaggaaagtctaatactagcgttccctcaaattatagttatacctacttggacactgaaaatagattcaagatgatattacaaatttgtacttttaaattacctcagtaaagggcaaattccatctaatccattttatgaatagacctcagtgaaccaaactctttgtacatatacctctgacttttcagttttggaaggaggaacttgcttagaaatacaggtggctatgcttttgtagtaaatgtgccattttttgtttttgttactgtttttcctaagttagtttctgaatttcctttattactatttactgtccacaccaggatatttgaagtaaaaactgtaaataccttctaaaaagacacaaagaatgtgatttcagctcagggagtgtttactgaacatcaggactttgccctgcactgataggagctggggcaggttgcggggaggtggtctgccctccaggaacttcatttttctgttagaggggatccaaaagaaatggaaaacatcagaaaaagacagattttgtttgtttgctttaaccacttcaggctttctaactatcatggggctctgtccctatgtcttatatatgctgagagaatctattgtatgtgcaacctaaaaaataacagaaagcttttactcgtgacttcataacattaacagcaacaaaaatctgtgtaaccttggaagaacaagtgtaaaggccatgagaactagaacaagaatggaaattgcaacatagtggagtgataacccgtacttcccatctgaacactttctgacaaatttacttttttttccccctcactaggacagtggagcattgttttcacatgtgtgatagaatggttatctatttcttcattgctgcttcttatgctccatggtaagatacagtcttcctattttcgaaggtagtgattttatgattagaattcctcactcctcctttcctttctccctcttgtccccaccctcagccctcatgtgtacaccaccttccctcctcctgaacacatacatgcatgcatttttttccccatttgatgtacttgggtcagattgcatatttgaaggggagaatattgctgctgtttataatatctgggtattggattgttcaagaagtgctatgaacttgtgtgcagatagcttgctcactcttgaaatctgtaacctttgctctccatattgtttccctatacctctgctattgttcagaacactagaaaattgaattgttcaagtggaaatgctgtaaatatgtatgaggaaagcaagcttatttatttatttatttatttatttatttatttatttatttatttattttgagatggagtctcacaatctcggctcactgcaacctctgcctcccgagtttaagagattctcctgcctcagcctcctgagtaactgggattacaggcacgtgctaccatgcctggctaatttttgtatttttagtagagacggggtttcaccatgttggccaggctggtcaggaactcctgacctcaagtgatctgcccaccttgatctcccaaagtgctgggattacaggcgtgagccaccgtgcccggcctatttttttattttttgagacagggtctcactctgtctcccaggctggaatgcagtggcgtgatctcagctcactacaatctctgcctcctgggttcaagtgattctcacacctcattctcccaagtagctgggactacagacatgtgccaccacacccagctaatttttgtatttttggggggagacgggatttcactgtgttggccatgcagctcactgcaacctccacctctcagattcaagtgattctcccacctctttctcccaagtagctgggactacaggcgtgtgccaccacaccgagctaatttttgtattttttggtggagataggatttcaccatgttgttgataccaggttggtatcgaactccgaccccaagtgatctgcccgcctctgcctcccaaagtgttgagattacaggcatgagccaccatgcttggccatttttgtttgtttgtttgtttgtttgttttgagacagagtctcactatgttgcccaggctggagtacagtggcagtggcccgtggtctcagctcatgcaacctccacctcccaggttcaagcgattctcctgcctcagcctctcgagtagctgggattataggtgcctgccaccacatctggcttctttgtttgttggttttttgagacagagtctcactctgtcaccaagcctggggtacagaggtgtgatctcagctcactgcaacctctgcctcccagtttcaagtgattctcctgtctcagcctttgagtagctggggctacaggcatgtgccaccatgcctggctagtttttctatttttagtagagacgaggtttcgccatgttacccaggctggtctcaaactcctgacctcaagtgatctgcccacctcagcctcccaaagtgctgggattacaggcgtgagccaccgcacccagcctgtttttgaaacttaagccatttgtcttcaattcacctcaagtgcagtagctactatatagcaagtgtgtttatcatttcttttgctgagtaagagaaccatttaaaatacctagtatcctgttcattgcctttgatctttctgcctttttggtgctgatcaaatataatcttttgttgctttgaaactcttaattaaagaaacattagctttcttctacaagacataatccagttttaaaaactcagaagcttatattttgcaatcatctattgtagtcattagaaacagtatgcctctagattctgactaatgcagcatcaatgattcaaaagaaacctgattatctgaaggagtaaaatgtaagtgctatctttgcccagcatctgactaaattataggtcggcttcatgttggaagaacactgaaaggcttttatgaatggacattaaatgcccagaacaatgcttatttcagtaggaacctacagggtgttccaaacaggattccttacttagttattttaaattctttaatttaaaataagtaaatgaataaaattaatttaaatgtgagctgaggagttaaatatcatagtaggcaatttgtttacctgtagttttagatatgtaggctgtactttttccatttggaaatgtgacttttgtagttatagataatcaggacaacatttgtttcttcctcatttattctttttttttttttttctttgagacggagttttgctcttgttgcccaggctggactggactgcaatggcgcgatcttggctcaccgcaacctctgcctcctgggttcaagagattctcctgcgtcagccttccaagtagctgggattacaggcacgtgccaccatgcccagctaatttttttgtatttttagtagagatggggtttcaccatgttagtcaggctggtctccaacccctgacctcaggtgatccacccatgtcagcttcctaaagtgctgggattacaggtgtgagccaccacacctggcctcatttattttatttattttttttgagacagagtcttgttctgtcacccaggctggagtgcagtggtgcgatctcagctcactgcaacctctacctcctgggttcaagcgattctcctgcctcagcctccctagtagctggaattacaggtgcccaccaccatgcccagctaacttttgtatttttagtagagactgggttccaccatgttggccaggctggtcttgaactcctgacctgaagtgatctgcctgccttggcctcccaaagttctgggattacaggtgtgagccactgttcctgaacttctcatgtattcttaatatgaaattagtacaaatgaatttgcagcattttaaaattcaaacctcacaacagtccatggttaaattctaccaaaatgtcttccataatacatgttaggaataattcttctcatactctctcttggcagagagactgataatggagacacacttggtttgtgtattaggtatccactgtgggtatctgatcctgcgtcaaaattttgttccaggttcttctcattaaggtttgtaagtaatctgctcccaaatacatggtcagaaattaaagggcaagcagttttgacctcattctgcctaatagggtaagttaggcgtcataagagtgctgggactcccttcaacttgtctgcttttagctggttctatttttaaaccatgttgaaactaattcttttttttttttaggtggagtcttgctctgtcgcccagactggagtgcagtggtgcaatctcagctcactgcaacctctgcctcccgggctcaagcaattctcctgcctcagcctcccgagcaacttggattacaggcacatgccaccacacctggctaatttttgtatttttagtagagatggggtttcaccatgttggccaggctgatcttgaactcctgacctcaagtgatccgtctgcctcggcctcccaaagtgctgggattacagatgtgagccaccactcccggcctaattctgagtcttaaaggtcgactgacaaatttgtttttgagttgcttaattttacctaaattgcccaaatgcctgcttgatgtgttgagtgtgttttcttcctgctcttatcctaagactttctcagttttcaatgacacaggttctatgaattcccttcatttatcacttctgttctttgttgtcacgtttacatttttaggttaaatcttcgtgaacttggacccctggcatctcatatgcgttggtttatctggctcatggcagctggaggaaccatttatgtatttctctaccatgaaaagtaagagaaaataatttacatttgatagttttaaaattgactgcctaaatattatctgcactgcaatacaatttacttttatttgtacttcaaaacagtagaaatacatatatagaatatgttatttttaataaatcttcaaaaccatttggtattcattattagtggaaagattgctgtggaaaaacaagagtggtacaggtttggtataatgtagttgaggggacatggtaaccagcccctttggagtccatcagacttcatttctatagcatgaggcaaattggccttattctctgtgattcagtcatcacgtgagaaaaccagccacttgtcaaggtgtctatgaagattggagagaatagatattaagtgctcagtacaatatacctaaataagggcctagagggtattccaaaaagggtatcttgagaaaaaggatgttgggaaggacattggaactcttaatatcctatccctagggcacagctttttagccagttattcatagctgatagtcctaattattgagccatataaaaacaaaagctaattgaaatttagtatctttgctctagaggagaccttcaaggtcccctattccaacttcatgattaaaaagtcagaacatttaggatatgcatcaaattagtgactcatctggaaattaggacccaaacatccaagttctgattccattgctctttttattaccctgtatgtttgaatttgagaaacacacaaccaggaaatctttgtcattgggtttatttacagttcattaaattctgtatctattgtgcttggcagaatggctctcagaattgaacataatttgtgtttatcagaaaatactaaattgttttcccctttcagaagaagaaaatggtagttttcactaacttctttttgtctctgaaattcacttaaatacctttttgaccataattagcaatgctgagtagtgttatatattatagcatatttaagtccaagggaatggtttgcttcttggactcaaatctcttatttatatccttggataaaataggaagtcaagaaaggcaactatcttttctccttttcccggccttctggtgtaaacaaaacccataaacccattcttcccctatctgattatttcatggtaggctttgagtataaaacacgatgaatgaggtatgagtcacccttggccattcagtttggcagacattagggagtacctaaattgtatcaggtactgttctaggatttacagatcaaaacataattaatcttggttcctgcctttgaggagcttatcgtctggtttgattaggctgaaatgtaatttgaatttcaatacaatgtatttcttagggtttttagatcttttgtagtctaacgtgatgagccttaaaattacagtttgtgcaggtgcaaaataaagagacaaacaaaattacacgtcctttccttagggcttgctgttcctttttgctgataaactaggctccaggctgcatctccattcatcttcagaatttcacttctagctctggattggaatggtaatgaaagcagacactctaggatcaaaagaggaaatattttacaaggtggagtgggttaaacgataactacttttggcagaaaacattttcttttttttttcttttctttttttttttttttttgagactgagtctcgctctgtcacccagactggatggagtgcagtggtgcgatctcggctcactgcaagccccgcctcccgggttcacgccattcgggttcacgccattctcctgcctcatctccccgagtagctgggactacaggcgctcgccacgcccagctaattttttgtatttttagtagggacgggtttcaccgtgttaatcaggatggtctcgatctcctgacctcgtgatccgcccgcctcggcttcccaaagtgctgggattacaggcatgagccaccgtgcccggccggcagaaaacattttctaggtggcatgtgggatttgatgccttttcaaccctgagagaaatgctagttccttgttactcagctactgtgttttagttagaggcctagtggttgcctactgagaaataaagttttatttgaatagttaagagtttacatttctttctcaaaagtaaaaaggaaaggctggtatgtaaattgttaggtgttatagaaatttataagttaaattaactgcatttttgttcctgcagatataaggtggttgaactctttttctatctcacaatgggattctctccagccttggtggtgacatcaatggtaagacatggcttcagaattttagttattttcttttaagctgctggaacttaacatgattatggatatgatatgtagcttttctttataaagttatgtccattaaatagaggctcaaaagaaaaagaacttataaataatgaagtgtttagctcggcatggtggcatgtgcctgtggtcccagctacatgggaggctgaggcaggaggattgcttgagcccaggaggttgaggctgtggtgagctgtgttcatgccctacagcctgaggaacagagcgagaccctgtctcaaaaaaataataaaaataatgaagtgtgccagcaactcgtaagcttgcactaggtaccgtgtacagtttgggaaagctataaattcaggtatgtttctgtctttatggtactttcctgaatcagaaccagaataggttcagagaggtatttttcaaatccctttactcttacttttcctttcccttgcttttaagtcgtaagtcaagcactttttttgtttgtttgttctgttttctaaggcaagcacttttttttttcttttactttgcttgaaaatatcttttggggattttcgtgggtaaagtgtaacattacctgtaataggcagttgcatgtatatatttgaattccctttcaaattgaattactgttgagaagtctgtgtgtgtctgtctttttgaaatgaaaatatattattacgacttcatggttccatccacctggttaccagccctttagcttatatattgcagtatcttaggctctaggcactatattaactaaggaggtcccaaggtgtttcgtttgaacccttctgagcctacattgttcagaagaactgtacttaggatttcactcctaatctcataggcacattgtaagaaccttttttttttttttcttttttttgagacaaagtcttgctctgttgcccagctggagtgcagtagagcgatcttggctcactgcaacctccgcctcctgagttcaagtgattctcccacctcagcctcctaagtagctgagattacagatgcgggctgcaacccttggctgattttttgtatttttagtagagatggggtttcaccaagttggctagtctgttcttgaactcctgagctcaggtgatccacctgcctcggcctcccaaagtgctgagattatatgcgtaagccatcacgcctggctgtaagaacataattctgtgatagtttttttcctggtcacagaaacacctataaaaggtttaaaagtttcaaatctggttctgttttttcaggggatgtcttcatgagaatataacaaaatatatttctttgagatacgaggtttatgatggctttaataattacctagcacccaaaatacatatagatggtaaaagcaacagggaatggtaaggaggaggagttaaaggacagaaatgagaaaatcagccttgaaggccatatagttagaaggcatttcaggacaccccaagcaatataagcaaggtttgtgcagcttaatagagtagaatttcaagcaaattccctctgggtatcataagagcaggtttatccagtaattttactagcctaaatttgaaattgacatttccataagtggtacaatagcaggtgactaatgtttgtgataatcaagcaggatgatcccccacactgccttcatagaacttagagtcaagcaggcaaatgcagttcctattaaagaaaaagagatcatgaaatttgataaaatatttgatgggggaaagttcaggctgctatgcgaacacgacagaagtaccagaggaagtgatatttcagctgatttggaaaaacatgtagaagctgagagatggtaggggtgaggcaagtgttacaggtagagaatacagcatgaaggaagcccagagaagggggaagcaccagcatctttggagaaatgaaaatagctcattgtttgtaacataaaatacatgtaccagcttgagttatgtacatatgcatggtgggggcaggtatgcaggtagcacaagtcttgtaataaagctggagagctagacaagagtccagatcacaaaggacctcaaaagccactaacacagtaacagaatgaatgaaaatgcgaatctttggttctggccagaatcatgggtctcagacttacccttctgccataaagaactgtaaaactagaaaaagaataaaggcaactgtttttttggctctgaacccaaacagtacaggactgtgatccttgaaggaagagaaaccaagaaaatgagctttgaattcaccccagtagtttccctggagacactttccaaacagcaacaaaaggaggtaaagcccagagaacagcagcctgggtggaggaaacagaaattacagttcaggttactgacatggctgcagtttgtggggcagggtatggaagaggaggaagccgctcagggaggatgcttcagaaatccatgaagcagtttccgtgagtcgttgtccagatatcaagctgaatgttgtacgggccaaaactctgcaagctccagttgcaaataactcttagaaggctggaagataaatggaaattccggacagttcccagtgctgaaagacattgaagttccaaccaagcagagttcagagatggtgctggacatcccaggcactcagctgaccctgccaaggccacagcttaggagtagagctactctatccctagagggagggctactctagaactgccataacaaggcccagacaaaccttgaaaggataaaattgatcctccagtaaataaaccgcctaacagaacaaaactcaacaatttttaaaggaatacaacagaatctttactgtaacaacttagcatgtaccataagtaaatattatcagaaataaatcaataataatgtaataaaataaataataaatatataataaatattaccagatgggcaagaaactggaaagtgacacatacctaagggaaaacagatcaatagacacagatcaaaagacgggagagatactgagattcacacacagggagtttaaaacagatgaggaatctcagaaaatacctggagactatgaagaagaatccacatggagattctagatccgaaaactgtgatgtcttaagaaaaaaaaattattggagggatttaataacagattggatattgcagaagcaaagttcagtgaacttgaagccaggtctgtagaaactatacaaactgaagcatgagagaaaagagtgatttaaaaatgaacaaaagaagaaagaaattggggcagttttttgttttgggttttctgttttacagtttttcttttctttttttttttttttttttgaagaaataatagttacaacttttccaaatttgatgaaaaatatcaacctagagatccacaaagcacgaggaggcctgagcagtataaacacaaagaaaactacactaagacacattaaagtcaaattactaaaaaacaaaggcaaagacaagaccttaaaatcagccagagagagaaaaaagagcaaggagagaagatgaccactgacattttatcagaattcatgggagcaggaatacaatgtaatggcacatttaaaatgctgaaagggtccgggtgctgtggctcacgcatgtaatcccagcacgttggaggctgaggcgggtggatcatgtgaagtcaggagttcaagaccagcctggccaacatggtgaaaccctgtctctactaaaaatacaaaaattagctgaatgtgatggcagaactcctgtaatcccagctactcgagaggctgaggctgaggcaggaaaatcgcctgaacccaagaggtggaggttgtaggaggttgtagtgagctgaggtcgggccactgcactccagcctaggcaacaacatgagactccatctcaaaaataaataaaataaaataaataaataaataaaatgcggaaaggaaaaaacaaaaaaaccctatcaacttcaagttgaagttagcacagtttagtaatattaatgtcaaaaatttaaccagggaggccaaggcaggcagatcacttgaggtcaggagttcgagaccagcctagccgacatggcaaaacccgtctctactaaaaatacaaaaattagctgggcgtggtggtgggcacctgtagtcccagctacttgggaggctgaggcaggagaatcactggaacacgggaggcagaggttacagtgagccaagatcgtgccactgcactccagcctgggcaacggagcaagatgctgtctctaaataaataaataaataaaccaggattgctagaaatgatgaatttgtatgtaaatacatggctgtttttcatttcttaatttcttcacaagataacatgggggtttctaacatgtagaagtaaagtacatggtaacaatggatggggtggagaaatagaagcacattgttttaagggtcttaaccttgtatagggggtataataataaaggtacattgtgatgagctaaggatgcacactgtaatccgtagaataaccaccactggccaggcgcggtggctcacgcctgtaatcccagcactttgggaggccgaggtgggtggatcacgaggtcaggagttcgagaccagcctgaccgacatgatgaaaccccatctctactaaaaatacaaaaattagccaggtgtggtggcacacgcctgtaatcccatctacttgggaggctgaggcaggagaatccacttgaacctgggaggcggagtttgcagtgagctgagatcatgcactgcactccagcctgggcaacagaacaagactccatctcagaaaaaaaaaagaataaccaccaccaccaccaacaacaacaaaagcaaaataaatgttatagttaagtagtcaagagaaaagataaaatggaatcccaaagttattcaatttagtctaaagcaggtgggaaaattggaaaacggaaacaaaggatggatgaaaccaaatagaaaacagagagcaagacgggaggcttcaatacaaccatatcagtaattaggtacctcatatataataacaattacatcacaatggactgaacactccaactaaaaggcagagattgtcagactggataaaaaagttttctcatctgtataatggagataatagtacctaatttagggtcgttgtgaagattaaatgaataaatatatgaagtgcttcaaacagtgcctggcacatagttacaataatgataatgataatgaaaaaaaaattctgttttgatacagaattaactatgttctaggtctttgaaagttgaggtaaatgtggtatcttgaggatactagttaacagaatgcatgtcaaaactaacctgcgtacttggtttggtgtcttgcttgttttggcagaaaggaaaaaaaaggatattttgtaacagtgactggccatgtgattttgttcaggccacttcactgctctggccttagtctcctcacctctgcaataagggggttgtgttagatgagtgactcttactatttgggagtccctgtgcccctttgcgaatctgatgagagccttacccctatcctagaagagggctcctaatacacacacaaatacttttgtataatgtgtattcattgctgtataaccttgaggaattaataacgtgtggtattttgtctttgtttttactttttaaataaaaataaatctagctgaagtcctttcttaccaaggttaggaagaaatccaatgtcagtccatttggattggctccttccccatcttttgatcccacacaaaacatgggggcttctgtgaactttgaaaaaggactgaagctcacagctggccctagatcctcacacctggtccttagctcatgatggtctattgttgccttgcttttagccgagggccttggggcccattctaatcaggtgcctgagttagagcttccctttactcttgcggggcacacaaggctgctgcccagtgcccaggcctctaggacacccacacacctatccccttccaaggccctgccgtgatctgccttaggtttccattcactctgcagaacctgtctcctttctattcctagtcctcagaaatccaggggactaacttgtttcttcatcagcttctaagcattgcctctattctctctcctcattcatacaagccattttaatcttgtagatgggccttggtctttgaaaaccaagaacagcctaaaaaattctcccttctgccctaagacacacaagaatattaacttattgctaagctaagcaatggccaggctcgaatacaaaaaggcctggagacatctagaaggctaggaaatatcttgtactatgtgatctgtgatttcagaggtcacttctagttacggttttcctgtgtcagccttaaggaatctataagctcacataagcaggggaagtctcaaagcagcaatcagtgtagaacagtgtttgagaaggacaaagggaagtaaataccctgcctgagatgtaaattataaatagagtggcttgggcctgccttagtagggaaggaagcatttaaaggggaagatgagaacagaggattgcactttattaaaatgaactcccatgtctggctatgattgcagtttgcttaaatatgctgtaaatgagcagaatgttctgctttttcatttgggacctgtaatgtgattgcttgctcaactcaagagtgtcagtccaaagggcaatccaggtcgatgtataagagactttttttatgtttggttcatgtttacagatcaggattgtgttcacacagcttcttcattgtctagaaaatcaagagccttagagagaattacagttatctgtagcttgccatgcagagtaacatcaaaccctttttatttttttttctctgttgacagaacaacaccgatggacttcaggaacttgcctgtgggggcttaatttattgcttgggagttgtgttcttcaagagtgatggcatcattccatttgcccacgccatctggcacctgtttgtggccacggcagctgcagtgcattactacgccatttggaaatacctttaccgaagtcctacggactttatgcggcatttatgaccaatctgtactaattctccaaaccagtattatttcaattatggcacttgggagtggggtgagagctaaacattgcacagggaaagaaaaaaaataactgcactgactttatatcttttgaatataattactgtgaaagtataaaggctgtgttctggaattttctgcctcacagcaaataaataaggtagtgaattaattattcattccattccactatcatgaaggactctgaatagacttggccaactgatgtttacaaaccagacttttatattttaattttacagattttactacatgatttttctaaattactatgtcaggttgtaaaagtcagtgcaataacaaaccttcctttttaagaagaaaattgtttctattactttcccattcactaggtaaagaatcatggacagaacttacactactttttaccatgtttcatcttggcataacatggttcttttttaaatagaaactttagttttttgtaaatttttaaaaaaatatttcattgatatgcatctctgcaggtcctcattcatgttgtaaatttttgcagcaagcagtcaacattccacaaacgaacaaacattatacctcttctgatagttttattaagcatggagaaattgccaatttttaaaaactgcagttttccaaacttttctgccaacctcttactctgaattcagtgctgctttgggacatatacttgacctagcttggtttaccagtgatggaaaagtattttgatatcattaactttttcaaaagatccaactttttctctatgcctttgccacattctcttcagggtctctttccacagtggataaatgttttttctgtattatgacagtattgttgtgatggccatctgctggaaactcctgaagagcattatgtattacagtgagcagttgtattgcctgtttggtgcccaatggttaagtcattgtcacttagctttatattgtcagtttgatatttattttaaattgtggaactagatgcataaattcacatttctgcctttcctttgcatcttctcatatattgtgttttttttttttttcctagaaaaaatatttaaagcattgtttgacaggtagaaactcatgtatctgtagtccatgagttatatcctggctcagtggagtgatatttatgtattatttttacttttctctcagtgtcttatattaagattaacatgttgttaatagttgctttgttgattaatctctcttgttggtgttttaataaatgaaataggcttgcctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggaatgagaaacagaagaagtggtatttgctggcgagttaaataggcaaggtacccagtgataacaccaaccaaaccactcctatctgcatgattctgaacatctggatgcctgttgttttactgtgtatattttatttttaatatattaactttgtggattcatttaaggtctactcaaaagtaacactgtcaaaaccactaatatgtatgtaaaaattgtgctgtatactacaataaagttgttacttggatttgttccactgtctctaaattagatgactgtgaagaaaaatgaatacaccctgtcacttagaactttctagtctactttttaataattgaaatgccagagtcagctcaaacattaatcaacagacattttcagtttaaaatacactagtcaggacctaatgatttcaagttttttagatgatgcatccttaccaaggtaagccttttggtttagcatatttaatattctataggactgaggtgacagtcttttatgttaccaaccagacaagtagcagattataaatcttaacaactctcctagtgttagatgccattctacctcttctgtagtgtgggaaaccagggccagagaagttcaactgcttcatcctaaatcagggagctggaacagcaaccagctctatctgattccgaagcctcccattgactataccactgcatttctagagtcagcaaaaacaaataaaaaaacttgaactaaaaattcatcaggcatggacacagaaaagaaaacactattcacatggtttagaacctcaataatccctcagataactctctgtcaaatctaattttgaagattgagtgtcttgaagcgttatgattcccaagagttctgtcctttaggtcaccagtgtgacctcatccatttctagagtgtccccactattgtgctgtcagcttcttggtcagtatcttcagccttaaactattttctaaggactagacctctctctagtcaactgcctaaatgctcccagacatattgactcaaaccgtcccaaactgatttcattatctttcctcatcctaccaccaaacctattttctgaaatttcctaacttagttaatggcatggccacagccatctgttcattcatgcatccttgatttcttgcaccccccagatgcaacaggtcagccagaactgtcacccctgcctttctcacaactccctggtctggttcctcacctctcttcacactgcagggtcctaaaaagacctacttagcactcatcagactacagcagccacctcctcatttgtatccctgccactgcttacacccctcaaatgagctcatcctccacactgtaccagcattatcttcccaaaataaaatctgagcatgtgtctcgatgctccaaaacttccactgactattatcctataagattcacgccagatgctttagcatggactcttcacatgctgactccgcctgatcggccctctccccagctgaaccccacttgacatcagccctgctagtgattttcacagcctcccccacaacacacatgccctcatggtgcttttgcagctgtgtttttgtacctgctgttccttggcctggaatgcccttactccagcccctttcctacctggcaaatagttgcttattccaagccttcatcaggtgccacccatctcccttgtgccattgaccaagttccccctggcatgagtagtagtgccctcctttgaccccatggcacagatattccttcatggcccctgtcatggtgcattgtgattgtgtttactgtctttacctctggtcttgggactgacctccttcaggcagggacagagtctcatccacttctgttcctagcttctagcatagcactggcttatgacaagagtgaagaagttttgttgaatgaaaggggcagggtcgggggaaggttggagaatgttgctgtggaagggaaagactgagaataaagcattttttaggacagactttggttttagcaggtttatcctgtccatcacaagcactcttactagctggaaactgacttttagcttcttaggccttagaggcttttttgaccacaagggtcagctagaacattcgtggcaaccacaggaaagttgatgagaaaatagagtgtaaatattagaaaatatgtcctaaagaagaaaatgtccagcatttttattggtgctttcctagaaataacaatttacaaaattattttgagagaaaaaa

SEQ ID NO: 12705 - DNA, 271134 bp, Human
  misc_feature (1)...(271134): n = A,T,C or G
agctaactaatgcctgatgatctgaggtggaacagtttcaccccgaaaccatcccccatctccccttccccatctgtggaaaaaaactgtcttccacgaaactcgtccacggtgccaaaaaggtgggggaccgctggattagggggaatgtctgaagaaaaggaagtcctagtggtgaaaaaggcaccactgaaggcaaaaatgttcaattctttcctcaaaacaccaaagaaactaatataacttttcttgcagctattctggtaaacgaaaaacccttgtttttgaaataagatatatctgttctttaaaaatgcttattcttttataattataaaagtaacagccattggaatactcgagaacgttgtaacaatacagaacacttaaaacagtttaaagacaatgaaaagcagtagaatcccactattctgaacaaaaaaaattgcatttttttcgaattgttcagtggctgtgcaactgggagtacatgcattttcatatatactacatgtatacacgcacactgcatttgttttactttttcatttaacatcaaaattaattttttttttttgagacaaggtcttgctctgttgcccgggctggagcacagcagtgtgatcatagctcactgcagcctctacctctctggctccagcgttcctcctggtgcagcctcccaagtagttgggaccacaggtgtgcgctaccacaccaccatgcccaactacttaaataccttttttttttttttttttttggtaaagatggcgtctcaaactcctggcctccagcaatcctcctgcctcagcctctcaaagtgttgggattacaggagtgagccatcatgccaagtaagttatttcttcacactaaacattcttcagctcttagttgcagagtatttctagcatgtgaaacttcatacaatcaaccacaaaacacagacaaatcagtatgtatcaaaaagaagtaactgaaaaacacaaaatattgtctttgacagaatgactattttttcagacccttaatagtgaccaggccttcgcaagcctagaagggactcctgggggtgttttcatgaaaggcctgtggaaccgacttggtatagcctcatagcaataacaaacagtttaggtatcattttgtccaggggaaatacaaattacaaaatcaaagctagagcctttttagtgttgtatgcctggcaacacacctcattctacactatagcactgctaagcctcctgccctccttacagtccagaccacatgaaaacaaagtggtaactaaatccatgcaagaagctgggtgaaagcctcctttctgtgggtgctaatctgaagttccctccctcatctgagacgacctgcccattttggcagaacatgtgttaagccaaaatctcacacagatgaactcccaagtcactcacctcgctccaaccactttacatttagtttgagaatgtcacaggaacaaatgtcatctcctatgatttgagaaacaagaataatacaacaccaccattaagtccacctacactgccttaatggtgctgttggtgccttgctcccgtattttggccgctgcaaaatgggcttaaatatgtttgtaaatacataacttaatattgaattcatcttccctattccgcgcattttgagaactgtgcttagttttcactttggacgaatagcaacccttctgatggccgtcatgacaatgtctccaataaaaactgacagtctagctggctgcaaggcaggtcctcttctatcttactgggcactgctaaactgcgaagtcggggcgacacggcagcaactttaaaatcaaaccgcatccccaagggctcggcgtgttttttggcctctgcagcttcacgtacttcgtacgacaggagcgcacttgttctctgtccgagaacttcgtcccgagagaacctcaggaactcgccgggccacaccccctgtccagggaaggaacacgcccccggtgacagccggtacggccccgggtttgggcaacctcgattacgggcggcctccagccccgccagcagcgccccgcgcccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcgggtaagcactggccacacggaaggcgcgggcggcgacgctgcgcatgcgcgcctttgcccggcggcagcgcgcccgctgcccggaaggaagccgtgggctggcctcgggcgggtcgcggggtgggggtctgcgcaggcgcgaaggggcgccggcagtggccggggagacgctggggtccactgacgtccctttgtctttgtttggctcgtcatcttctggagccaaactgggcattctgaaggaatctagtgcatcggtctcacttacccggagtgcataccgtcgcggccccaagttttgggcaggaaatgtgccgctggggtctggccttgctcgcgggcgcccgcggcgctgtgcctgcgccctcctttcttgtctcctctgcgccggccgccgggacccagggcacctgcagcggggctggtgcgagtgttgtcccgggaaatgccggaatgagacgagacgatgaaaaccttaagtgtggaactgcgtctcaggccagtgttctggctgaaagagtcacccctagtcacccctcgtgccctaggtcggccccgctgtccccaggggcaggggctgccgtatgctgggtcagcttaaagcgatgctccacaaacttggacaactttctagtcgttctcacatcagtactttgggaaaatacaataagggtgaaatactagaaaaatgttcacgtgcttcgatgccatgtaatggtaaactgctataaaagttttcaaaatcttggcaatttctgctgcagacagcacgcgtttcccagaacgagggccacacgttaatattaccttagtgcagcgcttctcagagtgcccccacctgccgcagcagcagcagcatcaccacctgggtgggcgttcccccattactgaatcggagactctgggggtggagcccaacaatctctaaaacaagtcctccaggtgattgtaatgtacgctgtagcttgtaaaccactgccttagagctgttggaggattaagtgatgtttaatctacacatggctcaatgccagagaaattcagcatttaaaaaatttccttagaagtttctttttcttttccttcaagaattgttgaggataggaggaggtcatattgagagtttgtcatctcgtagaataatcagtatgagattagaaaaggtagaggttttttggattagaggcagtttagaaattgtgtgactggcttattattaatcgaattagcagtttctgtttcctggtttccccatcatttcacctgctactcagccgtaaaagtttatttttgattcaaatgcagagattgagttttgaaacaaatctagattagtaaacatctatacttatatatagatttataaaatataaccagattatctaaaacttataaatgcatcttaaaattttttctttcttttacaggcaggaatttatacgtgcatgtttaaaggcgatacttttcaaatgccagacttcctcagcttgtgctatacttcccgttcacacactgccgtgtctttgctatgccctcccatacaccaaaaaaaaaaaaaaaaaaaaaaaaccccaaataatccaaaaactcttgttcagatttccaaactggttcaaggtcaagatggaccaaaatttactttggctttatcttaaccaaagtcttcccaatcagtttcctaatatgtaaatgacatttttggtaaaagatgagcaaacatttcagaaatgagccaacaatttttttcttatccccatcataacttttaactgcaaaacctcaggacctggttcttttccaggctctgctgtctccatatagctgtgagtgtttttggtacaccaacacatctctgtatctgggccagtaaacttttttttttttttttggtgtagggccaagcctacaatgcatatgtccttattgttcatctgttgtaactttttccacaaaaagtgtgtgaaatttagattgtggacgttccagtctccacttctgagccttgagaggttgctgaaagccctgactggctccagaaatgggcagtgttacctcttcagtgggtttcagtagctgtaaacttgaaacttaaggatttagtattgttctgaatgtggaattcacctccactgcaacttggatcctgtttaacaactcctcccttctctatattacctccatccatgtctgttcttatttgtaccctgaccctcaaaagttgcgtgacaaaagcatcaccttttgactgcagaaggcctgtttctttagtgcgtttagataagcctagtatcaggtgtgtaccattaccaaatacttgaggtgttaaggattaccatcttagcgttcatcctaccatttttatattcttaaggacaattccacccttttacacactgtgaccaagatttccaccttgcaagaaggaaagagtcaaaccttcaaagtttttcagtgtttaatttatcccaggctacctaaaatggatcaaaacatgaacaggcctacttgggtgagtggtgaaaactgaacctgccctggactgcctcatttgcagcctgctgtgttcaggttagggggcatctgggcagtgctggctggctggtagggcacacggcaatgtgtcttgccctgtatgtggagatggtctcattgtgcttcagtgcctgaccaccaagcaatactctgagaacttgggaatgagggacaaggggaattcatacttgttgaagtgtattggtattgtattgttcaaaataggctgcaggtagaaggctcataattaaaacctcagagtgccttccattttgttaagatgtgggttccttacagtcagaactgatcttatttccggtgaattattgtaattattgtaaaagtccaatatggtttggttttgtgtcctcacctaaatctcatttcgaattgtaattcccacctgttggaggaggggcctggtgagaggtgattgaaacatgcggggggtggactttccccttgctgttctcgtgagagtgaatgaattctcacgagatctgattatttaaaagtgtgtagcttgcccctttgcgctctctcgttctctcctgctcctttgtgtggagatgtgccagcttcctcttctgccatgattgtaagtttcctgaggcctccctggccatgctttctgtacaggctgtgaaactgtgagctaattaaacctctcttctttataagttaccttgtctcaggtagttctttatagcagtgtgaaaacagactaacacaaaggccgtctttcatgtggaacttgtttttgcgtattggaaacattgctaatctgtgtttgggaatgaatcttacctttttatagagtatcagtgggatcaggtgtttgggatttggagctgtcctttaaaataactttgacaagtttgattctatcttggctttcttgcgtttacattcttagtgttcattgtatttttttgttacagtgctttttttgggcactaacatgttaaaaacagatgtagagcaccatcagaaggtattctcttttaagaactttaaatagaaaaaaacagtagaacaatgtattaatccaaaaggtggctctttgaaaaaaaattgaactacactaatgacatttgtaaacaatgaggtagtctcaagaaaaagatgaaagtacaaatatacaaaataagtcctgagaagaggagatcataaaaacagataatttgaagaatgttaggagactactgaactcttttaaaataaactttaaaactttgatgaaaatgataatttttaggaaaatataagtaatccagattgaccccagaagaggtagaaaatttaagcaggttgatttttatagaagaaataaagctatgaaagagttacctcctctcaaagcattgtctagtttcaccaagattatctaccaaatatttaaagagcagataattccagagcaggaataaatggctatttccttgacatagcatatctatttgaacccaaaagcccattttaggcttaatgaagaaacgttgagatttccactgatgttcagaccaagacgaggagtgagaacagcctagtaccttttacagtgtgcactgttagcaaaattttggtgttatcttagttttaatcccacctttaaaaataaattctaccttttttgtattaaggaaacttccacctttttattaagtgtgatctagtcgttgatttatactttgtaagaaggtaagattcaaacctttaaacttcttaatgtttaatttctcccaggccacctaaattggattataacatgaattggcctactttgaatgatagattattattttacattgtaggtacagccagtgtgatcagacaaagcaattcgagaactacaaaagaggaaaaaagatcagaagttcttaaatacataagggaatgcagcatttgataaaggtggtatctcaagtcagtggggaaaaggtgaaatattcaataaatggtattgggacaactgggtagccatatggaaaaaaaggttggatctctacaccgtaagccaggataaatttcagtgtttgatggaataaattccagatatatgatgataatagctcacacttgttaagtgtcttgtatgccaggcactgtagtaatttactaatgcatttaatccttacggtaacccaaagaagtagtaactgttatcaccacttatagatgtggaaactgaggcccgtagatgttaggcagtttaaacaacatacattgctaataagtagtggagctgggatatgaacgtagtcagtttggctatagagttgctggccttaactcctatactctttttccatttaggttattgttaaaaatgaaacagtatgagaacagaatgtttttataatctgggtgtgaggaaagccatgacttaaccatgacttgaaaatcggaaaacgtaagactgataaattagattatatcacagtaaaaagactgataaattagatcatatcacagtaaaattcttctgcatggcaaaaatcatcataagcaaagccaaaagacaaacgatggtaaatagttgcaattcatatcataggtgaaggaccaatctttttaattatataagaagcttctagaaataaaaacaccaacatccattggcaagatagacgttaggttatgaacagaccgtttacagaaaagtacaattggcttttaagcatataaaaagatgctcaacttcacttataatgagaatgcaaataccatttttcatgtttcagactggcagaaatccagaactttgacgatacactgtgttggtaaattcttaaggaaaaatacactcttgtacatggctggcaagagtataaattggctcaactcctatggaaggcaatttggttgtatctatcaaaaattcaaatgcatataccttttgacccaggaattcaatttatgggaatttatcgtctggacataactgctatgcatgccaaatgatgactgcaccaggttattcactacagctttgtttgcaatagcacaagactggaaacaacccaggtgcctatcagtagtggctagttacataaattacagttcattgtcacaatggatatgcagctgtaaaaaagaatgtggaacatctgtgtgaatgggtatggagggattgccaagatgtagcattaagtgaaaaaagcaaagtctcaacagtgtatatatacagtatgctaacttttctgtgaacagaagggaaaataatatgtatagagtaactttgaaaggatagctaagaaattaatggctgaggagggggctgtgtaatgaggatggatggaagacatagacttttgatgcttttttgtaacttgcttcttgtaatgtgactgcatttgtgaattacataactccactttgaagatgatctgtctcgctgtttttagtctaattgaccacctttctgtcatcttttgtcatacttacttgaagtttttttttttttcaattttgctctttcttgtcaagtacatcttttttctgcaacttgcttttgtaatcaaaatctacattttggcgtgattgaaaaatcaaaatttagagagtgaaatcggaataagttaatccaagtcattttacatttcataaatattcatttttattgaagcatcaattgtgatggcatcatttatacaaagaacagatctttgaggacaaattccttccgctattatgtagaaggcattatgtgtatttcttgtattgtgagtgatgtacgttgatttttaaaagaaaatgatagaaaacagttttccttttagaaaagttttccccaatgtgtgattaatttctaaattgtaggatacagaattgttatttcccctctttgcatcctgcccagagctctttgattttacaacctgttccagaacgtttagtgtttccctgaagtccctgggatgagggtattctgtacctcccacaatgtgatccttacctgctttcccagtctttttctccactgtgtccctgtagaaccccatcttctgcctaatgtgtttcacttttctgcctctgtattgctcacacgaccatacccatagcgtggattgcacacttggatctttttacttagtcattcattaaatgtctattaaaggcctgcttaggaaagacctgtattgtccatatatccttatcttcaaggaagcatccttgaaatttgccctgctctaattccccttctcccggaaacccatcctttttctctccaacctaagtgatctccttcttctctactggacaaatagctatgtactactttatgaatcctttctatggcatcttgcgttgctaattagatgtcttattgcacggaactcgcacaatctgtctcatctccccacgtagtgagctcacagcacttcaccaagagtgctgcccaccaagaactcacagcacttcaccaagagtgcagtcaatagtgttttatgaacgttgggaagaatatggttaatgcctgagaacaaagaccagaaatgtcatcttttcgtgtgaccatcatgatacagagaagttaacagagctgccccattgtccatggggcatgttccgagtttttccagtagtggtgatagattttggctgatttctctgaacttttccctgagttatttttgtgactttggccaggatgaagggtggggaacccctcatctttaaatctctgagcagagacttgctaggcatctgcagcagtggtggggaagaggtcattaagctcagtgcagtccacgtggggccttggcctgcgatcttcaggctcaggagttattgtgagcccctgcgttgggtgggggaagggaggaaaggaggacagctgaggcaaggagtgggagcctggctgggggaggagacatcagcctggggcatgggtcttatgagggtgagtggccgccaggccctcagcaaggaccagagtggaagcctctttgctaagcttggtctggctcctgcatgggtcccagcagcgtgccatcaatcatccgttcctccttggcagatggccaggctccttcccatgcagcagcagcagcagctggctggccctgccctcctgtttcagctgacatcggcaaccctctggggatgtatggaagactgaattctacaagagatgctttcaggatgtcagtgcatgatgaatgaaagttgtggatcttctacatgctgctcttatcttcctcacatcataaactccaagtttgagagcatcacaatattcatcgatatgtagcactacacaatgaactgagggcaggaattgacttactctttgtacccggaacacagtaagctgatgataaatacttgttgaaagactgtagcatataacctgttgagttgtttgagaggccagggttcctctgagcagtatcatgccaacagacacacgcatgttatgtattatggcacataatcggtaagtccataactgttggagtaatggggacgagcacagtgcactgaagggtacaggaagcatcggggtttgggggctccggcctacatttgtggttatgttactggtttttcctatcgcatcagaaaactttattaactagatggaatttctgcagccagatgaaaatgtatgtgataggagtggatcgtgtgataggagtggatcgtgttagctgcgtgagattgctagtgaggcactgagttgtcatcaggtagcaattccaccatttccactggaattccttagcacattttaagctaaaagaggtaagaagtcagaagggtaagagtctggccatggctttgctttcttctctcacgcttccaaccaccctcgtctgaaagctacatttcaccttgtgaaagttctgcccttctgtttccaaatacaagatgctgtaagcctgaactcagatctaaaaccaaacttagcattttgtttccaaaagattgactacatattttaatttcccaacctctctcagtggcactgctctcctctcaaatcccagaagccgcagtcagggtcatctttgagccttacctctacatttgagttgtccttcctcccatgagtcccgatgacttcttttcttcattggtctctgatctgtcttcactctcccctgcctgagctgttcagagcattatcaacatctacctaaaatttgaatttcattctctcactgtttagggaacagcagcgacttggacctgtccaatgacactcttcaatgctggacacttgctgtaatttgctgctggcctcagtgtttcagatctccacttccaccccgaggctggctcctgctctgagctccttccttgcaggttgctatggtctgaatgcctatgtgcccctactgaattcatgttgaaatcctcacccccccaggtgatgggggattatgaggtgggggctttgggaggtgattagtcatgagggtggaacacgcatgagtgggattagtgcccttgtaaaagagaccccagataactagctagtcttttcggccatgtgaggacatggtgagaaggcgctgtccgtgaaccagaatttgggctctcaccagacactgaacctgctagcgctttgatcttggacttccagtctccagtattgtgagaaagaagctcctattattgataagctgccaggttatggtaaattgttatagcagtctggcggactgagacacaggatgttttttccttgcagccctgtctaaaacatcttggggctttcaaggctaaacttggcttcttccacttctctgccgccccttggggctgtttcagcttagattgctcttagagttggagctggaactagggctttggggctctgttttgtgctttcattccagtgtctctccttggggagatgaaggtagaatccctttcctgtatttggtgcttggtggtagtcatttcccccgctgtgttttcggaactcctagcctggttatagaagctgctggcatgatcagagttctcagattccagctgctttctcctggatatcctatcaaaatgccctctccgttcagtgagatactcgatgactttgactcatgatgccaaatgattgatttttccttcaccagagacctgcgtgtcctctgggtcagctggtacctcttctgtaagctcgggctcttatgaaaggggacataggcttttgcccaatttttttttttttaaaggcatggtttcttgtatttctgtaggaattttgtatcctttcatggaagtgcatctgtagtgtttctcagcagggtatattcctaatccactaacttgttgaacaagtatattaaattggcatcatgatacagcgaaggctagtaataatgaaacaggaagaaatgtggtgacagtatatttagatgattataaatacattaaaatacaaaatttaggaacatcggatgtcttcccagagcatgtttataaaatgaattctttcaaagatgttaccataggaaagtaatactagtgttgaattttcctttaaaaagttttcgtattttacctttgatttaaaaaaattagtttaccattaggtattttatactttgcataggtcaaaagtcatgtgcaaaattaaaaagcatggttcagatgaggccacaaattattctttggcctgctgaaaagatctgatattttaacagattgtacccagaagggaagagtcatgaaaatgaaatactttgagggaattcatagctttccacgtggggaaaatgagacctgaagtaaaaaattttgaatgcactgttgttagcagttgaaaaccgcgtaagagtttgcagaatggaatggtaggctgtcacagagcccccgagaaggcattgcattgctgaaaactccattgccttacctcttcctgagaggcagtttacaaagagccacctcatctaccagtgagccctctgcagggacttctgctggtccctggggtgtctggcttaccattcagcattcctcacaccccgagatgtgtgcatcagcatgaaggagtgcttctcagagccccagggtgtccaggtggtcctgataacagagggcactcaggcagtctgtccctgctagccccatgcaggttgctgggaaagcacctgacaccaggagtagaaacttcacctggtggcccatcctcagaatgtaagaggggtttcaggagcccactctagataacttaaaaaatgttttttttcttcaggcttatgctcatactaacaagctctgtcgaattatttcaatgtgcggaataaaaggcaagaattattttctggtgcagtttagaccttggatgagtagggttatgcagctgtttgctgcagtagttttggggagacacacacctgacttaagctatgtgaatttggatatgaagttccaagtgtaagatatgaaccaaaggatttctcttaacgtaacgatggaactcaagcctgaactatttttgttcattaacaacctggcagttattttttcagaataaggagatttatgaaagagctgaagtctgggcttcattttgcgtgtacatttgcttccgctgttgccggatggttggtaaaggaaattgatagagtttttaaagtgaggactgtattgtttactttatgtgttgttttaaagtaggaaggaacacagtcgccctgctatcagcctctggtttcttgtcccagtggcgctaagagtcaactcttctgcctgacagtgcctgctcctaccgtgcctgtgctgagatagctcctcctggcttcagggcctttatggctgaaacttcaattatatatataaaatatataaaataattattaatataacttaatataataatatataataacttttttgagacggagtcttgctctgtcggccaggctggagtgcagtggcatgatctcggctcactgcaccctccgtctcccggattcaagcgattctccatacctcagcctcttgagtagctgggattacaggcgcccagcagggtttccccatgttggccaggctggtcttgaactcctgacctcaggagatccacctgccttggcctcccagagtgctgggattacaggcgtgagcccctctgcccggccaactttgtatttttgctcaaagtttgatctgtacattttgaatcatttttatcctttttccaatttcccaactaaccaatgttcagacccgagaaagcattctccaaaacctttctctgtattcataaaatcatacacacacacgcacaattgttggttttttataaaaatggaccagattgtattttctgtatcttgcttttcttgcttaatagtacatcataatatctccagttcagctgatatatctgtttttctttttttgagacggagtttcactgttgttacccatgctggagtgcaatggcgcgatctctgctcactgcaacctctgcctcccagcttcaagtgattgttctgcctcagccttccgagtagatgggattacaggcatccgtcaccagacctagctatttttttgtatttttagtagagactggtttctaccatgttggccgggctggtctcgaactcctgacctcaggtgatccgcctacctcaccctcccaaagtgctgggattacaggtgtgagctgctgcacctggctcagctggtatatctttagtatgttcttttatcttaaatgacttttttttttttttcgagcagttttaggtttacagaaaaattgagtggaaagtacagagttcccatacacactcctccctgagtttcccctgttaacgtcttgctttagttacaattgatgagccaatatagatacattattattaactaaagtctgtagtttacattagagttcatttttgctatcatccagtctgtgggttttgacagatgcatgatgatatgtacctaccattgcagtatcagaacagaatgccttcactgccttaaaagtcctctgtgctttacctatttgtccatctcccccttcccaagaaccccttgcaaccactgaactttttttattgtctccatagtctttgctttttccagaatgtcgtatatttggaattatatagtatatagccttttcggttggcttctttcacttaacaatatgatttgaggaaccttcatgtcttttcctggttggatagccaaatttctttttattatcaataatattccattgtatggatgtaccacagttgatccattcacctactgaataaatatgtgcatcacttacatggggatctataattgttttggcagttatgaataaagcctctattaaaatttttattcaagtttttgtgtggtcataagttttcaactcatttgggtaaatgcccaaaagtgtgatttctgggttgtatggtatatgtagttccataacaaactgccaaattgtcttctgtaccattttgcattgccaccagcaataaatgagggttcctcttgctccacatccttcccggcagttgttgttatcagtgctttggattttagctattccacagacatttagtgggatctcattgttttaatttgcaattcccaaatgatatatgctgatgaagatctttcctgagcttatttgccatattatgttttctttggtgatgtgtctgttcaaatcttttgcccatatttcagttgggttgttttcttactgagttttttttttttttttttttttttttggagacagtcttacactattgcccaggctggagtgcagtggtgcgatcttggctcaccacaacctctgcctcccaggcccgagtgatactcatgcgtcagcttcctgggtagctgggactacaggcatgtgccaccatgcctgactgatttttggatttttagtagacatggggtttcgctgtgtttgccaggctgatgtcgaacttttgacctcaagcagactgcccgccttggtctctcaaagtgctgagattacaggtgtgagccaccatgagtggcctattgttgagttttaagagctctttgtatattttggatatcctttatcagatgtgtcttttccaattttttcccagcctgtggcttgtcttcttatcttcttgacagtatctttgggaaaggagaagtttttaatttaaatgacatccagcttgtggaccatttctttcatggattgtgcctttcgtgtatctaaaaagttattgccaaaccgaaggtcacctagattttctcctgtgttatcttctaggatttgtatagctttgcatttagctatgtgatccattccaagttgatttttgtgaaggttgtaaggtctgtgtctagatttatttttgcctgtgggtgtccagttggtcaagcccattagttgaaatgactgtcttttctccatcgtattgcctttgctcatttgtcaaagatgagttgaccatatttatgtgggtctatttctgggctccttattatgatccatttgtcagaatagacaaatgtcttttcttttgctgattgttgaagttgagtagcatcggttctctgactttgttcttctcctttaatattgagttagctattctttttttccccctttccatataaagtttagaatcagtttgttaatattcacaaataacttgctgggattttgattgcaatgatagggttgcactgaatctccagatcaagttgggaagaactgacatcttgaaaatattgaatctacctatttgtgcacatggactatctctccatttatttagatatatttctttcatcagatttttagtcttgttcttagggatcttgcacatattttattaataccaaaatatttcgtgtttttttgatgttgatgtaaatggtcttgtttgtgatttcaaattccagttgttcgttgctggtataggaaggcaataattgactttcgtatattaatcttgtaacctgcacccttgctgtaatttcttattagttccaggatgttttctggattttctacatagacagtcatgtcatctgtgaatgaacagttttatttcttccttcccaatctgtacaccttttatttctttttcttgtcttaccacattagctaggacttctagtatgatgctgaataggagtagtaatagtggacatctttgcattgttccagaacttagtgggaaagcatctagtttctacttttaggtatgatattagctctggatttttaaaaatagatgtttgtcctcgtccattcgtgttgtgataacagaataccacagaactgggtaatttataaagaaacgtattttctcacagctccggaggctggcaagtccatgatcaccgtcaacatgtcagcaagttcagttgtctgctgaaggctgttctctgcttcaaagatggttcctctggattggagaaacagtgtgtcctcacatggcagaagaacagaaaagtgagctagctgaatgctctgtgaagcctcctttataagggctttattctcatccatgagggatgagccctcatgacctaatcacctcttaagggtacctcctcttagtaccatcacactgggaattcaatttcaacacctgaattttggaggggacacattcaaaccaaagtgatgttctttatcaggttaaagaagttctctactcttagtctgctgagagttaatatgttctttttaatggctgcatgaagttccatggtatatatgcacatagtttattaaaatgaaacatgacaaaaccacaccctctttaacgttgaaatattgatatgtttgttaatcacagcacgtggtatgtatatggtaagtgcttacgggtacctccctgttaaatcttgccaaggatataaaattggtgccaggttatgtaatgcttttgaagccaacttgagtcttggatcagactggaaaatggaaagaatgtagattctgtgatgatgaatactttggggaaaataagaggattaggtagctgatgcccacctttctatcaagggagcaaaaatgtcctatgggtctttgatctttgccagtgcatttggattggtttctaagtacagcgtggcagccgggttatggtattgttagttctggaaacttagtcaatttgcatctggagtcacctagtcacatttgatgaaatgggttacaaagttttagcacctttctgtaaaccaggggttggcaaataatagcccacaggccaagtgtgacctgctattttttcaattaagttttaaattttgagataatgttagatttacatgcagtagttagaagtaatacaaactgttgtactctgtggatctgttgtactctttgcctggtttcctcagtggtacatcttgcaaaactatagtacgtcattacaacgaggatattgacaatgacagagtcaatatacagaacagttctgccaccagagattccttgtgctgcatttttatagccacattgaccttcttcctcaccccctgcccatgtgcaacctctggcgaccactcctgttctccattgctgttatttcatcatttcaaggattttacataaacgatgtcatatagtatgtaacctcttgggattggcttttttcagtcagcacaattccctgagattcaccccagttggttaatgtaccagtgctttgttctttttcattacagagtattattacttggtgtggatgtaccacagtttaaccattcacacattgaaggatatctagattgtttccagtctttggctgttacgagtgaagctgctatgaacattcatgtccaggtttttgtgtgaacataagttttcatttatctggagtaagtgcccaggagtgcaattgctgggcacttacatgtgataattgcatgtttagtttcataagaaactgccaaactgtttcccagagttcttcagtttgatattcccaccagcaacatatgaaggatctgatttctctgcatcctctctagcatttggtggtagtgtcactgttttattttagccattctgatagctatgtagtgatatctcatcatggttttactttttatttcgttggtggataaggatgttgaagatcttttaatgtgcttgtttgtcatttgtatatcctctttcgttaaatgtctttggtagacgttaaacatttctaattgaattattgctttactcttcagcggagtcttttatatattctcattactagttttctgttagatatgtggtttgtaaatattttcttctaggctgtagcttgccttttaattttcttttttttttttttttcttaagacttgtacagagtaaaagtttttaattctgatgagttccagcttcctaatttttcctttcatggatcatgttttcatgtcaagtctaagaactctttgccttgcgttgatcctggagattttttcctatgctttttgttttccttaaagttctgtagttttacattttatatttaagtctgtgatccattttgagataatttttgtttcaggttgaggttgatgtttagtttgaggttcatttgtgtcaaacagaactctgtgtactggtgttcagttccaagggaaggctggcactccatggaggttagcaaaaaccatcattatgccaaccatcaggaatacgatccagacacttgtgcccgctgtatctcagtacgagagtctccaaggaaaacacaacacagtcaggtagtcgagggagcaatagttacacagagaagagacagagcaagatcagtttcagtagtgcgtatgggtcccctgtgtccaggggtccctcgtggctgcccgtacggggtggtctgcctacgagcacccctcttgtactgcaactaagggaccctgtttcctgggtggggaacagatagagcaatgaggttggccaggtgccatgtgacacacacccttaagcagaacaaaggcgcacacatgagcttgcagcagtgagagatacgtattccacacaaggcataagcctgccacaggtgatgagggctcttcatctgttggtgagatgtgtttcaggcccagggcccattcttaggccactgagtgggggctgaaaggctgtgcacacaagactccctttcgcaacattttttttttttttgtctatggatgaatattcagttactacagaataatttgttgaaatcctttctccattgatttgcttctgcatttttgtccaaaattagttggccatatttgtgtgggtctgtttctgggtccttactccctcccgttgatctatgggtctccctctgtgacattgtcatgctgtcttggttatgatggttatatcgcaggccttaatattagagtcatccctcccaccttattcttccctttcaagattgttttagctgttctaaggtctgtcccactccatataaacatccaaataaacatcagaataaactctctgtcaacagaaaaaccttgctaggattttgataggaattgcatttagggacaattgatgtctttattatgctgagtctttcaatccatgagcacagcatgtctttccatttatttaagttgccttcaacttctttcatcagcgttttgtaattctcagtgtatagatcttgtgcatgtttgctatgttcatacctaacctaagcttttcattttctttggagtgattgtaaatgatatggtatctttaattttggtttccacctgttcattgatagtatttaaaaatgcagttgattttgggatgttgatcttacatctttcaaccttgctgaactcactttagtagaagttttctcatagactttttcagatattctacatagataaccctatcacctggaagtagagttttaatctgtgtgccttttgtttttcttgccttatttcagtggctagaacttccagtattatgttaaataaaagtagtgatctgtggatatttccctagccttaaaaaaaaagtattgagagcagacatgcttactttgtatctatcttaggggaaaagcattcagcctttcactaaactatcacatatgatgtcagctgtaggcttttttgcagatgctgtttattgagttacggtagttcctctttattcctaacttcctcagtgtttttatcaggaaaagggtcttctaccacctgtttaaataaagttttattggaacacaggcatgcttattgctttagctgttttctgtgtctgcgttctcagtgtaacaccagaatcgagtagttgtgatagtgaccatatgaccctcaaaacctaaaatatttattatctggaattttacagaaaaggtttgctgaatcttactatagtttcaccaactttttcttttgaattgtccttttttctttctttttttccaagttcttcctatctcttgatattctaccatggttgcaaactcttactccacacactcttactctaattggctaagacctagagcttgagccattggctgcggccagcctcagaagaaagcagggaggatggatagatgtagatctagttgccttctaaaggcactttctactctttgtctgtatttctatcaacggtagcatttggggtagttctaacatgttcttttgataacttctattaattctgtagcttgacagttaccctgaacaaattactttcatttcacttcttcttgacctcaaccttctttcctgccttgattctctgactcttcctatagtttgtattgctgtgtttccttatgatggaaagatacatgacttcactgatctctaagggatttaggggagtgttgctttctatacgtgacagttcttcactttttagttacatagttccattttgttttgtctaagggaggtgcttttttttttttttttttttttttttttttttttttattaaatggagtctcgctctgtcccccaggctggagtgcagtggtgcgatctgggctcactgcaagctctgcctccagggttcataccattttcctgccttatcctcccgagtacctgggactacatgcacccgccaccatgcccagctaattttttgtatttttagtagagatggggtttcaccgtgttagccaggatggtcttgatctcctgacctcgtgatctgcctgcctcggcctcccaaagtgctgggattacaggtgtgagctgccgcacccagcctgtctaagggagttttaaaatgtttagctttgaaaagtttgttgctttcgctgaaaagagtgggatgaagtatgacctgagtctctgagttaggaaataagtgaataagtttttttgatcactgaaaggtaaaccactgtggtattgtgtttattgattattaattgatagagatattatgtcctgcatctctacattcacatttgattattttccagcttgcttgatctctccccagaacatggctttattgataatacaccccttcttcttcttttcttttcttttcttttttttgacacagtcttgctctgttgctgaggctggagtgcagtagtacgacgcctcctcacagcaacctctgcctcctgggttcaagtgattcttctgcctcagcctcccaagtagctgaggttacaggcacctaccaccatgcctggctaatttttagagattacccagagacgggggttcaccgtgttggccaggctggtcttgaactcctgacctcaagtgatctgcctgtctcggcctcccgaagtgctgggattacaggtgtgagccaccacgcccggccccctgtacttcttttttctctttgccatgcttctgtttacccattactgccaacccatttgaccctccttgcttaggaattgctagcatttattttctttactactcatttggtatgcattcatattatttgaagacttcatatattgtctttttatttaagtttataatagtgattattgtatttctgttttctctataatggcattgcaaatttaatgagagcttatttacttatgtggatccctcccacacctaggcatgtctgttacatgatgaccattagttaaatgaactaaagaatgattgagcttatattctgtagtatcgtatttggaagttgtgtgttcaataaaactcttttagtataattcaggccaataggtattaatattaatgaatgtcagtaaatggaagctatgtttttaccttctagcacaaacatctttagaaattttattacgactgtgtatgtgtgtccagtggctgactttccaagcagttattagaggagatctgagtttttagcttctgcattatgattcatgttgaatatttatggaagagaagtgtttctacaaatatgtaaaaatattggtgagtgaaagaaatggctcccagtatgacagaagaaaatatcctaaagagatccacagttatctgcagtttccccaaggttgtgtttacataaaaaagacattgttttatgttctagcatcaagagatgattttacgatataacaagttccacaaagaactctcgtaagatggttctcagtcccggcataactgctacggagatcacagagcaatattattctctggatttattgggtttgctgcattctgttagcatcattcatatttttctcccatgggtaccactttcctctcttttcctaataccaagatatggagactcatttatgccgtggagtgtgatgctgggaaatgaatgcttgcttattacctctctccacaggacctttcatgaccatacgtcgatgtctgccgcctcagtataaataggcacattcagaaatgtgttctctagtgaagggcatgttggcttggtggaaagcacagggacttcacgtctggactgcgagtcagagctgtgcgtcatgtgcttaactggctgtgtgaccttggataaatttgcctcagttttctcatttgtaaaacagacagtcgctatttctgggaatagatgagataataaggaaagaacctagaatggtacctggctcctgccagttgcacagaatgtttgttttgcagtgtgatgcgtccagtagggacacttaggggacagtgtactgtcatgctgttgccctgttttgtaagagtgactgatggctacgtgacatcaccacactccctgcaagagctgcggtgtatggcacgtggctaagctgtaggtgcacatggccttcaactccacctgagctccagccttctttttgggagaactggcctctgggtccacctatgaagcaggaaggttgattattacttaaacccatagtcttataacctcttgggaaaagattctctcaaaatgactcttgatggtcaacatgggtgtgcatttacgcagcttccattcccatcgcttcttgcaggcagtgttgttcctgattgccccagtctagtttatcgcaagggaatttctttgcggggcagtgagctcccttttggcagaagaaagagtcaagcagaggctgggaggttcccttacccacagtggtggctggctctgtagtgcctcccggctctgggttctactttcctagtctcctgcctttccgcaagtgtctccacccagctccgatagagtgggtagcatcaggagaagggagggcagggatgagtgttgtagcatctcaacatttaagagcagaggatggggggctggggaagagcatacactggggccgggtgtgaggagggagaacattagaaaaaaaaagctaatgcctgctgggcttaatacgtaggtaatgggttgataggtaaatgtgtgccatggtggtttgctgcacctatgtaataaacctgcacatcctgcacatgtacctcagaacttaaaaaaaaaaaaaaaaaagagcagaggacaaggagcctccaagtttatgtggaaaaagtagttagaaaagcaaaaagagtactcaggaaaccaagagaaatgagaacatcaggaagaaatggatggtcggccacagccattgcatttgacaaccaaaagcttttgccaacaatgatgggcaaagagagggagggcgagagccaggcaccatggccaggtgggaaagtgtggagacctgcagatcctggcttctctttcaacagcttggctggaaataaggcaacaggttcaaaaggggtagggtttttaaagatgggagagactcaaaaatgtgtgtattctaaagggggaagatatgggaagatgttgaagaaaatctaaattttgtactactgtttgtcattttatacatggattctttttcactaccttctccttttttttttttttttttttttaaatgagacagagtctcactatgttgcccaggctggtcttcaactcatgagctcaagtgaccctccctcctgagtctctctgagtgttggaattacagccatgagtccccaggactggaccccttttgttttttattcctagttacttttctgctctttttcctctcagcctccctcactcttccctccctcgctcgctttctgaggcttctgacaactcatctattaataagtttcttacagtcctgtccttctggaagccctcagtgccacatggaatctggacctggcaatttcttgctatccatttaggaggagactgttggtgtccattggtcccatttactcatccccggccatgtgttagctgtctgtaattctgtacgttgttgctacagtatttatatatgtcaagatgtatctcacagcatcttattcaccctaatattagtgaaaatattcactaatattttcagttttgtgcttaattccttgaaggttttgggatttaagcccaaccaatttctgcgaagagcagtagcataggaaattaaacacaaaaaataaaagtttaatttagaactgccctaaagccaaattgggaaaatttagtcactgttttccggtaagtacacagtaacaggtgttttggatggggagaggtgagcactataaagatgtctctgcagttctgaaatttccttttctgctttttctttccctcttcttcctcctctttaccctcctcctccttccctactcagccagtttgctatcgagtgtaatacccatggtagagaccaggatggaagctgaaacgtgagagaggtgtgtatgaatggttggtttgggtgtatgttcacattcatgcgtggagctcagtgtgatggaggtgggtcctgtaggctcactggggacccttggcgcagccccgttcacatggttgctgtggtgctggactggccactgggactctgccctcaggcaccagtgacccctgggggtgggtcatctgaccctttctggacagcgtctgcttcctgcagcttgtgtgcctgttttccagagatgggagctgtaaactgtgaaagtctagggctggcagctgccacggtgctgcaccctgcagaagatctgctttcagcaggagaggctgaggcccacgggaggaggcagaaatggtagctggtcccaagctccttagctataaccatttttctgcccttcccatggcttcagtcttcagcgtttccttggattctttgaccaaaaacaaccagtctatctccctgtttctctttgcctctctttccttaaggcagtccaagttggaatattttcacctgcagctgaattaacatggatgccttccttatccttaacaaggtttgtcttgaatggaaaataaatggggatcacatttggagccagtggtccctcgctagcttttcatgtgagccacacttagaagccgtgctagggccgcaggcgtgctggacattcgtgttgttccagtattcaccgctgtgtgctggcaggatcctacctggaggttctggggactgcttccccatcccgcagagtttagcgttgcccgcaggctcataggtgtcaagaaccaggtgagagatagcacctggctcagcatatgatgtggtacttttttctttttttttaggcagggtctcactttgtgggccaggctggagtgcagtggcaggatcttggcttactgcagcctcgacatcctgggcttaggtgatcctcccatctcagcctcccacatagctgggactaacaggcatgtgccaccatgcctggctaagtattttttgtagagacagggtttcgccatgttgcccaggcttgtctcgaactcgtgggctcaagcaatctgccttcctaggcctcccaaagtgctggacttacaggtgtgagccaccacacccgaccatgtttgttctagaaaaataaagctcattaattacaggaacatcgcagcttactgcctttctcactagcagccatgacgtgagctcctggtagaaatgaatagctcccttattaaaactgactggtcttaagtgtcacatcatgaagctttggatctctttccttccccgcagtgtccctccccgcacaacataaggaaaacctttcttagtccttcatatttggtgcttgggtgctaagcattacagcgctcttggctatccagtcatgcccataagccacaaagtgtttccctgtcaactgggcttcttctcttatcagagccaaggtgagaagccactgtggcccctgagagtgggctcaggaattctcggttttggcttgctattaatttgctgtgcagctttgagctatttacctaacttctctgttcataaatttgctacttatgaaaagtgcttgaaagcgaagttcctagaggctcttttttcctcctgacctgcggtaattttaagtgctttcttgtgttacgcttagcactttctctcttcccgtcaaaattaatctcctttcctcagaagctgatgaattagaactctaagccacgcttctttcttgcatggtctcacttgcttttctcccccatctttttctctgttctttttccccttgaggcaaaggcagagaaagaagatggaggcctagcagacgggttgctaatacagttacgacattctctttctcagtctaggggaagttactctggcaattatgaatccatatccctgcctaggaactaactttatcccccttattagtatttcatttctatgggatggcttcttgcagattttttttaaatcttttttttttttttcctgaaatttcttacagagaccaaccctgttttcactatctgaatatttgaaagtatagttgaaactcaggcagtttggaaggagaaccgtgctgtggtttcctccaggagccgaggttctttccacaggactgcacatgggccttgtgctttgtggactgtcagttctgtgtcagcctgcagctgtctctttttaattttgttgtgttttttagagaaggtctcactctggagtggaggctagagtgcagtagcacagtcccagcttactgcagccttgaacttctgggctcacgcaatcctcccaactcagcctccttagtggctgggactgcaggcatgcgttaccatgcctggctaattttttttttttttttttaatttctagtagagatgaggtctcgctatgttgccgaggctagtcttgagttcctgggctcaagcgatcctcctgcctcggcctcccaaagtgctgggattataggtgtgagccaccgtgcctggccttggcagcctcatcttgagtgtgaaatttgtttacagcttttcttgctaaagactagtgtttcttaattaccatgtgcaaggtcttccataccgcagaaggctgttgggcaaggcatagtccagataaactgtcttgacagagaagtagcaaacgggaaacaggctgaggttggatgctagggagatgcctgggcaggatgtcacaacatggattaaaatggaggcagggcagggcagggccacaggccaagccaacacagcaggcctgtctgggctgcacacgtggtccagttggagggccatccacagcaacagcaggaaggggttgatcaggaggcatcatataagaactaggcggatggggcagtggctgattccacgtggaggggcctgctctgaggctgctggtgttcctttggtggtcagaacctggcatcccatagctgacttctataacccacgtgccatttgggcctcctgctccttggcttagtccctagttcgttaccatgggaacgtgaagctatccttaatatttctctaaattctggagtgtgtgtgtgactcggggagtttgtgttctcatgattacttccgcctcaaggttcgggcatctccagatgctacctctttttcacactgaattgactccttttcatttattttttgagttggagtcttgctctgtctcccaggctggagtgcagtggcgtgatctcagttcactgcaacctccgcctcccgggttgaagcagttctcctgtcttggtctcccgagtaggtggacttataggcgcccacaacgacgcctgacaaatctttgtatttttagtagagacggggtttcaccatattggccagactggtctcaaactcctgacctcaggtgatctgcctgcctcggcctcccaaagtcccgggagatgggattacaggtgtgagcccctacgcctggccaatgtaaaggaaattgagggggtacccagattcgaagcggggacctcttgatctgcagtcaaatgttctaccccgaattctaccccctctgctgactcttgtctcattttctatcaaaacctcatccatggctttggtggctcatgcctgtgtcccagcgctgtgagggccaaggcaagaggactgcttgaagctcagagtttgagactagactggacaacaaagtgagacccccaacagtacaaaaatatattatgcaatttccttggtgtggtggtgtgcacccgtagtcccagctacttaggaggctgaggcaggaagattgcttgagcacaggaggtcaagactgagtgagctgtgatggtgccactatactccagtctgggtggtagtgtgaaaccctgctgctaaaaaatgaaaaagccaaacaaacgaaacaaaacaaaccctacaaaacctgacccataacacaggtgagaatgtcctagactttcctgaagactggggaaggagtgatgggggaggggccacactgcacacatcacggaagggggacctctaaccctggttattcctgctgccaaggcagcctcatttcacagcttctccctgcttgagggcgaagctgtccaccttccttcccagccctccttcctttcgccctcctaagaaaacatacgtcatcttttctcccacaaaacagatggagcacttctttttggcgtgggttctggctaacatccgtgcactaagggtctcatctgttacttccaaatcctaccaagttgttttctcaagcaaagatgggactttttgaacactgacctcgcattaaattgtgtaaccttggaggttggactacatgtcgaaccaaacaggcaagaggaagtggtgaccgggcttgaggggtccctctctgtgatctccattccggtgtgctgtgaccccctttgcccatcacacggttgtgtggttgtgttttattccacccgctcctcgtgtgaagggggcactgtgttcactctatcaccttatccctggagcacccaccaaagtgccgtgaacagagtaggaattcaatcaatatttaccgaacgactagatgtgctcagcacggtgctaatggatgattagaaaagttaataatctcagctcttaaggagtttatagtctagtcaggaagccaaaaataacacagatgagaataattaagcctccaatctgatggcactgactgggggtgcatttatcaagaatttggaagcacgtaaccatacttacattctttgttgcatacatagcatttaaattgtgactctcatccaacttatcactcagatacatttttttctgtgttaaaaatataaagccatatttccagagatttttaaagggcccaaaagattatgaatttgatcttaacatcagcagatgacaatctagttttaacaagttactttgaattagtcaaatctaaaactcactttagatttgttttctggctaatattctaattgagagacatttccatggaggtattaggttaaaatactgtttttagatatgtgacacatttccctgtattttagaaatctcttgggtatcttaagagaaatttaatccatctgattttgatccaaatataatttactcacaatgatggagaaatatttgatatccacggaaatctattgatgcacttaaagtttttctccagggaaataagaaatcacattttttcaagggtgaatcataaacctacagtgtctaatttttctgcttatttaacaaaacctgagttaagtatcaaattgggcagttccagatcatttgtttttaagttttttagtcttttaaactatgcagaggaaattttattcaaagaggtttttttttccttattctgacagttttatctgctatcctgtttttttccctaaacagtgatttttgaagatttaaggtaataacacaattttgatgtctgtggattaatggcgtctgtattcacgatgtttcagacctgtcagagcttggaaatagcatttaaatgtattgcttaattttaattttaaaatactttctctgagaattagatcccagtcctaagtgagtactttgaatttcaaagaggggatttaggccaaggtacagctaaattttgtcctcttgaaagacctgaaatccatttacaaataaaattgaggtcttcgtatcaatattatgttttggaagtgaaatgtgcaaggacttgtgcagtgtcacatcttaagaggctgttgggtgccatcgggagtcgaggcagggcctggcatttcagcgaccctgctgctccacatgctggttatggagtactctccgacttgtccacgcttccaagttctgatttctggcctcctgaggatggtggttttcctagcgcttctctttcacagtaggttttgcatttctgacctgggccttagcctctttctttaaggtttgccttctggccagatccctgggcaggggcccagctcctgctttgcggccctctgctgcctgcagctaatgacagtgacccctgcccggctccactgactcataggatctgatgcttggatcgttgtaatagtcttctggtctcttcttcttttagttcatcaaacagatcttaaccatgtaaaccttcgtaaatattatttcatgtggggattggctcaattttagcgggtgggtatacaaactggagacagactacctgggtttagtcccaaccctgaaatttattactctatgatcttgggcaagttacatgaccttggtcaagctagttaaggtctctgtgccttagtttcctagggtgaaaaatggggttgatgataccctgatgagaggtaggtattattttatgaagattaaatgacacagaaggagaagcgtttagaacactgtgtggctatagtaagtgctaaataaaattagttattacatagattgccctatccttttagaattttctgttttagaattttagaatgtttttaatcttcagtacttgctatcgtcttttttaatagaaataagtctcgagtttagaggtagttataggctttgcgaattgagtaacattcttttattttttaaaaaatttattttttcagatgaagctggttcccctttatatttaatacaaaatttcctttaaaaatctaggttaaaaagaagtgagtttaaaacatatcaactaaatcataaataaatcgtactatggttttaaatatggcaaaaatcgtgaacacagtgctcaaatgcctgaagtttgaggaaaatctgtgaggggtgggtgcttcgggcctctggtaggtcttagctagcctggggctcttcctgccctcctgtgggcctctgttttagccagacagcccactgatgactgccacatcctgagcattcctgcctttgggtttgttcttgagaatacccaccctattccacgtttctgatttccactcatcctcatggccccatttgagatgaacatcatctgtaaggcctccccagtgcctggctccaggcctctcttcttcctccaaactttgtcgtgctcaagaaagtgcctattgtgtgtatttggcagtcatttcttgccacgtgatatctaataacttccatggatctgtcctgtttctgcaactggaagaagatgagcggaacctcttttaggtggggacagtgtcttagtcatctcaatagccccttgaaggcatgatacggtaccttggatggtttctatgttaatattttctgttatgtgtccatattgaggtatcatttatgtaccacaaaattcacctcttctaaagtagtggaatttgctttttaacaagtttgtacagttgtgaaaccatcaatgctgtccagttttagaacactgtcatcacccccaaaagttgtctcctgcctctttgcagtcagtctgctcacctgcctccagctaacaattgatctgctttctgtctccatagttatctttttaaagataaatttcatagaaaaggaatcatccaacatgtagtcttctctgtatgggcttttccacctagcatagtgttcctgtggttcttccatgttgttgcacttactagtaattgtttcattttattccttagtggcagcagatagaccttgctgctgggtgttcagattgtttccagttttgaggtattatgaataattcttccatgaatgtacaggtctttttgtgagcccatgtcttcatttctcatggatagattttggagtagaaataactggttcctatgatcagtgtaactttttaagaaactgctaaactgtttatcatgttatattcccagcagcaatgtatgaggattcatttctgtacatacttgccaacacttgatattgtctgtctttatcctaatagcctttctagtgggtgatgaggcatgaattgaagatgactcttgggttttcaggttgagcagttggatgctggtgctaccatttaatggaggttgagaaaggaatgaaggtttttgagaaaaagtcaagaattctggtttggccaagttgagtttgaggtgccagttagcctttgaagaagcaccgttaagtaggaagttggatgtatgagggcacctatgttaattccagctttgtgaattcattaaataatgaaacctgggatggttgcttgaaatttttctaccctatatatgaatctgatggtctggacaagtcacatagtttcggatgtcagtttcctcatccataaagtaatacctattttcctccaaagcttaggtgaggagtgaatgagttaaagagtgcaaagtgtttcttattgtggcggttgttattaatacgtgatttcacttttcatttatttcatttttatgtccattgtggcttctaacctcatatttcacacatagcaggtactcagtaaatacttaataaatcaatgaatgcaagtaatgactatgtatatactagtggagaaggaaggaggggagggaaaggagaggagaggcgaagagaggtgggccaggcagaggagagaagagagggagggagagggagagagagagggagagggagagggagagggagagagagaatgagaatgagaatgagaatggatataatttgggttggccttaggaaggagggctctcagaattccacactggagctttgtgtaaaggaagtttatcttctatgacaccagggaggcaacatggaagacatgattttgggagatgtttcaataataagaattgtcacgtgtaaagcatggttgtgtttgcaaagtgtcttatcttcctactagaccttaaacatcttgagggttggagcctttctgatgtgcctctatatttcccagagccttactaatttcagcatactataaatacaacaaatacctataaaatgagtatgttggtggatgactcatgaacaggttgtttccttcctgtgtccctgggagagcatgtctgtgcttctaccacagctcatgcatggcttgtgtttataatgatttgtttgcatgtctctctgtctgtcctgagctccatgatggcaggggctccatatcccttggctcatgcctggcaagtagtggttgttcagagagtgctggagagaattgttcgagtgaatggatgtgtctaacactgaaggaaagcagggaaaggagaccagatctgtgctctttggagtttcagattgtagctctaaggatctaaatttccagagggagagaaagtagggaaatggtccataactcatttgtcttccattttctgtcccgtgggctaggtaggtctgttcttgatatggttgggagagtggttgcctgtctcagtgttcaatgtcagatgacaatattagctcacattgtaaatattctgagagtgccataccctcaaggtttcttgttaggttatttcattagggagtgttttctaagattggcttaaagtaaaggattttaaactttttctaagagagacattttaaatttattttaattttcatgggttctccaaatgcagtagactttttggcaaaatctcaggtaaacctcatacatataaatcacagaaatggaagaattaggtaggtgcaaaagtaattgcggtttttgccattacttttaatggcaaatacttcagttaatgcaggggtgatctaggacctcacctgcttatcatttctttgtcctttgtcaaagccctgaagcatctgggggactttagggctccttggaaggaagtttgaaaaaccccaggtatagaggtagtctgttcattttgacttcctgtttcttctgccactctcaagagacttctgttaagtctgtagaaagacttccccatgctaccatctgtaaccaccaactacgggaaccctagttcactgttggtgggaatgtattttggtatagccattatggaaaacagcatgaaggttcctacagaagttaaaaatggaacttccatatgacccagtaattcctcttctgggaatatagctaaaggagatgaaatcattaccttgtaaagatgtctgcactccaatgtatgctgcagcattattgacaatagctaagatgtggaaactaagatgtctatcaagggaggaactggccaggcgtggtggctcacacctgtaatcccagcacttcgggaggctgaagcgggtggatcacttggggtcaggagttcgagaccagcccagccaacatggcgaaaccccatctctactaaacatacaaaaattagctgagtgtggtggctgcatgcttgcagtcccagctactctggaggctggggcgagagaatcgtttgaacctgggaggatgaggttgcagtgagctgagatcacaccactgtgctccagcctgggcaccagagtgagacttcatctcagaaaaaaaaagtctatcaagggaggaataaggaccatgtgatatatgtatacaatggaatactagccttaagaaagaagatcttgccatttgccacagcacggacggatctaaaggacgttatgctaagtgaaatgtgcagacacagagagagaaatattacataatctcacttatatgaaatatttttaaaaagatctcaaatattaatacacacgtagagaataaagcagtggtttccatgggttgcgggtggggagaggaattggggagatgtagatcaaaggataaataaaaacagatatattggacaaatgagagatctaatgtacatcatgactaaagttaataaaattgtattagggatttttgttaaataagtaaattttagctgcttttgtcccacacacacacacacacacacacagtaactctgaggtgatggatatgttagtctgcttcactgcagtaaccattttgccatctatatgcatcccgtatcatcacgttgtcaaactcaaaaatacacagtaaaatttatttttttaaaaagaacaaagccttaaaagaacaaaagaacaaacctaacaattgcctccttttgtatttccctttttgtgttcattttcacctcctctttgagcttgaatcaaaaggttttgaggccaccagtaaatcaggtaaacagtaaaaactggagggaaaatgcctcatatttgtgaatttgccattgcacattcccatggtcagtgtctgatgtggatatagaaagcagcatcttgtccaaggacatggctaggaggggaaaccacagcgggtagacgagaggtaggtgtttgtcttaggtcattttgtgttgctataaaggaatacttgaggctggataatttatacagaaaagaggtctttttccttcacagttctgcaggctgtataagaaatatggcattagcatctgctggcctccggtgaggacctttgtgctgcatcaaaacttggtgcagaaggtcaaaggagaagcgagcacctgcgaagaaggaccaaacccaaggggcgtcctggctttataacaacccactctcagggaacgaatctattcctttagaaacagtcccgtttcatgagagtgagagctcacttgatcccttgagaatggcaccaatccgttcatgtgggatatgcccccaggagccgaacaccttccacgaggcaccacctcccaacaccatcacagtgggtatcaaatttcaacatgagacttggtggggacaagcaaaccacatccaaaccacagcagcatgaaaggggatgagtcagatcttgggttactattgaaaagggctgtgtgtgcctgctgggattcatggtgcacatggagagcaaaatgagtcctgggaagcagagacttaatgcagcgggggctggctgttaaaattttgaattccctagggcctggcagtgtgagttggaagacaaaaatgactgggtgcctctgggagggcctagcagtccaggagagcagaagctctcagagccagaaccaacagagctggcagaagggagcgatgtttggatggaatcaggaatgctggagttggctgggatggaaccaagaagtcaaaacagtaaggcactagaattagctgggcagattcctgaagcagattcaggtggataagagtttagttaatgtatagtattgcctctgtttaagaggctataaaggatttttgtgagtttatcttgggttgtaacagccgtaaatactggagagatggactgcaacttttaaaaagttgatgtaattcacatgccataaaacttgtcattttattatgtacaatccagtggtttttcgtacattcactttgttgtgcagacatcaccattaaaccgtgaaaatgtttggttcactccaaaaggaaaccccatagtcattggcagtcacttccaattcttccctctgcccaggtcccagcaaccaataagctatgttctgtgtctgtggatttgcttcttctgaacctttcatatatatagaatcatacaatatgcggacttctgtgtctggctttttcatttagcatacttttttcaaaggcccatccatgccattgcatgcgtcagtgcttccttcctttgtattgctgagtaatattccaatgtgtagcccaacaacattgtatcagttcatcagctgctgaacatggggattgtttgcattttggattattatgaacaatgattctgtgggcatttatgtgtgcatttttgtcaaatccttttctgtgtagagatgatcgtgtgggttctgaacatggttctattaatatggtattttacattgattgagttttatatgttggactggtcttcttttcctaggataaatcccacttggtcatggcttataatcctttttatattttgctgtgttcagtctgctagtattttgctcagaattttttcatctatattcgtaacgatattggtctgtagtgctttaaatttttacttatgttcattattcacatttaaaaagtgacaaaaattgtatttatggtgtataacatatttgcaaatatgtatacattatagaatagctaaatcaagctaattatgtgcattgcctcacatattattttttgtgatgtcacatattgcagaatcttatttttaaaggccaaatagtattccgtttaccatatatattttcctcgtttatctgttgatggacacttaggctgatttcctgtcttggctattatgaataatgcggcagtgaacatgggagtacacattgtcttcagtatactgatttcattttctttggatatatgctcagaagtgagattgctggatcatatggtagttttttttttttttttgagttgaaattttgctcttatcacccaggctggagtgcaatggtgcgatcttggctcattgcaacctctgcctcccgggttcaagtgattctcgtgcctcagcatcccaagtagctgggattaaagatgcgtgccaccacaccccgctaatttttgtagttttagtagaggtgggattttgccatgttggccaggctggtctcgaactcttgtcctcaggcaatctgcttggcttggcctcccagagtgttgggattacaggtttgagccactgtgtccggccggtagttctatttttaatttttgaggaacctccatactgttttccataatggctgtattaattcatattcctttcaatggtgtagatggttcccttttctccacgttcttgtcaatacttgtttttgttgatctttttcataatagccattctaacaggtgtgagttaaagggtctgtagtagtactcttgcagtgtctttgctgatattctgtgtttgttttcctgttctttatttcatttatttccactctagtctttattatttcttcattatttaggagtgttatttaatttccatatatttgtgatttttcctttctttttttggtctgtattgagttctacttttattccattgtggttggaaaacacactttgacttaatcattttaaatttattgaggttcattttatagcctaacatattgcctgctggaggatgttccatatatccttaagtatgtacattctggccaggcacggtggctcacgcctgtaatcccagcagtttgggaggccgaggtgggcagatcacgaggtcaagagatcgagaccatcctggccaacatgtgtgaaaccccatctttactaaaaatataaaagttagctgggcatggtggcgcacgcctttagtcccagctacttgggaggctgaggcaggagaatcgcttgaatccaggaagtggaggttgcagtgaggtgagattgtgcctggtgacggagtgagattctgtctcaaaaaaaaaaaaaattctgctcttgttgggtagattgtttggtagatgtctgttggtactagttgatttatagtgttggtcaagttttctgtttccttgctgatcttttgtctagttgttctcacagttgtggaatgaaaggtattgaagtttccaactatcattgttgaattacccatttttcccttcaattattttagattttgctttgtgtattttggggctctgttcttatgtatgtttatattggttgtctcttcttgatgaattaaccctgttagcattataaaacgtccttctttatctttagtagcaagcgttttcttaaagtctgttttgcttgttagtataaccattctagctctcttggggtttctttttgcatggtatatatattttacatagttttactttgaacctttttatgtctttgagtataaagtgtgtcttttgtagacagcatatagttgaattttgttttaaaattttaatccgttctgccaatctatgtcttttaattggagtgtttaattcatttaagtttaatgcaattactgatgagataggatttacttatgctattgggctatattctacgtatctttgtcttttttgttcttctgttactaccttattttatgttaaatattttttcaagtaacattttaatttccttgccatttattttcctctatgtttttgagttatttgcttagtggttgccctggggattacagttaacatcttaatttataacaatctaattcagattaataccaatgtaataatatacaaaaactttgctcctatatagctctgttctattccttctttactcttattgtcacatgttacctcttcatagattgtgtgcttttcaacataggtttataacaacagttctatgcttttgtcatttacatcagatagaaaaaagagtacatttatcccattttaaatattttagaaatgcttaaggatatttaaaaaattaaactatgttacatttattttaaaatacatttatactatttgtaaaatattcacttctgcagttacctttatacttactcctatatttcttcattgatttgatttactgtctagtgtcttttcatttcagcttggtggaaaagttcctttatttcttgtagagcaggtctgctagtaatgaactctgtttttatttggaatgtcttaatgtctccttcattttcaaagaatagttttgctgacatagaattcttggttgacagttattttcctttcagctctttgactatgttatcccactgctttctggtctccatggttttcaatgagaaatcggctgttaatcttactgaggattccttgcacgtgatgagtcgcttctccaatgctgctttcaagattctctttagtctttggctattaacaggttattggttttgaattacaaattcactgttagtctgcccacgtttcatcatccctatttgaagggacagcatgggacacttttgtcagtgctttaattcaacacttgtgatatctctgtagcattttattgatctatcaactttatggttcagtaatatgtggttttgtctttcactgttatattacttaatagaatttcagattgatatttatgtgatccgttcccataacttatttacttaatagatttgttggacagctgtatatggaaggctgtatgcaagactttgagttttcttagataaatgacacatgatcctaattgtgaagatgacacatttgattggcagagcacacaaacttaactaattactatgcaattaggatgaaggtatctatgtgcataaacgtagtagtttggaagcaaagaataggaagtcactgattttcataagtggtaaatgagcaaactgaggagattagatagattagcaatttgagaccttgagttatctaaattagaacgtggcagaatcaaggactagaagtcacttttctgggttctttctatgaaacgatgattctagaatgtggctcttttctatgttcaagcatcataggtaaaaatgatttcttaaaccaggtaagtgtgtgaagcacagactggctattttgcttcaaaaggtgtttatgttaaaaataaaagcaaacagtacttatttatgcttattatattgtattaacatgaattaagtaaacaagtgactatgctggaacttgaggtgtcaaaatatgaaaagatacttgctgttattaaattgaccttagatgttttattttcctttttattgttatttgttttatcaaaagaactcttctcccctgtacatctgtagtaaaattttgaataggtacagtttgtattagagcctccttaaaaataaagttgcagatcaatcaaaactatattcattctccataggataaagcatgacatttctgggcatacggttttaattttaatctgcatgcctccgtttctattctcccatgagtctttgcggcaggacaaggaaaagcaagtcttataaaaagaaatacagtatgtggtgcttattaaagttacatacatctcttctcacaggagaaatttgatttattgcaggttgtgcatatgtcgcatatggacatttctagggaacagattccttattgctgagcagtgaatggcttctagtactccattattgctccgggaacatgttagtaataattatgaaaggtaggataccatgaaatctgtaaggtgatttggcagaagtcgatgctgttggtgccaggatttgggtaccgtaccacggtttcctgttttcaaatgtattaattgatccgcaaaggacatcttttggagacaagaattcagacagactggcacagcctggacctccgccaagactgctcggaaggttgccatactgggagcaaaagagtgagagagagaaagagggagagagagaggcagagggagagctgaggaaagaaaaaaaggcaagacttggcacagctcagtcaaatcagcttcttttgtctgctttctcggcttgagcttcaggaaagaaaaccgtcctggggtacagaaaaactcagaactttttggttttcaaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaacgtaagtttttagattttattttattttatttttagacatttatagacattaacttttcaaggagcctttctaagattttatgcagcccagccaggaagtcagagtaaaagttgttttatccatgtgtttaagaaaacgttttcttaaagcaacagcttttatttctgctgcttcatgctgtcctaaactacatcccccagcaattagtgacaacactgaagaccagaaaggcaagctgaagacaccagacttcgcttgaagggcaaacaagaaatgtgagcttggtcattatttttttgtgtgtctttgctctgaaccatttttgggaggtgggtggggaggtgtctatgtctaagagatgtatgcgattagtgaattctcattgtgagaaggaaatgatgaaaggtgatttttatgatgttggcagaaatggctgggaatggtagagaatagaaatttaaatcttttggagaagaagtggtgagctgtgtttgcaatacttggagaaaaatttcttatttttggttgattagattttataattaaacgattactgtagcctggctctctcaaaatgttttaagtagaaggaaaatttagaaagtttaccgattttctttttaatactacctggtgttttacttagatatatactttatatctaatttctgaacaatgaatctttcctattaggcctgattatgattggattgtgatagttctgttcttaaaaatcagcattattgtaggagaggttaactgtaaggcatgtgttactgtggatcaccctgattgtaagtattctgtttttaaagacagtttgacttgtaggattaagttatgacttcctataatcatgtattttctttttattttatatgccgaaagaatacaggaaaattgtatctattcacataagtactcatcattttgggcagtataaaagactgcccctggatctgtgcttttgtttggagtatgtaatcattgatttcttaatccttcgacaataaaaacctgtctatagctttccattattgcgcgccttaaatgattaattgtttcacatgttttttataaaattatagtgacacatcagcaatcctgaaaatggcatttaatatataaatatgattgaaaaatatatgaaatctaacagaggtgtttgaacagttaagcttaagtatgttcttcaactttttaattaatcaacattttgattttctgtaaaatgaaatcacttaacatttatgtgtgttgccaaaatgacaacctttgtttaataagctcctttatacactacgtcgctgatactcctaaaatggacgccaagacatgaaagacatgctgataggcactcggaaggaaatgtttgcctgactgcagtcttcctttttgaattgattacaggatcattcatgcttatactaaaaaacaacaatatatgaaacaaaaagaaagttcagcaaacaagtttaaattgagcttcattttaatactgaccgtcttattgccgatttatatttacttccatttacttcttaaacatttaacataacttcttgccatttaggtttgctaaatatataacttatttaatttttaagtccattttttcttgaagttaaaataatttttgctagctgatttcttaacttctttgcagcgaactcagaacaaacttatatccaaactatttcatgtccaattattttccagcagtatgatcaaaagtaggtgaattaaaaaacaaatatgtcagaatataccttaagaaatattaaatttttcgatactggtaaaactacattttacagtgtatattaaacttaaaatttgataaatactagctattatagtcactgaagtttcttaccaatagaaattctctctggcctacacattacatagcttaaaatgaaagaaaatctcccataaagatgttccttgtaaaacgggtataatagacacgtctttgtgcaagctttttttaaaaaaaagtgtgattaagaagttgcgttgattacatttttttaaaaagacatttagttgtaacataatgcatgcttctttatttttagaccttttgtactacaaacacattgacatttaggttattaactatttccatattagtatttcaaatcttattttaaagtatataaatactattggtttgattgtaaatgaaccctatctcacctcataattatggtcgtttgaattgtataatattttgaagtaaaattattgaggcagaaatgcgttaatatttaactgctacttgatacctattattaaattccattttgatgtatgtacctgaacatacaagcacattattctacaaattaatgcgaacttctcaggaagcgttagtccagtattttataattactcgctcatttattcatttattcaacaaatgtttattgagcactcacttaaatatgctaatattttattgataaagttattttgggtaacggggatggaagagggaatagatttaaaataaaatttaaacgcctagatagaaaaaggcagtactataatgagattaatttcaacaaagtatgttcacttttcttgcacaatacacatattgtagagtgtgattataaaaaatcaggagattagttgtattacacgtagctgtaagaatcttgttttatgactattttggttgttacattttattggccagaaaacttgagttgttcaagtcttctgacagacatgtaaaataagcaattcaaatcagggaggaagaaactgagaatgagccactgctcacatgctagatcttacatatgtcaaagcaggtgtaattgaaccttcgaagacgtggctgcaacgtaaacaacagtggcctgtttatgtgggatttttttctttcctttgttttctgttgtgagacaaaggaggaagataaggcccctcccacatcctgaggccagcatggccctttgaaagaaggtttgctagggggtgtggtatattttaaatggacctatcagttcactttctatattctagtggttcgtgtgtgtgtatgtttgtgagtgagagagagagagagtgcatttaactcagtggcctaagtttattccatgcagttgttctctgatacaaaaagaaggcataggttcatctttgaagaggagataaaagtcacgtgatctgaggagatgtacttgtaggctgctttggtggcccaggcgtgaggcagagctggtggcccatggaatggagatgaggagtgtctcagccgtgggtatacactgctgaggtcattcagcagatactcccagaggacttgctctgtgccaggcaaaagatataattgctgcccataggaattcctagtgtagttgggtagaggagaggataggaataattgatgaatgtaggtaccttttcaggttaccaaataccttcgcctgttattccatgtaatccaagcagccatgctgggcgcagggactggtacacaatggccacttaataagtattcatggaagaaataaactgagtggcgaaccagagtattagcttgttgagtcttatttgactaagagagtgttttttccttcatggatagaaaaacaaaaagtactgtgctttctttatcttgtttctctgttgctggctatgggtttagaggggtgcagcagagggccacattatttgtgaccacattaggctctcttgcggtggccattggagatgatatgaaacaaggacttgcctggtgtggggtggccctggacaccggctttctctctggccagccctctgttgtcttgcattccctctgtcctcattttcccaaagcatcccatattgtactttaggacttggtggtgtggcctgagcatgcagcaggccagtggagtgcccagtgagtttaaagtgtttcttttgagggcaggacaaaggcagaggggatggagacagagaaggtggtgagggcagttgtgcagagttgagggcgctgcccagcaagcagcttcagtcctgttgtagctgcagcactaggggcctttgagggagcaagggtgaatgtgggatcctgggttagactgcaatatcagcaaccgcaggcgttgagagggcataaggtgttattgaggggctgcatggggggatgtaaatgggttgctgaggccagttcatgttgaacatcgtctttctgggtctttgtcctgggaggttttgaggcccaggagagggagaggcagagtcaggagcattgtgtatagttctgtgtccaaggcggtgaggggctggaatttagcctcagctttgctgcccaagccctgtgccttgatctgctgcaggaaggtaccaagtccccattgtgcttgtggaggtcctggggtgcatacaggcttggaactggaatagcaggtattgggagaaggtcaaaggtctgtggccagggagggcagtgttccagtatctgaccatggagtctagggggctaggggatgtgatcagaagtgttctagagaacatggtgaaacaggggaggatgagtaagtagaaatttagatcaagtgaaagaaaaggttttgagagtactggagttaggagtttattctgaaactcatcagattctgaataattgtaccacctctgcaaagctcgacttaaaagtttggccgtgagttgtgctcaggttattttatttctccaaaagcaagcagaaagtgaaaaatgttacctgtgtgtgttctgtattgcacgttatcagaggagatgcacattttcttctcttacagttaagaatctctcagtcttacacaattagaataccccttatgtgtggatctggaggttttgtgcaaaatactgaagaattagtccctctggagtgatgccattcttttatccttgtctatcaatgtcatttatatctcttttcctattagcccttctaagttattgtacctcatctgaaaagatcaaattgttctcaaagacccaggagtgtttcaccttagctgtattcatgggaaatctgcctttgaaacaaatagtcctttaccgtcttgggttagagataatgttcctcagcatctccccaaactgagtttgaattttgactcaattttttggttgtgggactttggccaagttatgtaaacctaatttcttcatctgcagaacagggatcatggtatttccctcacacgattttgggaggagaaataaggaaatacatgcagagctcttagcatagtgtctggtatgtagtaaatacttaataaatggtagatattatttatgttttacaaaattatttttttaatttttagaaattgtgataaaatatgcataacatattttaccgtcttaaccatttttaagtggtatcaggtacattcacattgttatgctgccattaccgtcatcaagccacagaagtcttttcatcttgcaaaaccaaaattctgtacccataaacaataactttctattcttcccttccccaaaccccgcaacagaatcgtggcaaccttgattctgttttctgtctctatgaatttgactacttcaggtacctcatataagtggaatcatacagtgtttgtccttttgtgactggcttctttcacttagcataatgtcctcaggattcatacatgttttagcatgtgtcagaatttccttcttttatgaggctgaataatactctattgtatggacagaccacattttctttctccattcatctgccagtggaaacttgggttgcttctaccttttggctgttgtgaataatggtgctatgaacatgagtgcacagatatctctttgagctcctgtttccagttcttttgagtatatccccaaaagtggaattctgggttgacaatttcttttttttcagcgcaacttcagttgtactcccttcttttgcctttgtgttttctgatgagaaatctgctgtcatttgaattgttttgcccttcagctaagatgtcctttttctctcactactttcaaaatcttgctgtgtccttagttttcaaggaatgtgttatgttgtgcctttttgtggatttctttgggtgtatcctgtttggggctcattcaccttcttgaatatgtaggtttatgtcttttgctaaattgggaaagttgtcaggcattatttctttgaatacttccccaggtgtgccctctttctcctttccttccaagacttggaggatgtgaatattaaaactttgttatagttctaccagtgcttgatactgattattttttaagtctattttctctttactattcagattgcataatttctattgttcttaccttcagattcacctattcttttctctgtcatcttcattctgctgtttagctcactgggtgagttttaatttcggttattttatctgctatgtctttactgagactttctgtttttaaaatttgtttcatgcccatttttagttgtttgtggaaacatgtttataatggctactttcaaatccttgtcagataattccaacatctgtgccatctcaatgttggcatctcttgactgtgttttctcgtttaaattgaggttttcctggttcttggtatgataaatgattttgattatatccaggcatgttgggtactatgctatgagactggattttatttaagccttctgtgttaacaaaccttctctgacactgtgctagcaggggaaaggggggcactccctcatttctgtgaggtgggggagtaggagggtaccttattattggtaggtgagggtgaaattcaggctacccatagttgatactgttatttttattgttagttttgtactgggtgcagtaacctggacagtgtctcagctctgtattccttaaatttagcttatgttgttggtgctacttgtgtttgataacttgtttaatgatagttacattctcaaattagggactgagccttctttaatcactagctacccagagattagtatgtgtttaccactagcacattgaataaaagaatataagagatgacattgtagtttctactttattaatttagaaaaattatttttaaaaggagagaatacgctacctgggtaagatttccatttttttggttattaacatgcgaggttttatcagacttttgcaacttatttttagaagaggtcagtatattaaaaatagtcagaagaaacagatttgactgaaggctttaaaaatgtcagtgataaagtattctgtttcatttgtgaattcaaacctgtagcttcaggacagatcttaaagatgatgcatgtaactttggaataatatattgtcagggttcttacgggtcatctgtgctgtagcattgacagtgagatcccagttttgcatcacttactaactggataatcttgggaaaatctccaaaactctaaaggttgacttttcctataagtgaagtggctgtcataataccaatatcaaagggttgttcagaatattaagtgagataatgtgcctgaaagcaatttagctgataggtatcataaacatgggagacaattatctagttagtttctccagacacatgaggatgatggataaagataatgtacctaattctgtatgcttttcagctgtttattccaatagactgttttatatatatatatatttaaaatgctttaaaattgtgtaaatatcgaagaccttcaaatagatagcaaagtattaaataaagtagaatgaatacccatatacccattattcagaagtgacaaatgccatatttattttcctcagatgttaaaaaaaaaaattaaggatataactaaagccttactctctctcacgtctgaaattggtgtagaacactttcatgcacatttttctggaattacagcgtatacatgtagccataaacaatatattttacatgtttaaaaactttgataaaatattttaaactgttgctatccttttgcaaatgaaattagatatttctgagcgttatctctattgctaatgtgggtatgaggctgtagagtgtctcattttagcgtagccattcttctgtggatgggcgtttagggatctgctttgtgctacccatgctgtcatgaccctcctacacatctgggtgatctctagaggaggacttagaaatggagcccagtttctgaatatttcagctttactcagtaatgccacgccattctcccaagtatttgtaatgtgaacccaaaagtatctgagacaggtctcaatcaatttagaaagtttattttgccaaggttaaggatgcatctgtgacacagcctcaggaggtcctgacatgtgcccagggtgatgggggtacagcttggttttataccttttagggagacgtaaaacacatcattcaatacctgtaagatgtacactggtttgatctggaagggcaggacaacttgaatcaggggcttctaggtcataggtagatataaaaattttgattggcgactggttgaaagaattatcctcaataagaaggaatggctgggttatgctaaggggttgtggagaccaaggttttatcatgcagttgaagcctcctggtagcaggtttcagagagaatagattgtaaatgtttcttatcagacttaaggtctgtgttgatattaatgctggcctgcttttcctgaattccaaaagggagacggatataatgaggcatgtccaaccccccttcacatcatagcctgaactgggttttcaggttgactttggaatgcccttggccaagaggagaggtccattcagatggttgagaggggcttagaattttatttttggtttccagtacccatttatattcctgtgctagagtatcaatgttcttgtctcactgtatcttcaccaacagttggtagtaccagactttaaaattcttgtcaatctcatgggcaaggaatattttgctgttacgtttattggtatagctgattacttagtgagattgaacatcttttaatattggtaatttagatttccttttctgtgcattctgtattcatatgctttgcacagtattcttttgagttgttttattcttgctaatttgtatcatattaactaatcctttgttatgctcatcgaagataccttctcaatctttttttttctcattttccttatggcaactttggaaattaactatggaatatgtttgaaaaattggaatgttttcatttttcattttcagaagtgattttagtaataatacatgcttacaatccatgctttccgatgaggcagagagggctaatgggactaatttcttagaatgcatcagaattttatctccttaattaacatctagaggaaaaagtttctcattttccatgtaaacttttggtcaacttgaaatgtcaggcagattcttagtccccaggcatccatcattgaattaaagagtattgtggagttttactctattatttgcagggactgctatagcacaccgataatgtaggcacattcccattgcatctgcaatgttaccaaataggagttctagggcccttagaaagaatgttctgttgatctgattatagtgctttctatacagtgaataatctcggtgcaataagcactttctccttcccctaaccagtagtcttgctaacaaaataacttaattgagaaatgcacactgttggggcaagtggattgagttgtggctgaggctccttgtgtatcttttgttgtgcaatcaagtagcacttattcaccgactttgctcatgctgtcccgtctaaacaaaacccacctaatcttccaaatcactttgcaaaacaaaagaacacacagaagatatagaaaccaggaggaccaggcggctgtggagtattttaggcagcactccctctttccctgctagtaaccatgtatatgaaattgctttagtaattatacatctgttttaaaattggaatcggaaaggatactctttccacaatcctataggaaccctccttggttgttcaaacatttggcaccactgcgtgtctgctgatggtttgccacagtcataggtgaggttctgggcagatattaacagctgagggaagagtgggcttgcaaacccaaacgtggaagtcagaccttgaggtatggttctcacagacttgactttcttaaggacagtggccatacgctttgctcagtcaattccagttggccttattgtactcgtttgccatttactgcagggagtgagcctcccttcagcatataggaaccagtgaaatgtcctctcattggctagctttgatatttccttctttctccacttactgaattcttacctggaatcagcatttggctccagtcaccgtctctgcaccattcctctactgtttaaaagttttaaggaaaacttcaataaagagtatatgaaaataatgactgttgtttaattacaaaccctgttttctctaggttatctaagtcagtgcaactctgtgagagagactggcagacacacacaccacacacgtttcaggtgaggaaatagaggcccagagaagtgaagtgcctgggcttgttagtagcaatgctagagtttaaatcaagtcctctgcttccagatttgttgtgcttcttgtgatttcacatttgttcactctgtcatgggaccaccaggagaatatagtaagttggtgcttttatggtagcctctccatacacccttgggaatgtgtccttaggtcattccttctgtctgctacccacccacctacctacccactcacacacccacccacctaactacccacgcacctacccacctaccccttccctccacccgcctacccctctacccacctacccattcacctaccccatctatccaccttcccacccacctacgcaaccatctaccccatccgtccatccatgcagctgtcagcccattattcatttagtctctgagtccctcagtgctgagtgatgaggccacatcatggatagaacacagataaccgctgccatcacccagctgatgatacagtggtgaaggactacagatcagtaaatgtggccaagcgcagtgactgttaggagaggagaaaggatcctgcttttcctcaccttcttgtccctctgcaactcagagggagaatcaaaattcacattttttagagaacatggatctttcagaatatgagagtttcatgagtgtttttttttttaatttaacacttaagtatagcactctgaaaaataaacactctagagttttagtgtcttagaggtcatttagtttgcctccttgtaaccaaaccgatgaaaatctccttttctgacctcctgagaaatagatgctagaatctctgggcagcagtccttgtggtactcgtactcagtgcctagcaaagaggtccataatgagatattctgtgcgtctctgactcagaacattcctgtttcatcttccacctggattccttctaatgcttttcaataacagatcagtgtagttgagttttgtttagctatttctgtatgtaagcatttttaaaaaaggaaaaagaagcaaaagaaaaccacaaaaacccaacatgctgtttaaataaagaaaaatgagttttacttccaagagagctttcgtcattttcttaatgcttattctccttctgagagcttgttatggaacagagtgtgacagtagtttaccgtggtgagcctgtcttgtccgggccaggggatgaattagagcactgaaaaaggccagaggagtgggcagaactgtacctaaattatccccggatattgctaagtgattctactttttaaagacctccagagagagcatccctaatctcctttagtttgcctttacagtgtttaatgacctttgctgtcaggaaattcttcctcatatttaacccagctgtcccttcccaccaatcactcccatttcttttgttgtccttggtggtgacagaatataggggtcgttgtcttcttgataatatacttaatgttcctgaagggtatgagggaggcctcccttagcccagacttctgcaagtgagagaaatataaattttttctcctttacacccccgttctcagtggttctatttggacatataatctctgacgtttgttcttaagtctctgttgcaaacattcacatcaggccttcctggagatacccattggttccattttcactcacagggcaagatcctttcatgatttccctggctgttgattcattcacattaactcctgtttgttgagccctcattaggtgggaggtaccaccctagtggctgatgggatgtgaagaggagtgactcccactgacttgcacctagaaggaggagcctgaatgtcacctgccagttacagtccttgcgatagtctgtggattagaactgctggttcctctcttccacaaagacttttttttcctgatttatattttggtacatttagagtttacattgaccccatcctcagaaagttaaggcactgtcatattattcatgccctcttctcttgattcattttataaacaccccgaggaagtttgcacgtagaaactttggcctgtgagcaattggcgaggctgtttcccattagattctgtgcagtcctcacgagggggtgtgatggatctttgcaggtctctagcacttatcagaaatgcctggcacgttttaaacaaactaatgactggtggttggttgtcaaatgagttgttgggaaattttttttttttagttctctgtctctccactccttttacctcaacataaaagcagcccagagcttctgcctggctgccaatgtaggcagccctcccacctcagctgccaagctcttagcagatgaaataaaagtctatttataactggcctctgatggatttcctccctacctgggctagtgctccatcagcaggtgtactgaacagatggagaagggttttaagtttttcagttcaattagatcaactctctaggttctggccagcgcattccctttctcacttagtttcttcctcttggcattaaaattgttgagcatagcaaaacacaaattaagtccaggagataaaatgcatatagtgcctgcctttaaaaaaagcactttggctcaggaaccatatttgacatcatatgctaaatctgttttaacccttttttacctagtgcttaattttaatgtgttttaaatcaatattagagtactaagatgctaaagagcacaaatgctttctttttttacttttcttttcttttcttttttttttttatttggagatggggtcttactctgtcacccaggctggagtgcagagatgcagtcttggctcactgcaacctccatctcccgggctcaaacgatccttccacctcagcctcccaattagctggggcaacaggcacgcacctaccacactcagctaattatttgtatttttggtagagacggttttaccatgttgcccaggctggtctcgaattcctgaactcaagtgatctacccatcttggcctcccaaagtgctggaattataggtgtacgccactgtgcccagtcttttttcttatgatgtatttttagcattggaatttaagtgttttgaaactatatcacactgtttttgaagaaactttatttctgatagtagtttagtttatatgatgaagcattttaatgaggagatgaagtcattcatttcatgatggttgtttgatgtctttttttcacagtttgttgaactgttcaggacagtgatcaagtgataccacgcagtggtccaaaaccagtctgaatatggccttaggctctgggttttaacaccgctagtctgtgaaagatcagttgccacagtttttggtttccacatatgtaaagattcgtcataattagcaagttcacccttagtaggctgtatcacctcttgttccccacatcccagatttcagtccgtccttggctctcggatgggaggccactctgattgcagccacagttcatgccccacacagacattcactgagcctctgcccagcgttctgacacagacttccacaaggcccacatctggattctttgtccacgctaacaccatcacatttaattaattaatatctttgtgaagctgggtttgaaacaagaaaggtttggactgtttcagtggatgttttgttcatataactggagcaggttttctttggtggttttattttgccccattctttattatttctggatattttcaagagtgtggattatccagatttgtggcttgttctccagcctccctcccattttgttacccactaagatgcatatcatggttgtcaggggccaaaggagactccactgagtcagcctcactgctggctggaagtggggtgcatgatttaagttaggagaaacagtgcaaacaagaccaccgcttcctatttgtgtcattgtctggcaagtgcctttgaagattttctttcattgttttctgtactttttcacagactctcatatttggaggatgagttaaatattacctagaaaatcacttctctgatccttcatctccttggcaggatctgtgtcaaatgtcttgattttcacagtagtgatcgcgctttctcccaggctggctgacctgtgctgtctttggtaagttattctgttgagttgtggtgctgcgatctttctatccattactttcatctgtggcttctcctttaaccttttggggtcatacagcacaaaatctaatttcgacacgtggcagcctttcacatatttcaaaaatgacccttctgtattccaccaatcagacaggacatggttcagttacatggtttttctcctaaccatctccagtctagcaatttctttattgtggagtgggatgcaaaaaggaaagtcacatttttatgtaggttctgtctgacaagtgtggaaccattactgacctagttggaggtcaaggaagtgtcagaacttcctgtgtgcttgatttgaccaagtgtagcatcttagtctcccagtaggacaaaagggtttccgtgttatccagggacggggtggatcaactttgatcatttggacctggctttggtcatttcttggtacccattacatggctgggtgatggcagtccatgaatgtgtggagaatgatgtcaaacagggtgctggatgacaagttcgggtctccagagcacttatgtggtctgtgaacataaatcattccattcagtcaaacctccacccttgccccctccctcattgagatgctacaccactgcgtcttctctctcttggggccacttattcttgtcttgtttgtgaaagccaaaacaataggatgctaggttcttgaggcagataaaatagattcccaggttaactccatttatgatttgtcgatcttttcccttcttcactcctgcagtaagggaattatcatagggagggaccatcagacaggcctttttggggactttttcttatatagcgttaacacatttatttccaagtggtttaaaggcaaaatatatgaatgcctaggtattttgagatctttcagaaaatagaaggaatgggaatgttcttgttcatgttattgggctagtattgcatgagaagagcagtcaaaagcctaaaggaaatattagcagattgaatatcagtttttagagagaacttcttttggttcacctgggtagctggtagcatgctatgtgctgtgagatggtcacacacgctgtctcatgtaggtctcacacaactgccctgtgaggcttacattctgtcattaacggaggaggatggtgacactcaagtggggaccagctggtccttgcagcagctgaggtcataggcgcttcttcctgatgttgggtttttgtggctgctcttggtgagatttatttaccagaagtttgtcttctttatttttctttttaagactcagttttttttttgacttagttttaaattccatttgttaatcctaatagatagtctttgttctctaattttgtagtcacctctgacacccaagtcccagcttttatccacagtcctgcgctgtctccttattttaaaagagcaactcaccacaatcacgtagggtttattccagaaacaaaagaatagttcttaggaaagctagtagtgtaatacagtctattaattcattagaaaagagactgaccatcttgatagatatgcaaaagccatttggtttgattcaacacctactttttcttaaaaataaagaaataaaagctgttggtaaatgagatatagaaggctacctctctcacataatagagaatttctaggaaaagctgttaacattcttactaaagtcacggccagttaaaaatgcctgccacagtcacagttcttcaaccttgttttggaaattgtagctaatgccattaaacaatataaagaaataagaaatacaaatactggaaaaaggcaagagtcattatggtcagatgctgtgattacatggaatactcatgaaaggatatttcttgagcacctactatgtgctaagctccctgtcttgtaaaacttatattagggaagacattcaattaaatatgcaactctaatgtagtgatataaattccacgacagagaaaaacacagagacctatgggaacatgatagccatggctttctgagccctgcaggggtggggttggagaagtttttctctttctcaaacttgtcaagctcatggtgacctcaaggcccattgctgcagccattccttgtctgaagagctctcacccttgaacttttatggctgccttctttgactcagggggtctgggctcagttgtctccttttcaggagaggtcattcctgaccaccccgtctaacatggctccttacccctgctggtccataacagtgtcacccctgcagtgacttctgttggctccttgcatattctctgtctgcagctccatcacctcacaggtatcctccaagagcgtagggcttgtcagtcttgttcatggttttatcctcagggtagagaactgtgtcttccccctgtaggtgctcactaaataatttgttgagtgaatgtgctggaagacaggaggtggagacaggatatggtgcttataggctgccccttcaggaggaagcagagggtggagccctacctgggctggggaggcatggctttggtgaagacaggtcttcttttttttttttttttttttttttttttttggaggtgtgtgtttaaatgctgagcgaaaagttgatttgggagatctaaaagaagggggaagggaggatctatggcagactgggataaagggcacaggggttagcctgaaagaggaggggaaacagcttttacctgtaatgggagggtaggaggaggggattgtgcagaactgacgttcataggtttggtgatgggatgttggggaagttttcttctttgaatgatgctattgttgacagtgagaagtggtgggcttggagatttgaataaagtaggtaataaaatgggtactggccattaagaaagagaatgagacagagcagactgagaaatgtgggaggctggttgggtacccagttaaaggtggaagactgttaatttatggtgacaccaatctgtgagttcaggagattgtgcattgaagccttaagcagcccaggtatttgcatgtttttttttttaaaaaaaaagattattaattgtttagtgagatctaattcacatactgtagagttctccattttataattatacaattcagtggttattagtatattcacaaaattgtgtggccatcaccactgtctaattacagaacatttttattatccccaaaagaaactccataccctttagcactcactcctcattctcctcttccccctgtccttggcaattactagttcactttttgtctatggatttgtctattctggacctttcacgtaaatagaatcatgtaataggtggtgctggtcattagcatctggcttcttttgcttagcatggtgttcatggttcatctatgttgcagcatgtatcagtattccattccttttatggctgaataataatccattttattgacataccatattttgacattttatttatccatcatcagttggtggacatttgggttctttttactgttgggttgtttttagtatttggctatctcgaataatgttgctgtgaacattggcggacaagttcttgtgtgaatatatgttttcaattatctgggggccagacgtaagagtggaatttttgggccatttggcaacctatgtttaactttttgaagaatgtccaaactgtttttcacaatagctgcatcattttactttgctaccagtaatgtatgagcattccagtttctctacatccttgccaacacttgttattattattttttaaatgacagccatgctaacgggtgtgaagtggtatctcattccaagtgtgtgcatattgaagatgcacttagattgatccacagttgggattttgctagaaggctctatggaaaaagagaggtcttacgtagctgaggatggtggcaagtggataattgaagtgacgggtcagggattgaattaaagaaatttgcaggaccaaggaaagcaaaccacaaaaatttactaaagggaagaaaggaagccttaaattaatgaaagactcaatattgtaaagatgtcaattctcttaaaatctcatatgtaaatgtaatataattctagcagaaatcccagtgaaaaatttgtgaaggatttgctaaaatgatgattaagttcaactggaatgtttaaatgcatgaaaacactcaagatatatttgggggaaaaacaataacaatgatagggacttatttaccagatattaaaacatactataaaattagttattaaacagtgtagttttaggaatggaataaaccagtggattgctggaacaaaagagaagtcccaggttaacatgaacatgtattatagagatgacattgcctcgtcagaagtgaaaggataatttcataaatggctttgggcaactggcttactatgtcaaaaatgtaaagttatatccctgtctcacatcagctgacagcacaataaatttgaagttaaatatttgtgaagaaaaatatattcatagaacactagaagagtaactgcggtcatggggttagattttgtggaatggaagagagaccagcctcacagcgaagaggccattgaagacttggacagagctggctgtgatgcagccacagccaggaacagtaagaatggcaggggccactagaagctggaggaggcaaggaaagatcctttcctagcaccttcagagggagcagggcccctccagcacctcgatgtttggacttctggcctccagaactacgagaaaatcaatttctgtgtctaagacccagatttgtggtaatttgttgccacacggccctagggaacaatgcagtgactctcagacaggatttgatggagagagtggtcagaaccagtggcgctttctaaaagattgatgccatgagctgtgtttgtctagtctgggcagacaagagatttccattcatgattaaggagggcccacggatctgcgtgatgaatttgaggaggatacactggtcccgcagggcaaggacgtcatcttagtcactgctgtatccccagcgttaagaagagttagaagaggacacagtccacactcaatgactgtttaatgaattaattaataaatagaaaacacacaaaaatgtaaacactatccatttttaaaacaagatactaatttttgaataaaaccaggttgtggtggggaccatagggccagaatagttgccgtccccttcacctcccacttgattcacgcatggtggctcgaggggacagagatgtgagatcgtggctggaaccactgctctgagttggagctgctgaaatggtagcttggcggtctgccctcatggtgcatggcttgaagctacatgtcaaaggaaagcaccatccttgcaaccaatgacactaaaactcaagttagattatggcaagcttgtccaacccgtgggccacatgtggcccaggatgccgttgagtgcatcctaacccatattcataaacttttttaaaacattgattttttttaaattttaagctcattagctatcgttagtgtattttatatgtggcccaaggcagttcttcttccaatatggcgcagagaagcccaaagattggacaccccctggactatagtattaatgcatcacatagttcattcttttcacatagtgagtaaaaagtaattcgtttgataagcaattcttgagcacctcctgtatgctgaacgccatgctacgctctgcggtacagagaacaaagaggtggtccttgcccttgaggcttctacagattgttgtaggctggtagccatctagataagtagacaaatcacttggatatcgtgtgataacatacatgccatcgatagacacctaggatgctgcaggagcacggagcagggtctgccaacacactgggcattgtagattttacatatgatggagttttgagattacaggctcatgcctgtaatctcagcactttgggaggctgaggcaggcggatcacctgaggttgggagtgtgagaccagcctgaccaacatgaagaagccccgtctctactaaaaatacaaaagtagtcgggcgtggtggcagatgcctgtaatcccagctacttgggaggcgaggcaggagaatcgcttgaacctgggaagtggaggttgcggtgagccaagattgcgccattgcactctagcctgggcaacaagagcgaaactccaagatggagttttatttgggccatattgaggcagaggctcaaatgtaggtgaaatggttggttaactgtatggaataatgtgaagggagctgaaaatccatctgcccagagcaactatgcaggagcatgcctgaaatggcagctcatatttcttggcctcatgctttctaggagtcctctcctaaaacagagacgcctctgtcagattcctagagttcttctaagtaggcatgcctactttgttgagttcctaggtttgatttttgagggaagagaagtcacaaaggatggaacatgggatgggggaggagagaggttggagcagagcactgggcatttagggaaaagaatcgtgaagggaaaattcctagaaggggcaacaaacacagcctcaaaaatccacagctcttccctagactgggtctgccaggtgccctgatccagctctctggtcagccgcattctgcatagaaaggggagcagggctggtcttgtccccatggaagtgtgaacttggggctcgtcttttgggagcagagaaaaatagttccttgatatacatgtaagtttctatgtggggtattagaatgaatcctagctgttgggagcatgtcttttacaaatcaaattaagtatcttttatatatagatatagatagtctgtaatttgatggtactgatgagagtgaaaacaatatgtggacttgcccatttactgaaagatcaagcaaatacatttcagggtctttttgatagctgtgagtattacttgctagtattaaaatattttaattttcaagaacttggactctgtttcctttgatgaaccagttaggaaatattgtcagagaaaccctaaatttactctcattttcagtcatgaatgaatccctgattactgtgatgaagaaaaatcctgggtcccaacttccttgcccaaatcaacacaaatgtaacctttcatcttgatcaggagatgctgaaggtagaacataaacaaaaacataagaaaccgttcatcactctgagagaggtttaattttcatcagtcaggaaagatacagacaccaaatcaaaggtgttgataggatttcactgtaaggttttggcgattttcttttccctgggtgttaattctccccttgggctgatggtggttggcagagctggagcattcaccgtggcttttctgattcctctttcccatgttggagtaatgtttttagttcattgcccaaatagccttggcagctataatcagtcactggagtatatccttgattgtaggagagacttgataataatgactctttcattcatttattccacaaacataggctgagtgttagctgcgtgcagtgaaccatgggaagtgctatggggaagcacagctatgtaaatcatggctccaactatgtgcaaaggccccatgacataaataagcacagaagatgtgtctgtacctctgtatctgctttataacctccctgaggaaatgctacaggcctgatccatctctcccctctttaaagactgtcaggggctctctatttcccccaccatagagtccaaactcgagcctagtacccaacattcttcagaacctgaccccaagccatctgggtgtcctcatctcccaccgctccgcccacaccctgggctccagcatttgactcttccccagtgtgccgtgtgctccttaccgctgcccctggccttggcactttctgttctctcctctgaggacgcctggcctcatcttcaacagctggtggacttctacacgtccctcaaaaccagctcctctgttacctccaatgtggcactcttttctaagctaccccaattcccacccaaggcagaatttgtctctaggcttgtgctagaacatgtaggatacaggggttctttgggaagaggacattgggaaggcatatgggaatgtggaatatgggaaggcaacaattcttggctttcctggtccagcccgggctggtctggtcccctccagatgatctcagcgttcatgaaggcaggttctggagacttaggaggagggacccctcccctgccttccctgggacgtggaatcccctgtgagcaggatggatctagggtatgtcttttagccttctgtatatctgcatagacttttcttctgccttctcatagttcatagcttgtgtctacacaagaactctctaaacatgtgatagcgaattaaagccattaactccattatctgggatattgtttcaggtatattttaatattgctgtataatttgtccataaaatgcttatcttcataatgaaatatgaatgggtctttgtccgacagaagacttttgttgaataagatgatggcagaacgctgtaggatcctgctatttgaatcttcttggagtcacattccttagcatctagaggaggtaacagaggacatgtggacgtgctttctgctggcgattaagtcccaggcttgggagtggcttgtagcaggctgatgattgaagtctggagtgattctagcacagaaaagcaaccagggcgcaaggtatttctgtgtgtatttggttcgctgatcagcacttgggttaccaagatgattaaagcacagccttgccctttgggagagaaaaccattcaaagaaatgctgtgacaaaagacacaagcattgagtgatcaagtacagcatgtgcatgattattggagagcaccaggttgtcagtgaagacagtcgtaagggaggagagatgaggtggtgggggagacgtcttataatcgagtagagtactgagaacaatgctggggttatctctctggtgtacaaagggactaccttggtcagggtcctggcagaaatgtacctaagagggataattggagaaagctgaaggaagacactatttacaaaggtgtggtcaggattaagagaaaccaacaagagctggcagagagctttgaagctttaccatgcctagacccaaaaaggggcaagaagagagcaatgacaagtattgaaccgtgatataggagagggtcgccctgtaggaattgtgccctttagtagaggaactcagccactgccaaactgtggaaagagggctgggggaagaaataccgagtctcccatcagtgtatcccattggccaagtccaacagaaaccagagttcaagggagcccattgatacaggtcgtgcaacaggatagagagtggtcccagcagagcacacagagactgtcctgcagaaagactgattaggcaccggcaagagtcgtactcagccatgttgagagccctgctgagcttggaaacaatcactttgtgattgtaccaaataggaaggatatgggattctcattgggtgagcaagagtgctttttctgttatttggaagaggtatcactctaagacctgtaatttgcccatccgtgtctggtttttgacactggcaccctagaacatgtacaaaagggtagtgacaccacgatttaaggaccagctctctgtgtatggctcagtcacttccaaaatactaagctaaaatgttttggattcttatgttttatccagcgttacctcacgtcaattcagttcagttcaattacattcggatatttgctgaacatcaagaatttcttggaactatgctggatgtgctcaggatacccagatgagaaggcatggagttagaatacagtaggggagatgatcatgtaaacaaatcgtataattaaagcgaagcctggtgaatctaatggaagctcttaactgacctgcccttgcagactcactgtgttaattgggaagccttgttctctctccaaacgctgtggctgctgggctggctagcctacatggtttcggcttatttggctgtgtctctgtgcacctgtacacgtccatgatttgcatgtttaccaagagtctcctgtgtgtgttcccaaatcattttatgtcagttgttagtaattaaatttatacaatttaattacgttttaagtgaaccagtgaaatatagatgcaaaataaaaagctttcgtttgcgttaaaattaagtcaaacatttcagaaaaagttaataaagggtagtcacttaaaaaatgccatttgaaatgggtacagataagacagctcctcatcccttaaagctggcagtaaggatgatcttgacaacaataagtttgtcgatggtaggcaaaaaattaagactgtaccttgatggtttctcaatttttctgtgagggaggaatgagcagtgaaatgatgggggtgggagcctgaggaccgtgaagacagcttgaaatagataacttggcaggggaacgggaggttgctggctagggcctggagaaggacttgtgggcagcactgaccgtgcatccacctgaggctggagattgtgatttttgtcatggcccccacctacctaaacaactgtgcaactttcttttgcagtgcttgacaggctgacgtagaagtgcaaaaatagttgcttagagcgatccaggatggggattttgtgggggcaggtgtggcaggggtttaaggggaaacgagagttgagtttgggcaagaatgatttaaaagtgacttaagccttttggccagaattgccatttttcattaatttgcctatgtgatgaacatgaagggaaagaagagaggtacctgctatgttttctttctttcttactccctctccctctctcttttttttttgagactggatcttggtctgtttgcctaggctggcatgcagcggtatgatcatagcttactacggcttcagactcctaagctcaagcgatcctcccacctcagcctcccaagtagctggaactacaggtgcacaccaccatacgcaactaatttttaattttttttttttttggtagaaacagggtcttgttatgttgcccaggctggtctgaaactcttggcctcaagtgatcctccttccttgggctcccaaagtactggggttacaggcatgagccactgtgtaaatgttttgtaggacttttagaaaacatggggttgtgcctttggccacatgcatgcttgtggatctacaagaacagcggtcctgtaactcttcagggaaggggcaccacatatctgtcctgtcaccatggcaaagctggaagggtctgcagagctacccagcatgctgctggtgttgttgtaaccaagcagagggcaagattctcgccatgagaattgatgtacatgtctagcatgtgaagcatcctaagggctgaggtgggttcctgaaacctgtggaggaaaatgctcagtgcaagaagccaaagaaaaaggcaccaggctcagcgggagcacccgcctggagaagcatactttgtgaggatcagcagaaaggagctgagtgtggaagctgtccccaagtcatggcacaaaagtattcaaaagaaaggatttctggattgttttttaaaaaacaaaactgtgatgtaaatgatgaattgtgctctgtggtctgattaggaatgtgagtggatccagagtacagtggggctgaggcaatggaagtatttttttgtgtttttttttttaacttttaggtcagggatacgtgtgcatgtttgtttaatgggtaaacttgtgtcacgggggttcgttgtacagattattttgtcacccggataccaagcctagcaccccaatagttattttttctgctcttgtccttcctcctgccctctacactcaaggaggccccagtgtcttttgttcccatctttgtgtccatgtgttcacatcatttagctcccacttctaagtaaaaacatgaggtatttggtttcctgttcctgtgttagtttgctaaggataatatccgccagctccatccatgttgctgcgaaagacatgatgtcgttcttttttatggtggcatagtactccatggtgtatatgtaccacattttctttttacattctgtcattgggcattaggttgattctacatctttgctattgtgaatagtgctgcagcgaacatatatgtgcatgtgtctatataggagaatgatttatattccttggagtatatacccaataatgggactgctctgtcaaatagcagttctgtttttagctcttcgaggaattgccacactgctttccgcaatggtcgaactaattcccaccaacagtgtgtaagtgttttcttctcttcacaatctcaccagcatctgttatgttttgactttttagtaatagccattctgactggtgtgagatggtatctcattgtggttttgatttgcatttctctaatgatcagagatgttgaacttcttttttatatgattgttggctgcatgtatgttgtctattgaaaagtgtctgttcatgccctttgtccactctaatggggttttgttttttcttataaatttgtttgagtttcttattagatactagacctttgtcaaatgcatagtttgcaaaaattttctcccattctgtaggttgtctgtttactctgttgatagtttcttttgctgtgcagaagctctttagtttaattagatcccatttgtcaatttttttcttttgttgcaattgcttttggcatcttcattatgaaatctttgcccattcctatgttcagggcagtataggttgtcttccagagtttttatagttttgaggtttacttttgagttgactttttctatgtggtgtaaggaatcagtccagtttcaatcttctgcatgtggttagccagttatcccggcaccatttatggaatagggagtcctttcctcattgcttgtttttgtcagttttgttgaagatcagattgttgtaggtgtgcaaccttatttctgggctctctattccaatccattggtctatgcttttttttttctttcttcttcttttgagacagggtctcactctgtcacccaggctagagtgcagtggtgcaatcgcagctcactgcagcctcaagtggaagtctcgatgagatcagggaggagtaggtgtgaagacagtagaagttctgggaggctgaggttggggaatggccctttgaccttgggattgcagaggtcgaggggcttctggtgtgggtggggctgcagccttgggtggtgtaagtgaagtgataaagaccactggatcagaagacatctagaaacatagaggcaaaggggtttcaagaccttctttggggacattgagaccaccccaaactgccaagatttgtgatagataagtggacagggagatcattggcaaagccattgataaatatggtgacagctccaagaagattggcaggcgagagagaggctgaggagtgagtgtggtataatggcatgggcctcaaagggcttttccctaaggagaggggaatggtggttttcccctgtatgatttctttggggcaaaccagacccgtttttctgtaagcacaaaatttgtgcttttgattagcagaatatctgctcccatttgaggaggcatctgtctgctatccgtgtgactcttatggaaaattctaaaagtgactggtgccataattggagctaggactcacttcttgctcctatgattctactttgatattaaataagtttcctttatgagacaccagtcagtaaatagaacaggatgtatggttaaatagctaaaattattttcatcattgcaattatagtatgccttgccatttcaaaccaaatatccacttatctttcctgaaattttgcaagaaatctattattcgaggatgcagagatgatttttttttggttgagttaaacatttttatggattagatatgaattcagtaaaaataattgaattgggtaatatgaataattcatgacatgtaatttcacatcagttctaccttaaaaataaagctattggtttatgtactgggaagatgtattttattatttagaaaggtagagaacattattttggaatataactcactgtatgattaactagatacattaaatagtaagattgaaagaaagtacagaattcaaactaaggtgctttgatgcaattcacctgttccatcttcttgatgaaacactagttgctctgtgtctgtcattagcgattccgcaaggcatgtggtgataagacttccagattttgaggatatgtccagtaattgtgcttgaacattgtaatgggtgtgacggctgccaggtgcctcatttggggagtaggggacaactttctggctaggtcattctttccaaagacatgtactctctgcttcctctgtgtgtagcccagcatactgggacatccatatgactaaggcttggggagtttcttgcagagtggtgtggtggcacagatcaaaatcttggtagaaaagtgagcccaggtagtcacaggcttgacccaagcctggaaggaggagcaggagttagctatggagaagaagaggggagagaagggggacactgaggagtgagaatcacctgtgcagtggtaccagggccagagggagtcagtttggacctgctggctgcaactggacggaagaagcacatggactgtggtgggagatgaggctgagaacattgggggccaggctcctgaaccgggctaaggagcttgaacctgatcctgcaggtatagcgggaaccactgagcagcgctgatgacagagatgttctgtgttggtaccatagtcagccgaaagtctctcgtgaaagttttccctcttaaatgtttgtggtggtagttcaaaatggaattggtccacaaaggtattgcacaatagaagatgcagtatcttaaccattgctatcatttgttgatgaccagaagttcaatcacagaaattgataccaatacctgttattactcacaacaatgcgtcatcctttattaggctcctagtgccttttggccattttacactaagacaaaaccactaactgctttaaaaggcgttggtcacaacttttatgatttgagattaatcaaaggcaccgaatgtcagagtctcctacagaactcagccaacttttagggcaaggctctgtacttctccatctttagaaggaaagcagggaaaaccgtggaaatcatgctactttcattctcttcttggaggactatcccctgggtaaaaattcaaggttcttctaattaatacattgtaactaacacattaatgaatactgcctggtgagatgagttgtatcttaggtcacagttgttgaagccagacaacgtgaaagaagatgatgggcaaaatggatggttttagttacttcttttttaaataccgtattgtttttgttaaatgatacaagctttctatgaatgaagtaaaatagtacctgaaatgcaaaggaagtaaaaatcactccaaaatttcatcctctagaacagcagttcccaagctctgtggcaccagggactggtttcatggaagacagtttttccacagactgggggcaggggcgatggtttcaggatgcggctgttccacttaacatcatcaggcattagttagattttctttctttctttcttttttcttttgagatggggtcttctgtcgcccaggctagagtgcagtggcatgatgtctgctcaccacaacctctgcctcctgggttcaagcaattctcgtgcctcagcctcacaagtagatgggattataggcgtctgccaccatgcctggctaatttttgtattttttagtagaggtgggattttgccatgttggccaggctggtctcaaactcctgagctcaagtgatccactcgccttggtctcccaaagtgctgggattacaggcatgagccaccatgtccagcctagattttcataaggagtgcacacgtgcttagatatcttgcacatgcagttcacaatagggttcgcactcctatgagaatgcaatgctgctactgctctgttaggaggcggagctcaggcagtagtgctcgctcacctgccactcacctcctgctgtgcggcctggttcccaacaggccacagcctggtccactagctaggggttggggacccctgctctagagttaactacagatgacattctggcgaacatactaccagacatttctctagaattcataactttgtattcttagtccttcttgcaaactctggtgtgcttggtcctctctgtaggatatctgttgagattgcctagaatttttttttctttactcttcaagtttcttaatttttgccaagtgttccattattggaacgctaagcatgtgggagttatttgtatcctactcagggtcatcgccaaggtctgtttgcaaaaattcaaaaaattgcaacctcaggcataaatgggtacggactatgttcaattttgtttcttctttttacagtgtgtggcttgttttgtaaacaaatgaatacatgaattaaatctatatggagtacaaagggatgaaggagaaacagcttctgagctgtttgtaaccatccttgtttgcataacctacttattattgaattcagttcagagatcatgctggtggtcatcttactggttagctttgcctcactggactagagtcactcagatgaaatgagtggaggatgatacattaatgttttccagagatccttcctgtagcttactatttaacatccaatccatcaatggatatttgatattgggattaaggtactagttatatttatggataaaagagaattgggttaccttagctaacttgatcaaaattcaaatggttgtggttaagtagaagaaataggtaattttaaaatgccagagtttgaatgagtgcaagtaaaggcatgtagatatgaaaacctcatccttttatcttgatggtgttttgaaacttcaagtattttttttttcagacctccaggaagaatggattttttattgccttcacgtggggtggtttctttgtgtacgtgaatgtgccaccagggcagtgtttctcctggggcagtgtttcacagtggggcaagttgtggacccacctgtgaccgtggtgcatttccagagaggagaactgcggatcttgtgcattctctgtgtctccttctatttttcaagagacctttaaaaagtttctgtctaggccaggtgcgatggctcacacctgtaatcccagcactttgggaggccgaggcaggtggatcacccgagatcaggagttcgagaccagcctggccaacatgatgaaaccccatctctactaaaaattcaaaacattagccaggcgtggtggtggaggcctgtaatcctagctgctcaggaggctgaagcaggagaatcacttgaacctgggaggcggaggttgccgtgagccgagattgcaccattgcactccagcctgggcgacaaaagcaaaactcttgtctcaaaaaaaaaaaaaattctgtctaaattccagtgatgatcagatgtgaacataaacacgttcaggatcatatacattgctggatttgccatatctgactttgtctgtttctaggatattcgaaattctgtgactcctattaatgtatcattctcctggggcatcacagctgaggctggtgtaggctcactagtagcccagcctggaaaacaagctactcagcacactcctcttagcttggctttgttgtgtgtgcacttcatgagggtgatgctgcccatgtgatattccagatgtaggtgagtctccagaacggacagcagctacagtagtgtatcttttagagagcacggaagagttgcttaaaacttcttttctattcaactcttcatcagaggtactcttcatgacctcatctattcattcatgcaacagatatttactaaatgtttacgttgcaatggacatagtagaatgaatcatcaaaagcttgttattatatattaggttgattttttccaggagaggagtttaggaagacattcagtctccttggtaaacttgtacatgcctttactgtcagccttacttaaccctttacgctatataatatgctttctctcttaattttctcacgagtttgcaagccccttgaggggtaaagatggtatctcaactcttcgcagttctattttatgcaaatagaggcagtggtggctaattgatgattccatcatccagaatatcttatgcctctagcttctgactgacggagactctgttttttaacagatgatctgaaatgagtttgctgtaggttctttgctgtcttggtcacccctggacatgattggtattctgcatgactatcattggtagtggtagcatggtatcgtaaaggcaaggatgtaaagagaaacaaactcgggcttcagggtgaaaacctttggctctcctacttggaaaatggacttgacctgaaaaatgagaattaaagtctacatctttcagggttattcagaaagttaaatgaaataaaataaatataaagtgatgaggtgaaataatttcttggaataatgagtttccttgattcacccttgagcagacacctgttctcttgccctgcagcctctgatgcagggaaactgagagcaccaagcaggaccttgaggaagagaaggggaagaccagctcaggaggaggcctgattctcatgcaggcttagagcacagcatgcatgggttggactgtgcagatcagaaggggtgggaatgctgttcttacaggcttaggttttctctctttattcctccatccttgagcccctggaggttcaaaaaagcaaagataccagttattaggaaaaataaagacattctgtgtttgtaagtggctgagttgaatctgtccaaaccagcttatacttgtgcaaactctgtgtctggcttgcacagggttgacattcagcaaatagtagttccattccccatatttctcctctctctctccgtaatgataaatatgaatacatacatatctatatataaaacctgtgacataaaatatatagaagcaacttggatattaaagtgtgagtttgtatgtgcacctatccccatccatccatatgctagcagtacctacatcccttggaagtaactggataattggagacatgggtgggatgttgaaggggcatttctggtcatcttaatgactgggagtgctattggatgtatcaaggacgctaaacattcatcagactgtcaggcagtcccttatcctcaccaatagagaatttttctgccccaaatgccagtagtacttccattgagaaacactgtatactgacagtgtggaacatttctcagcaactttgtgaattagagactgctcattattctatcatacaggataacaacttttcaggggaagttatctttaacttccctgtgccccgactaatggtattactcggtgagaatgttgactgcatgttgatccccactgggggattctagacatgttaagctctaacatgtatgtgaatattatttcagatctgagggcattgtgatcattgttctctttctgttggtgtggatgaaataagagttgttgctgcttggatattttcccctccgacattctttcactgggaagctattagacaaaaattgtgtaggctttgtggacaagacatttcgacggaaaaaataatcttggcgtcactatgcacacacacagagaccgcacatacaaagcgattttggagggcccttttgaaattacatagggaaaccaacagtgccagtaatagcacggggctctatttctcacagtgcttttgaaggcatagaaagcaaatgacaattctggcggtcgctaagatgtattttgcagtggctggaaagaaactagcattcttagaggagtccagcaaattgtctttgagcctttgagggcacacagaaagctaatgacacctccgaggaatagccttctcaggttttagatgccacagatgctaaagccaggatataaaacctttcttatagggcctttaagaatcctcagtgtgcttttattagcaagctgagtgtgtatatagagatgttaatggtctgtggagcaagctcagcttgtttttgcaaactacagaactataaaagttatcagaaaggacacattcttgcctattgctttgttcctttgtttcttatttatttccttctctgtggaatgttagggcactgatcatgtgctgggtcccgtggatacaaaggggaatcctctgtggattcttctctctggaagcttgccctccaatgtaggagaaatgtacacgttcatatccacagtgcaaagtatagaaggcaatgacaatgcaaataaagcctaaattaaatggaaatttcgccacagaagaaattacttctagctgataggatcaaagaaagctacatagacaaaagagtggaaatggtatttaactattttcaaggatatgtaggatttgggcaggtagcaattagctttcaggaagaaaagaagacttattgtaggggagggcagtccatgccggggagtggcattcacaaaggttatgagtgtgaagtgagaatagctaaggttagcaggttcgtaggtgtacactcctgaccgttgagagaatgatcctggatttactgctcgttaatgaatggttaggaatcctagtattcacacattgatgtgctacagaaatccctatggagcttgttagaaatttctatccctgggaagctctccataccctgtggttagaagatctcagagatcttgccgtctctcattccctatggccagtgtccaccctgcagccagccactggggactctgtcgctgcctcttcctgagctgggaggcgatgctgggatgccagaaacacacaggagggaaatggagaacacttttctcagaagtataatccccaaatctcctcttaagccattacaataacatctcatattttatttaattttctttaaatggaaaaaccagttataccaaatgaaaacaaatgactgaagaagaactgaatgatgtttataagccttttatatgattttttaaattgagtttttggtctcctaattgattaataaagggaaagacagagaagactgacatgtgttatcttctgtcacagttcagatagagtgaaatgactcccaccttgccaatacaattctcaaggttgattgctaattttaatttatctgaaccgtgcttttcaatgaggtgatattggtcctgatcgttctgtaaattggagattttgcccgaggaagttaattctcccctttcacaaaaaaagtttggactttcagatgacttatttgacattagcaatgttagattcttgctccactgcagctctgcctggccactctctgttctttttgtcactgaattctctgaagcgtgtttgactctgcttaggggacccccatcactaagcctggggtctggttaccatggatcttaggcagtttggctgctatagcagcataccgtaggctgggtggcttcaacaacaaatttatttcctcacagttctagaggctggggaagtccaagatcaaggcactggcagacttgggaagtccaagatcaaggcactggcagatttggtgtctgatgagggctctgcttcctggtttacagatggtcaccttcttgctgaacagagagagagaaagcaggctgtcctataagggcactaatcccattcatgatggatccacctggtatatttaaaagcccaatgacagtcctgtgagacatgtaatagtaataagatactaattgctgtttatcaaatgagccttgtgtgccagggactgtgataggatcagaaaggttaaacagtttacccggagtcataaaatagatgtttaaaatagttgcagagtaggtacacaaagatatgtcttttgacttatctagatggaccccataatgcagaagaacgagtcttggccatttgcatactgacacttgggctagcaggccagaaggttctacaataggcctggcctcaaatatatttcacttgtaataagcaccatatggggtcctgccttggagctgagtcatacaagagtgcctagagtgccttttaaaggcctacagccatccaactcttagggaagggagtccgcattggacttgggtgctctgggaagtggtctggttcctggatcaattgttgatgaggtatatatttcaatcatgttttcccacggactgtggggaaggcggtgagggtggctggagacagggttggttggggagaaggggctgctgttggttgaacattagttacacagagctgcgtgctataaattctggctcactgaatcctcacgaccactctgagacttatattattaatatgtattagaaagaggacagtccgtggggtgctctgcctcctggactcctccgtcaggaaggttgttggttcagggccagccactgcttggctaacgcctcagtgcttcagcgacaaggaccaggccgtgggcacaaataaggtcttaggtctctcctctgtgcacatccaggagagagattttagggatagttcctactggcttcatcactctagggtttaaatctgggctttgctgcctaccagctgtgtggcccttccagcgtgaacctgtccagacctgagttttagtatacccacagtggggaaaaaagacctacatcacagggttattgttaggcttaaaggacgagacagatgcaaagtactaagcatgtggcctggcacaggggaagtgctcaggaaatggtagtgactgttaagactgtgatacttggaggctgaaccttaacaggatattatcctgacctgtcagtttagctctttggatcctatggtttttttttgttgttgttcttttgtttgttttttgagatggagtctcgctctgtcgcccaggctggagtgcagtgtcacaatctcggctcactgtgacctctgtctcctgggttcaagtgattctcgtttctcagcctcctgagtagctgggattacaggcacctgccaccatgcctggctaatttttgtatttttagtagagaaggggtttcaccaccttggccagcctggtctcccaactcctgacctcaggcgatctgcccacctcagccttccaaagtgctgggattacaggtgtgagccactgtgcccggcctggatcctatcttaaaggaatttctgtggtgataaattatgaaatgcctttctcgtgccatccgacctcctgtgttcactctctgcacctttctattgtttcactggaagtgtcatgatattccatgagcacgttggttgctattaccacgtaagacaatgggaaaaaagaagcctccagcttctgggtgtttaccgtttggaaacacagcacaacacttgacattctcagtgctgagctcatgtagaggcagcagacagactgcagatacgtgcctgtcctgccccattagctgcttcgcaatgggggtttcagtttatccctgtgccggtgttgctcccaaacacggtgaccgtggggcacatccatgcctgtctcacataccaaggcactgtcagcatgtgctcctgctgcaggacccttcggccaagggattcatcctgcggcacaggctcgagtctaagtttacccgtgacctgtggtcattctgtggacggcagaccaggcatgactgcacgcctcgtatcagaactcggaagcctggtggtgacaggaaacagtccgactgctttagagaggtattagtgaaatgtctaggagggcagtcttctcctatggcagaacagagcaactagaccaaacgcttggttgaagtatatctttaagtctttgattaaacatgccgttgcattttctgtttaaatgttgttttacaagctgtgttctgactgcaaggtagggtttctaagaaatcagtcccaaagagctcttgccccggagtgtttgttgtgtagcctaggtgggctgtaaaagctagagctgttgctaagggaaccaacggaggaatgtgaatttgtaaatctctcaatcacattaacattttgtgtaatatctgacctcagctttactttaaggtgaagaggaagctggtgtaggaatgatactggtcaaagatcaatgagagaggcactgtcattttagaacttgacactttgtcatcagcatttctatttcactcttgtaatacacaattctttatttctttgtaaaaagtcctatataagcaatacctgccgtggttccccacttttcaggccatgccctctgtgacattgggggttgcctattttatagagaggcagagtggtgaggagaaagtcattcggtgtttttgccgttgaaacctaaatctctaaggtgacaaaagaaatcccagtttacttggcatgagagagttttgccagttccattctacctaaaatgctcttttgctctgttttatataagagaggaagaagtcattttattgtgctgaaaaacagtggaagtaaagttaccaacgagtaatattaatgacttcaattcataatattgggataatgactaatgtgccaggtattatattaggtatttaatatacatgatgacacttaaatttatactatggtcaggcaaaggtatggttcatgatcccaagcatataacatgcacaccagctgaatataagatgaaagcaacattctgtgcattcgcgtgcccctatgctaaatatacttaggttgacccatatgaaattgccatttttatgggcaaagagagccaaatatcggtaattccaagtggttcagcccagcacatgtttgcatatacgcaaactggcagacgcagttctggaattttgttgagacatccccaaagtgtttcacaggcctacagacacgtgggtcttttcacagaggcataacgaaccatgcagaaaggtagaatcctcagatgctttatctaataatcacagaactgaagatccagaaggatccttgggggctgcgtgttgcactgtggttgtttaatagaagtaggccccatgaggtgaggggacctgcatgtcgggtgagttagggctgactgtgaggctgggacttaggcctgtgtggcatctggaacactgtattctatccattttaaattttaggccatgaaagtgagtaacacatgggctgtaacttagaagtcaactaagtgataagggcttgcagtcacgctgggcacagggaccccgggcagagaggagctctgcggtgcagagaggcacattggtgaagggagccaggcattcagccacatggtagaggagggcgtccttatctatctcaactagcttctgctatcggacttctggggagaaagggtttggtgttcaaggcctaacattgcctttcctctcagaaggtctcgttcatgttacacagctttgttcaccctgagcctagcaagctctgagctccttggagccaccattcctctctcgtacgcaagaaacaagtcccagctcgggagcccacaagattaaaaagtgcagataaccagtagccgtatggaatcatatgtcttgacaggagctatggacttgtcctcatttttaaatttatagcactttgaaaaatcacaagtgtgggcctgtacattgtagcatatctcttttgacacagtgggaacgagagcctttacgtcaagggatactggttagatgcaggccttccagaagcttctgcagtagcatcatcacagctgccctgaggcaaggcaggagcccactcggggtcaggggttcaatgtcgggtcccctccttgcaggacacacttcattgctgttgggggtttcacctgtgactgtgtgtcttgccctctccttccccattcttggtgtgtctttgtaaaattagaacttgtgtcttcttctctccacatccctgtactcagtgtccaccctgctgtctgtccagcatggacggcaaatagtctgtcaaacacctctctagtcattgtcgtcatgggcccaaaaagactgttagcctctttaccgtatagatagatcaaatatatatttttgtcgaattctgcagtaacctgtgatgtgcgttggcctgagacaaaaattcgcttccatcctcagatccttgttgtgttctgaagagggcacacatttaacagaacaaagctcgtctgctttgctgggacgatgggtggctcgcccagcaaatcatcattggagccttctttattttgacgtgagttttcaaaaatagcatttctgcttttatttctcgacttaaaagcatattttaaaaaattggttttctgcatttgtgtaatcaagtacaggaatggttttatggttttgtttgacttaggaacgtcttggtgcctgccatttttcacggccatcatctgaaaggttctttccactttcacaagttgttaactgctttctttgagagcaagcaaagtaggctgcctcaaatatacacctggaatcggtatttatttccttattctgtgccctgtttcattccaagattgtggtatactgggaaataagagaattcaatgaaaagggcttctataacaaacgaactaacccattagaaagaactgaccataagcttagtaggaatcagtcatgtgatgttgcagctaaaatagcgaatgctgtggttttcaaacttgtctaaagtgggagaccccacttcctaacagtgttctgatttgggaccttgtgcacaaagtgggcagtgggagtggtgactggggaggtataaggagcttagagcctggatgggtgcctgccctgccccttccaggtaaccccctgaaacttgaaaaccattatgttaatacgttaattatatagctatagggatcccttaagtaaatacaaagttttattactgtagaggcatgtttttatacattgttttatttgaccctgaagaagagaccgcaaaggcattatctctagtgtctgtatttttcatagaaggaaactgaagatcagggagattagtaccatgatcaagagcacacaggtaatgcataaggcagcagggattggaatgtgacttagtttagtgctcatttcactgggtcacaggcgtatatagatgaaataagagccttggcttcttggagctggtcagactctttctggattgttttgttcagtgatgggtggtaaattggagaatgttgagagaggcgtgactgggatgtatccctgtgcagtacagatagaggtgaaagattttaaaatggatatctctttgagaggtaattcattggtgtcagctggtttcaataaaggtgctatctaaagaaaaaggtgctatctacagaaaagcttgaagatgggagggtgtgggagccgcgggacacggtgtggatgtcacagtgaagggagaaggagaagaaagggaggcccaaggcagggcagaatcttgctgcaacttcgatgttgagcattctggcccacgggacacacacagcccaccagttttcaaaatacattctttgttcctttgccaggataagaaataagacggctgctttcatgtctctacttctcaaatatgtcagtcttttcagtgacattcttttattcaatgtagtgggtgatctgaattgcaagaatatttcctattttcccatgggactaaattaagttatttgcattttgaatggaatagaagactctaaacacatttatttttttcttcctgaatcatccttggaaaaagaggttgctcgctgttgatttatttcacaattttatctgggtaaaagccacttgcaaaaccactccccttatcttagtacaactgtgctagtgcagaactaaggccaaagggtggaaaattccgtgagagtgatttggattcactcttaaaatgatagcagcagcagcagcagcaagactcacagcagcagagctagctaccagaaacaggtggccctagagctccttgtccccagaaatacacaggtagaggctgggtgctgtcagtctcagtccctgaggagtagacctctgtgttgggtgttacattaggccagtctgttcttttgagatctaagattctgttattttaaaggctttcattactatcccattagaaggatcaatttgaatttcttgtatttgagtggaaaatgccgaagaatactgaggtttgagtttctgatgttttgtgaatttttcactgttgatatttcatcagaaagaatctgagaatgttatgatgtaaagtgggccagatttgctaatctattttaagaacatgtaatctgtgaataataaaagcactgatttgaatattggaatgataaagcaatattcttaattttaaatgattcttgttttaaaaatagcatgttttaaaccacttctcatgatctttattttcacttattttttatactaaattcgggggcgggggacaagtgcagttttgttacatggatctgttgcgtagtggtgaagcctgggctttactgtagccgtcacccaaacagtgtgcattgtatccattaagcaatttctcatccctcatcctgcttccaccctcccaagtccccgatatctgtttttacactctctatgtccatgtatacacattatttggctgccacttacatgtgagaacatacagtctttgactttgtttctgagttatttcacttaagataatggccaccagttctattcatattgcttgatttcattctttttcttggctgagtagtagtccactgtatgtatgtatatgtatatacaccacattttctttatccagtcatctggtggtggacattgaggttatttctatatccttgctattgtgaatagtgattggcacaggtgttgctgaaagtgtcctgagtgtaagaagtagagaaggattgttttcctcagtgttgtgtgtaaagtgcccatattttatttgtgtaggggagagaagatttctgttcttacccatcgctgggtttctggctgagtcatctatagcaaaagacagatgaacaggaaaaaagtatacatttatctgatgcaagttttctgcgacacgggagccttccgaaatgaagagcgagggaaacagggaaacctgtgtattgtatgcttaggtttgatgaagagaggacagatgtggaggagtgtggtgtgattagacaaaggaggagtgagctaatggtgataaacagagggatactcagcaagtcctgttggttctgattcttctctgtgtccctgtgtattcatagatgtggttgttccttcctccagttacagggagggcacttcaccaatgagaatcttatgacctgccataggggagaagggcaggaaaagggcatagagtagccttcctgcttctgctgctttcttgaatgccacagtgccatattttcaggtagcatgtcctgaaccccatcatttgcatagctttacaaagatttcctatttttatttttgattggttttcacatttcaggcatttgccataaatgtttagctttaccttgatctacgagatttggaatttgatggcctataataaattcacgttttagcataccaagggcctgatattacaagcaaatgaacaaacatacaacccctacatgaactgttgtgtaatatgcataatttctcggtttctctattttataatttggatttttctgcagcagggatggagagagcacattttctatcagaagttaccagtgcacaggaaaaatgagtcaagatcaactgactaaaaagaagcttaactcctttaagagagaagtacgttctactttgctttaaaaaaataagaacagggacataaatctatctaatggctaaaaatagaaatgagtgattgaggatgaaaaagagaaggaaagagaaagatcacagacacagacacactcggagacttcacagtaataaagaaaaaaaatcaaggactcagagtgagacacagacaaaacgagccatacacctaaagatgaatatatgcaaggcaggcaaacggaagtcctttttgggggctgtgcaaatactggtgtaacataagaaaaggtgatgggcagatgcagtgagttgtagagggcctgttctgtccaaaggcactcaaatccaacaaaccctgcgctcaccaaaggaaattcatctgtcatccactggccaccagcgtagaccctgggttctgaacacccacagaaatgggagtggacgttatactgagtgcttaccctgtgccaggcctggttctgtgtgcctcgcccctcacgccttataatcctcacatcaccgtcgggaggcctgtgcaactgccatttccccacttcagaggtgaggaagcagacctagaaaagtttccatgacttgtgtgatagcacacaactgatcaaggatgagttgaggtttgaacccaagaagcctggcaccagaaaggaaaacgcactccaatgcacaagacatacattgtcacccacacaggcccagccatctcccctcctgcttcatctaaccactagaagtgcggggatagttatggcagagacaaagaaacccactcagagaacacacagaagccttagagctaagcatgcatggagtcacatcccagccttctggcttctgctgtgcacataatttgtatcctaattttaatgcagtcaatgctgtagtagacctctgaaagatacacagataaatgggaccagagtgaaggaactcacctcttgacaaatgcctgctttttttttttttgttttaatttagtttgctttcttcttttgacctggcataaaatgccaataagaatttgctagagacaaaacttggcagcaggttttttgccaggtgaaaatggggttctaggattaccgtggttgcactgtgcctagctggtagtaggcactcagtcaatgttgatgactggatcacgagatttagcagttgtttaaccatcagtactctcccaattttcaggatttttttgtttgtttgtttggagatggagtttcgcacttgtttcccagtctggagtgcaatggcgcgatcttggctcaccgcaacctctgcctcctgggttcaagcgattctcctgtctcagactgccgagtagctgggattacaggcctttgccaccacggccagctaattttgtgtttttagtagagacggggtttctccatgttggtcaggctggtctgcaactcccgacctcaggtgatccacccaccttgacctcccaaactcctgggattacaggcatgagccaccgtgcctggcccttatgtacagtgtttccctagttatctcagaaacttctctaggccaacgaggtaggtaataggattcccattttccaggagaggaaaccaagacccagaggactgtctggactgcggtcttagagctggcaagtgatggagatggcacctgagggcttctgcttctaaatccgtgttctgtcctctaggctgcactgcccttcagtggtttaagtggaaagccatggatcaatctctagggaaatgtggttttcagagcagtagcatttctgacaaaggtgaagctctgatttttcccctctcctggaaggaggaatattaaatatctgcagtgtctgaatttctttaaccttccctccaatctttagtctctttaggaggttatttacaactctgacttctgtttgtttttaatgtcctctgcaattgaaagaagacagtgagtgtgatgcttaaatgtagtagatttttcccggactatttgataagatctattttgtaaaggaactgccaaagtcagttgcgataatagccataatagttttaaagtgatgttttccaatgcagattcacttattgcctggtttttgaaattattttgagtaactattagaaaataatactttaaaccatgtttttatttccaaaaactctaattgaaaattaaacattcttcagaacaaagaaagcaccttccttttcccagttcccaccctgatcctttattttgctccatttccccataaatccagataactttgttatgtggagtaagaagtagaagatttcactggggcatgctttgacttccccagttccctccatcaaagaattaagcgtaatttttatccaaagaatgggatgaaaggaggattccctgcaccgtcgttttggtttgtcctcttctttcacggggaaagaggagctgaaatgtgcttaattgtttgctgcatttcctgtgcacatgtacttatccctcacatcacccgagaccaagtgaagagggagtgtttagaaaaaagagagggaggctgatacccgttgaaagtaaaatgctggcatcttaattttaagagaacacagaaagccaaatgctttcagaaaagggtcccttcacggagtaatttgcctggtatggcatcccagtttgttgtataatttcagccccgttactatggtaacctgctttagtgtcgcagcgattgttaatcaggatttgtcgttattcccctttcatcacgaggctctatatccttatggattaaatcgcagttctcatcgacaatggcatagatcaaacattattgccagacataaaaccccgggtcgctccctgtcattttccccgttaccagaagcagcaaatgcaagctgaagtctaacttttgcaaggaaatcagggctccttctggctcctctgatatctaccctcatgacagaattccaagcaagagggccactttcgtttccaatcaccctgtgcccatgggaagggcaagcaccattttgcgtcactgcaaacctgactcttcagatacatatccagacaaaaagttgttttaatgtgacctctaactcttcctcaaaccttattcttattcttggagcagccgactttttctttctttctcatcgattttgtagattcttgtctgctgcttttctataggaagtccgtgtcaagaagcaggggagaccaagacgccactcctgttgaggatgttctgtggtgaatcacagagcctcgtgaggctcgtgggatggtggcttgcttttcccatttgtgaagtctggtggtaacagtacccagacagggaagtgaacaaccctatagtatagtgaccggatttagcagggccggatcgccaccatctttaggaaagtcaggttaaaggaacataggagcggtgaagtctcgtggtgccatgttctaggttaggtgcatatcgctagtcgtagtgtgtcttcatattgcaaattgctttgtttaggagcgagaactgttaagccacgcttgttaatagcctctggagccagtctgcctgggttcagtgtttggctctgccacctcctaggtgtgtgaccttggcaagtttttgaacctctctgagtttcagtacctaaaaccagcgtaatagtagtacctacctcagagtccgtgaggatgacgtaagttaatatttgtgaagcgcttagactggtgactggcacgccatcagtgttgtataggtgtttgtaaatagatgaaacagaaccaacattgcacgtacatgtattcaaaatatattcaagatcagattatccaaataccagtaaggtgttgaaaacagcgcttccccccctcctcccccttccctctccctgctttttttccttgatctctgcaatgtgcccaacccccaagtataattctgattggctaaattaattctgcagcatcctgctgtgaataattatgttgatccagtgtgtatctcatgcctttttttttctctttgcctaaattataatgtgacaattgcggctcacagctggctcatcagaggtgggcagttgggggattggcacatctgactgtgcttctctgttaactctgtgccttgattgcttaagacaagacacatgtaaaccccatgattattgccatttttttggactttgcaaagactctgccttcaaacataaagctgctgggctcgttttgggggagggggcatgtaggagtctcctttcccctccccccgcctctccctgcttttcctttcagacaataaatagctgtcaggcttatgtcaaggatgaaattataggtgcacatgaggccttgattacattgttttggagagattgctattagcatactgaaatgaagtctaatttttcactggcggagctgagtcaaactccagggacaggcagggcctatgcagtgcgaggcgagaaccgtccgatcggagcacctgttctatgtggggatcagcttttccttccttaagacaaacaataggaataaaataattcatacgaagaatagctttgcattagaaaagaaaggccaactgataaaggatggaataagacatttcggttagataaggctctttgtgaaatgaccgtatatgattttcaagtgtgtttaatccatgttaaggcagcatctcgcttgttgattcaggctgtgttttagcctgaagagtgtaccatctgattttttaggttgcttgccgcctgcataattcattttctactgcccggccctgcaagcaggcatcctctgaagaggcgtgtttgtgagcactccatccacggggcgggtggccttcttgtacttttgatgtttatacattctgatgatgtgaccctgtgacctgttcactttcaaaatccttcaatataaaaattattcttggcaagtggtttccctgaaatgtgtaagacatggtgcctcgagaatgatggtggattaataattatacatggcttattgtataactgtcgtggctcactgcagtgaaaatttaaaaattacacacatacacacacagatgtacatacacccgcatctgcacgtgtgtgtgtgtgtgtaatgattttggcattgtaacttgaaagcttattcaatatcattgtttcatcattactattattaagggaaaaaaataaggatttggtgtgggtggagaggacgggagcgtgtcctccaatttgaaatctgtaacagtggagaaaatttgtaaacagaccgtatatttatgtatttggagtatatactttcagtacctactacatgcaaacagtgcgctgtagtcactgcagattcagagctgagttagaaatggttcctgctgtccaggagtgtgtggtttggaccagaacaaaacaagcatgaccacataaccctagagcagcaaagaatggtgcgatcgtaaaggaagaacccatatttgctttgggttttttttcccctagctatttgggtgatgttagagtaaactgaggaagagaagagagagtgaaggtttaatggaggaggttgtatttgaagtgtactttgcagtgtgggtagaattttaaacacagaaataaaagaaagacatccccagaagggtgaaactgtgagcaaaagcagggtgaggtctcgtctggccagaggttctctccctgggatgctcttgcatcggtagagaactgtgagtaaaacagctgctgcctgaaatccagacacaggaagcaggtgagtggctgctgagggccgagggctgggggtttcgaggaaactaggagtggctggatgcaggtaccaggggtattttgggggtgatgacagtgttctgaaatggaatgtggcggcggttgtacaactttctgaatagactaaaagccatcggattgtatactttaaatgggtcagttgtatggtatgtgaattatatctcagtgaaggtgttattttaaaaaaaaatactgctgcatactgatgaaatcacactttctgggcgtggcgctggtctgagcctccttaggagccctgggctggagcagacgctggacatagcgttcagctggaaggagaggtggggctttatcttagcctggaagggcttgctgaaaggtttgcaaaacctatttgcaaaagggagccattggaagttttaaagtagggtcttggcacattcacactattgtttaaaaagctactcacagacctgtggtagatggtttctggaagctgggacgccagctggggccttgttgggttaccggcagaggcgaggtggcccttcccaggtacagatgagtgccggttgcagtgagagtcgaaatcaggtgacaaatgtaagggacacagagagcagaatgtcagcagggcccggtgctgtctggatgtggcacgagtgggagagagggtctgacgggtcctcaggtttgagccagagtagatgagaaggagcaggcctggaggatgtgacatgctcagtgttgcatgtgttggattcaaggaaccggcgatccatcctggagcaagatgggaatgtggctctgaccccagcaaaggggctggccaccgagcctagggagtgtggagggtcagcttccgcagcagctcagtcatcagctgttggcaggaggcctcagaccttcaccacgtaggcctcaccacctctgtccccatgtcctcacaacgcagtggctgacttctcccaaggcgtgtggtccaggaatgagtgaaagtcacagtgtctttatataaccctgcctgggaagtgacacactctgtctcctacgggtgacgccaaccaaccgtgtacagggtagaaggggtcacacagggcatgagaacaggaggcaggggccatggggctgtcctggggacagtctgccacctcttgatgcctggcactgctcttggcatggccatctgcatggaaaggctgtaacgagaagggtgctcaaccaccagctcacaggcagggaagcccatgctgcctggaggattcctgcattctcctagcatctgtggcaccccccacgtcccaggggctcggagacaggtcaccgtttctctggactgtcactccagcgagttcaccgcccttcgactctgagcagtgcagagaccccggaccacaacaaccgtgttcctcagactgatgcgaaactccaaagagcgggaaaacgactttagagggaccggaaaggggaagcgagtctcccatggtttgaggtgttgctgcccgtacctgtgcacttggccacagtccaaagtgactccattgcgggcacagccgtggggctgacgtgagaccccagcctggcaaagcgagcactcggaggcagtgggcagaaagggctcctctcggctctgcagccggaaaggagacatctttttagataagagttacagataatattctatttctggaaacgcaaggatgggtgggatgaaccttcttaactaatgtgatccattcagaagtatgttaaaatgtatcccttcatataatgcaccctgctttaatttttagatcagggctgaagagtttttcttttttttttttttatgagaaagggaaaatgttgtttttaaaattaggaataggaatttaggccaggcacggtggctcatgcctgtaatcccagcactttggaggctgaggcaggcagatcacttgaggtcaagagttccagcccagcctggccaacatgatgaaaccccatctctactaaaaatacaaaaattagccaggcatggtggtgcacatctgcaattccagccgcttgggagtctgaggcaggagaatctcttgaacctgggaggcagaggttgcagtgaactgagatcgcaccattgcacttcagcctgggcaagagagtgagacttcatcttaaaaaaaaaaaaacgggaatttagttatatttaacaagtaatcattttgggaggccgaggcaggaggattgcttgaacccaggaggtcagggctgcagtgagccaagatctcattactgcactctatcctgggtgaaagagtgagaccctgtcgcaaaaaaaaaaaaaaaggaaactctgtctcaaaaaaaaaaaaatcataacttgttgagaagtaattaaagacatgcagaactggagaaggtaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaactccgatgagtccgagtgaggggtggaggatctggcgattgtgtgtgtcgctggtaaatttttttttttttttgagacatagtgtcactctgtcgcccaggctgggtgcaatggttcaatcttggctcagtgtaacctctgcctcccaggttccagtgattgtcttgcctcagcctcccaagtaggtaggattataggcacatgccaccacacctggctaacttttttttttttttttattcgtagttttgctctcgtcgcctgggctggagtgcaatggcacagtctcggctcactgcaacttccgcctcccgggttcaagcaattctcctgcctcagcctcccaagtatctgggattacaggtgcccaccaccatgcccagctaagtttttgtatttttagtagagatggggtttcactgtgttgaccaggctggtctcaaactccgcgacctcaggtgatccgcccgcctcggcctcccaaagtgctggggttacaggcgtgagccaccgcgcccggctgagaaattctttatgcaacttctgtcctgctgccctccctgcccaggcccctccagggcctgtgctgattgaagggagaaggtcgcaccttattacaacttacatcgccacctcgtgatacttgccaatttcccctttttgcagagagagaagggaaacattgggcaggctaacgttttaataacattgtttggttttcactgtattaattgtgtgtctaccttctgtctgtggacagtcacaggctgtccatttgtagtggtggtatggagttctctttagaaaataaatgcatgtacatatagtggtttccatgaaatacgtaaataatagcacagttggcagaaaccacaaaggtggtatggaaatgactaatatttgagaagcactagtttgtggcacatgggacggtatatttgtgctgtagggcacagcgctctgagctcccggagagcagattttataaacactaaggtggttttttttttttttttttggccaactttatctgtcaatttacaaatagttgctggtaagtgctgttttttcctcctgaatttagttaaaccaccaagggaggctttcttacactgggattgcagttgctctgttggattggggaaaaagtgtcctaatgacccaggaacactttaataaaaaggttcagttgaaactacaggaatgccgagagctgactgaaaatgcagagaagttctaagggggtaatcggcagtgagggaaaagtacagtgcctcgtggcttctaggatgtcctttgtcctatattctcggctcttttcaaattgaaggaagtgggtgagagagatgctgctaattacatctatgaataaagtgacacagtgcaccggctctgagcagagaccaacacaactcgagagagaaaatcagtctgtcatatttgtacaaatatgtgcacttcgatgataattaccatagtcattgtttactattgctgcattatattaattatctattcagtgatattaaatacataactctaaacatcatccccgaacaaattaccttttatcaattgaaacaaaccaattaaaaatttcaaaatgcaaccatgtaatcaacggcttactacacgataattatgaccaaaatgccaattaatgtgttaatatatgacctcaaatctacagaaacaaacaacaaaaaaaagcagcctcacatagcaattatggcctcgtttgattgacagatatctgtgggtttgtttttctgtctgactcggtaatttgacttatatgaaaacagccggcctgttctgtcccgtgttctgaagcctgttctttcccgtgtgtgacaagcgcgcaggattaaaaagcacagccttttctcttcagctcctgcatgtcccttccctgcactgcccagttgcatccctttccagcatcgtttctgctgctcttgaacctgtggagtgggaagcaagacagggatctctcattttatatatcagtaaggtgtggcgtggacagacccgtgtcgctccctggacaccactggtggtattgattttatggagcagaggctggtgcatgcatgtgtgtgtcaggtgggcagtgatgggggggtggggatgaggcatggtgataattcacaacataccctctatctagttgggatccgtaaaggaggaggttaggggagggaggatccatgcctacttgtggagggtatcaagaagggcttcctggggaggtggaggtgagccgagctcaccaggagcttcaccttcctggggaggcgcagtgagccaagactgcaccactgcattccagcctgggtgacagagcgagagtctgtctcaaaaaaaaaaaaaaaaaaaaaaaaaaataagggcttcctgtaggaagcttagtcagtggaaaggatttagagaggaagggacaggaaatagagaacagcaggccgggcgtggtggctcacgcctgtcatcccagcattttgggaggctgaggtgggcggatcatgaggtcaggatatcgagaccatcctggctaacatggtgaaaccccgtctctactaaaaatacaaaaaataaaaaattagccgggcgtgttggcaggtgcctgtagtcccagctactcgggaggctgagccaggagaatggtgtgaacccgggaggcggagcttgcagtgagcccagatcgcgccactgcactccagcctgggcgacagagtgagactgtgtctcaaaaacaaaacaaaacaaagagaacattctagcaggagaaagggcgttgagtgcttgggttgggtcaaggcacaagtctggctgaaatttagaatctttgaaggaaagcgatggtgagattatttagactgggaagatgaacctgccaatcttatttcttattctgcgtgtgtcacttgatgagaaggccatgtctccaccctttagtaaaggccaaggtcatttaaaaggttacctggcctttttaagtgacttgaaatgtttagcacagttttagaaggtcagtgtctcaccacctgacccttatttccttggtttatgatggccaatttattgcgtctgttttattcaaaagaaaactgagggtgcttctgaagtagtttcttatttcaatgtgtacacacctccactctgaaacatggctcccttaactgcacaggcaaatttatcacatgtagttgtgaacatatatttgtgtgtgtattgcagtggaaaatccccttgaaaaatcagcaaattggacttcagcttgaaaagtatagacagagaacaaaactgtctgtgtgcaaatatatgtatatgtgtgtatctaaaaacatatataaacacatgtatacgtatgtatatataaataaaattggattgagtcataaaagtataaatatgtccaatgtaaaatctactagagaaggagtttgtttttatgactcagagggaatgtgtaataaagaggtatttttaagaccgagagccagtgtgtgtcagcttctttttgcccattgtttgtgtcctgggcaggaagatgactcactagatctgaatcacaaggcaattaagagccccaggaaaggctgatttcaggatggatatttagaagcttcagctaaatcaggtcttgggtatctaggtggattggggaatcagtgaaacaaatatttctcttcattgttttagattctgtggatctcttgctcagtacagaagtactttttttcccccaaaaaatcatatgaagaaagaggaagcgctgcccattctgaaggaggttgttaaaaatgagtaacgcacacttcatgttcacagcagcagtattcacaatagctccacgtgcccgttgacaggtgaacaggtagacagaatgtggtctatctgtgcaatggaatagtattcagccttaaaaaggaaggaaattctgtcacttgctacaacagggatgaaccttgaggacatgatgctatgagaaatcagccagccacaaacagacacatactatgtaattccactgagtcgaggttcctagagtagtgaaattcatagagacagaaggtagaacggtgatttccaggggctgaggagaagaggggatgaagagctgctgtttaaaggatgcagagtttcagttttgcaaggtgaaaaattgctggagattgatcgtacatcagtgtgaatgtacttaccactactgagcggtacacttagaaatggttacgatggtaaatttaatatgaggtgtctttcaccacaattacaaaagtggaatgagtgaagcttattaaggatagacagcagatggctgagaagttggcctggctggaccgttgtctggggggagcatgtggatgaggcatgaggtggggaaataaggaacctgtctttcttccagttaattgttctttcccccttgccttccaccttcctttccctcctgatggctcatcctgtctccctctcacgtgcctgctgtatactttcttccttttccctgctggtccacccgacctatttttactccctcacatttggttgtctttatcctcggaggagaatgctcacaccagcgtctttcttcaggacagctttctaccttcctttttttttgccattttaagaccgacagtggcataaggtcactgggtgaggtagagatacactgatctttttttggtggcagttagggatattgacattggtcatttcccaaagcgacagcagtggtagcacaggtgagggtgtcgcccaccgtctgagaaacccatgaagtacgctggctgctcttccatgttgcccccttcataacaaagtgttcgctatcacgttaagaaatatgttcgaggaggaagccgtgcaacagcttcagaaaaaaattctagagctagaacatgcagttggttttcaaatctcatattcttaatttcaatccttttatttcggatccaggctttaggatgcctctctctctgatatcactaaataaaaattatccaaatgtttaacattatatagaaataaacataatggtgtatttgacaaaatttgacaattttcatgtggatattnnnnnnnnnnnnnnnnnnnncatgtggatattcaatgccttgtggtcaaagtttaaatcaaaaccaatgtggtcttggcttcaggaatctgtaccatcatagatagcagtggagaagaggaaataatagtctggtatccttaacccataatatagattgtatatttgttgaaagtagaatgcaagggtggcaaaggcctgatcttgttgagggatgggaatttgtcaaacgcagtcactgaatctgtgtggtggacacgcgtgcttgaaaaccttgcggaagagtagccatcaaaaatacttacagttcttaccaaggttacggcaggggtgaccacccaataaggtagcacccaaatcggcttcactgcttcaatacgatggaaggctcaaggacacatttgtggttttttttttcttttctttctttcttttttttgagactgagtcttgctctgtcgcccaggctggagtgcagtggcacaatctcggctcactgcaagctctgccttccaggttcatgccattctcctgcctcagcctcctgagtagctggtactacaggcacccgccaccacgcccaactaattttttgtatttttagtagagacaggatttcaccgtgttagtcaggatggtcttgatcacctgacctcgtgatccacccacctcggcctcccaaagtgctgggattacaggcatgagccaccgcgtccagccaggtttgtgttttataggaagaataaatttccattttaaatgaaacaattctacttttttcttgtgaaataatgttgaagtatagataaaatatatcaattgtatgaagatcatttaaagaaaatcacatgtatattgaaaaagattttaatttttttttcttggaaatagtgatctattgttttaatggaaaaaggaagtgtagtttttaaatgttctttaatattgatttacagaagcttaacattacctttttaaataccacaggtacagtaaaatttaatgggaaagctaatttttaatagtttgataatgtgtatatattttatatatatataggttttaccttgcattcgcattttaagagaacaagcttattttatgattaacagaatcattaaaaattttttattgtaagcttgccagagtcctagatttaaaaagttatactcacaccacatatagtctaatgacgacaataaggataaagaaatactgaacttttttaagtaggcttatgtcggtagggatattgatgacattctgaaactattttgtgtttatttaggagagagtaaatgagcaactaagtgaattgatgtgttggacaccaacattttcactgtggaaggagacataaatatgaggaatgtgaggtactggatttgagttgaaagtatcagtatgaagtcatgttaaaatacacccacgctctctctctcactgttgtggttgtatcaactgaagagcctagaagctgtgccatcccaatacgcacacattctctctctctcacttttctagttgtatcagctgaagagcgtagaagctgtgccatcccagccattatgagcatctctcatgcccagatcttcgtttctgaatttctctttccactagaagaaaccatgagagaaatggcgagcctgagatcctttattgcaccaaaagcaaggaagtatggaaggagagctgagggcttgccaggacattggctgacatggtctctcactggtcaaacttgggatggttggaacatcaataaagaatattaatgatcatggattataagtacattaaaaaaacccatatgagtccacagtgatgagagttgggctggagcagggaggggaaagctctgctttataggaacatgccagataacaaatatagaaggagttagagaattagaaactcctcatgttataaccttaatgtaatcaactgattcaggatggatgtgaaaactattggatgagaggctgttgatgttagcacagtattctctgtgcttttgcaatgtagagattggccgtgaccttaatgaagtggtcaggtttggcgtcactaatggtgggagtcctgatgtgatgcggtaggaggatacctgaagcccctgggaagagtggcttcgatgctgccaaggagaatgtcatgaagtacagagctaagtgcaggaactgtttcagattagggagaccaagcagaaataacagccaattgcagtgaatgaaacttggtcggattccatatcgaaacaaacaaaatggctataaaggacatttttgagacaatcggggaaatgtgagtgtggactgtatgttggatgatggtattgaatcaccctttccttttttaaaggtgtgactggataggagaaggtgtttattcttgagagatgcctgttggattacttagggtgaaatttcacaaggtcttaagtccagttttggatagtttggtaaaaggaaagcatgtgtgtgtacgtgtgtgtatgagagagaggggatttgagaagatattaattcttggtgaatgtaggtggagagttatcagtattcaatgctatatcgtttgtttctgtaggtttgatatttttgaaaataaacaataagtaaaactaagtggcatagaaattaatctcttcttttcatatggacacatagagacatggtgctaggatggcatgtgggaaatagtttctgcaagatgagcatattcttcctccactgcccctaccagagaaatgtgaatgctgattcacttcttttgaccagtggtgatggaatagaattttccagtcatgcagttgtacttatttccttctggttctgtatcgataagcttcattcctttttttttttttttttagcttcattctttagaaattggattctttacttagtcaagtctataatcaaaatagactttccatggtaagtaaagtaacatgggagcgcataacaatacctgtcatttatgaagacctactgtgtgcttggcactgtgctgtgcttttatttaagtcttctccattcttcatcatccccacattaccaggaggagacaggctcaggatgacaagtggcttttgcaaggccgcgtggtgaatacatcgtagatttgaaatttaaacccagttctttctgactctaatttacctatatgttcatcctccagtatcatgctacctgtatgcctggaaataaaccattttacatagtttctaatgggattacatttttaaaggaaattcatggtagtaaagatctcgttaacactcccttgatgtatggtatttgagtttaagtgtgaaaagaagacactagcaatggacttgtactgagattcaggaaccctggcttctgcttccagttctctcactgtctgatggtgtgatttgagggccttagtcttatcaaatataatcattggttggtctggttgatatctcagttaatttgggaaactaaaatagcatgacattttcaaagaatttttaaaaagattactgtggcagaagcaagttctgggggtggaggtgcatgaggagggcttgggatagtgggaggtggctggagtaggggctgggttattaggggtctgtaggcaatgttagggcttccaactttgtaaggggcaatgaaagttctcataggttttttacactctaaaataataataataatagttctttaatatcaaatatgagagtcagagtcaaatttccctcatttatactttgttcaaatcaggacctaaagaaggttcacacattgcaattgctgataggcctctctccccctctctctgcccgccctcttcttctttctctctctccccatctccctgtctctctcttcccttccctctctccatccctctatcttttaataacagctgtattgacatataactcacataccgtacaattcatctatttaatgtgtacagttcaatggtgtcttattccattgggctactataacagaataccatatactgggtggcttatatgcaacagagataagtttctcacagttctggaggtggaaagtccaagatcaaggagccagcagatttggtgtctgatgagggcacacttcctgcttcatagatggcaccttcttacggtgtcctcacatgctggaagggcctcttttataagggcactaatcccatccattagggccccatcctcatgactgactaataacccccaaggctccacctcctaatactgtcacattgtgaggaaagatgtcaacatctggacttcaagaggacgtaaacattcagaccgtagcaaatgggtatgaactgcagtcagacagttgtgcaaccatcaccacagtcaattttaaaacgtttgcattacctcaaaaagaggccccatagctgtcagcagacattcctcacttcttcccaacactcccccagctatcggcacaataatctactttctgtgtctatagatttgtcaattttggatactttacataggtggaatcagataatatgtggcctattggcttctttcactagcataagttttcaggattcatctgtgttgtagcatgcatcagtgcttcagtccctttgattgctggtcatcttccattgcatggatgtatccataattgtatggagacaccacattttatgtattcatcagttgacagacatttgggttgtttctactttttgtctattgtgaataatgatgctgtgaatatttgtgtacagttttttttgtgtagacacgttttcctttgtcttagatatgtatctaggaatggaattgctgggtcatatggtgactctgcatttaacattttgaggaacttccacactgttttctaaagtaggtgtgctatttttcagtcccacctgcagaggattccagtttatccacatcctctccaacgcttgctgttgtctgtgtttttgattatagccactctactgcgtgtgaaatgttatctcattgtaattttgatttgtatttcaccaatagccattggagggttttagggatgaaatggcatgatctcatttagattttaggaagatcactgtcaccgtatcaaagaggatggatgagagaggtgcaggcagattaccagataccagatgatggatggcagcagacaggccaaggtagtggcagtaagaatggtgagaagtgagtggattacaggggaatctagaaatactgtccgtaagaatttgtgattggtcagatgtgaggattggggagcgctgaaactgcatttcctgcctgggcacctgcgtgaggccatccattgacagaggggacagagcagggtgggtagtggagagtggtgtgtgcagatctggaggggttgagtttgcatttactatcaagagaggagatcaggagtggtctctgggctggaggcagacatttgggaattgttaatatatatcagcagtatctccagaactgggaatggctgaggttggagagtgagaggaaactaggatatttgagcttacctcttacttctggagctttgtgatgcttttgcccttttagaaaaatgcatggaagtacagttttttactcaatatggaatacagttaaagaacaacatttccttcactttattgaaatttgttgcaggataacatctctgtcaaagcactttacaaggctttctagtaaagtaaattttttgtgtattgcagtggggagaggggagggggttgcctcttgtaaggcagaatttgattggcattatctcttaagtcttcatttccagcaacaatcttaacatgctgtttagatttaaatggtgggtggaccatatgtcatgaagaggtacagtgatagaaaacaatctctaaatatctaacccatttaagtggttcctacaggtttttatgtttttgagatacatgcctaattttggattattaattcttactggaattttgtctgttaagttaggaagaaacgacttataaagtttcctttggttttccccaggaagatacttttataacatgaaatctttaaaaaaccctttagaaaagtggtctatataattcttagcagggtgttgagatcaagtgcttttcttcttttcattttttacactttgtcagttgaagatgtgcaaagaagtccatttgaaatttccctcgggccacttaattcagcttcattacagtggaagtgggttaaaaatgataatcatacagccccaacaggtgattagaaatatagataggatggggccaggcacagtggctcacacctgctcagcactttgggaggctgaggtgggcagatcacgaggtcaggagatcaaagaccatcctggctaacacagttaaactccgtctctactaaaaacacaaaaaattagccaggcgtggtggtgggcccctgtagtcccagctactgggaggctaaggccggagaatcgtttgaacccaggaggcagaggttgcagtgagccaagcatggtgccaccgcactctagcctgggcaacagagcgagactccatctaaaaaaaaaaaaaaatctatatagatctctatagataggatgaatccatgacacgtccttaaaacagttttattttttccgtttcatgaatttagcaggaggatcctattctcactgcaacctctgccacccaggttcaagcaattctgcgtcagcctcccgagtagctgggattacaggtgactgctaccacacctggctaatttttgtatttttagtagagacaggatttcaccatcttggccaggcagatcttgaactcctgacctcgtgatccacaccccttggcctcccaaagtgctgggattacaggcatgagccatcgtacccggccgagatttcatttttaaaaaacatgaatccaagaagtgacttgagttccaaataaataaatttataaatttacttatgttctagaataaatgcaagtaattatgactgcattagtgcagcattaattaacattgctaattctttgtaattatgccaaataataacactaataaaatgtaaatatcaaatgaataaggcgagagcctcccctcctctttttaaagccactatattacagtgtcagattatgaacacacaatattatcaagcttccagatatccactttctaaatacggtctgtgtgaattctaatgaaaacatcagctctgtggtataaatctcctttgccgcctggttcaatgaggggctgcccagcaagccaataattccattcctcagagcattgctgagaatatttatataattaaatatcatctgtttccccatttaattcctggtggctatcccccaaccccctggctgtttttgctgtttccttgggcaggaatggcacaataaagttgctgcagtgctgatggattatcttcattaggtacttgggtgatgagtccccaagcactgctgaatttgatttaccctgtgcaaaggcccaaccttccatagaagcgctaagtagggcaggttttatgcagcttgaactggttggtgtgaagaagaaggaaaaaattaagttgttcttctagaaaacaattttgggaaatgctttggtctcttaggagagcctcctttgcctccttttatacaatctcaacaaatggtgatactgaaagtcctttttggtaagaagaggcggatgaagtgagaacgtggtgagctggagagaatgcaggagacccgggttctgcatctggggtcagagctgaagccaggctgaccttccttgggtctcggggtgtctgcatctgggcagcgatggaacaggactgtggctctccaaggccacttcagctttggagtgggaccttcgtgaatcccgccctgcccctgataaccatgggccctgggcaagtcaccccatctctccccgcctctgacactttgtctttaaaatgggaatacaccacttgttttgcccacttgttacagggtggtccggaggtctgaatacaagagcgcactgcatggtcctgtgcggatcccagctcgcagcaggtgcccacaggacgccgcccctcgcttccctcatgtcctagattctgtgagacacagcccgtgacactttgaagcagggccgtaggaattccgatgggaggtgattagagagaataaacaaagtgacggagttgggcctgagacaggggagtggtctgcggtggaacagtgctggagtaactcctgccactctgagccaaggctcttatttatttttattttggacagggtacttgcagaatcaaggctttgggagtctggtgagtggtcagacccttcatgaatgggattggtggccttataaaagggactccagagatgtctctttctctccttgcaccatgggaggacgaaatgggagtctggccatctgtagcccagaaaaatgttctcaccagaacctgactgctaccacgaagggtgtttaacctacattgagtgccaactgtgcttctcctttaattcaaagcctttgatttctgggggtgcctgttctgatggcactgatgggcaccccctgttgagtggggcaggtgacgggaggaggactggcggccgtcagtgggggctaccatgggggtccagggggcctgtcaaactgtggcacaggggaaacccgtagctctgtgccttactattttactataccatctcatttagtgcccacgatttcttaagaggtaggcactgaaggggaaacctgtagctctgtgccttactataccatctcatttagtgcttatgattccctaagaggtaggcactgaaaccattaccatttgtagatggggaaaccaagggtcacagtggcttgcccaaggccacacaggtcataggtgggagaactcattggagccctccccgcctcagccacgacagtcgtgtgtaaaggtgggttcacggaatatcatggggcctcctgtggtcttaaagtttgcacctctccaaattcctaggttgaaatcctagcccacaaattcgtaagttagtatttggggagggggctctgggaggtgatttgttacgagagtgcgaccctcatgaatgggaccaagagccttagtgcctgcctgaaagggacctctttgcaccatgggaggacacaatgggaggttgaccaactgtagtccagaagcgggcttgtaccagagcctgaccatgctggcaccttgatcttggacttccagcctcagaaccatgagaaatacacttgtggtgttcataagccacccagtctgtggcagttcgttatagcagcccccgccgactcagaccacgctgtaggatttgaagcaggtgtgctgagaatgtagggtagacatgtcatggtggccggtcaccttccattgtcttctctttctaaacggcacccaccttatgggctgctatgagaaggaaatgaggccagtgtgtggactggcgcacccactgttaatcagctgccgctgcttggcccgtttcatctgcccggaggccgttcctcactgacatcagctagtcattctgcccttcaccttgggagggcatcacaccttgtgccttcgtagagaaaaattcctgtttctgccccacgctggaaagtcagataaagccagcacatgtctggaagatgcaagatgaaatgtgaaatcagtatggcattgggtggaaacagaattctactgcacgataatgacagccgagatcaaaggaccgtctatttatcgataagagtgaaggaaggataacatggcagccagaggcgtcatcaaaggggaggatggctggggtaagaccctccaagggggccacaggccctacccagatggacaccgcatgctggtgtggcagacgagggcacagaccagtgtggcccctccgccctttgccccagtcggcattgtcggctgttgctggcccacagctgaacatgctacgtgtcatctagaaccagcctttctgtctccatattctgagtccacaagggacagtaataatgttgggcccacccctggaaatgtaagaagaaattctcttagcctgtcttatcttgtacttgattctttaggtccttctcttaagtttttcttttctgttctcctgttaatctgtctttctttttaaaaccgcatacttacacagctagcgttttattgcagaatactacttttaactggacctaaagagaaaagtctaaggtgttagcaggtatcattctcaccagtcatgaacgattgccattcacagtttaatgttatcctagtcttatctgtcctgacctcatttcttgattaaaatgttcctgttaaatttcctgtaaatccttcctaggtgaaaaatccctccgagggctgcgtatcgcctggggctgtcgtgtattttggcagcagatcccttcccttggctgctggctgggtttctccaagctaatgctgttcggtgcaaaggaatggccctcgttagcttcctgagctttttagaagttttaggctgtgctggttttgaccccttccttcctctctaggactcctgaataggccgaagaaaaaattaaatatttaataaacaacccaatgtcacagagaatgggaaaactcttgggattacatacttgtacccaaatcctaatagactttttatgcttattgttaataatatactatatttgaaagcagagtataatgcctaggacgtagaaggactttaaaaaatgttagtttcctttccctgtagaatagtcaccctcaaccctgggctgcacttaaaaatcacctgagccagtggctcaagcctgtaatcccagcactttgggagacctaggcggtggatcacaaggtcaggagttcgagaccagcctgaccaacatagtgaaaccctgtctctactaaaaatataaaaattagcctggtgttgtcgcagacgcctgtattcccagctactcaggaggctgaggcaggagaatcacttgaacctgggaggtggaggttgcagtgagccacgatcatgccactgcactccaccctgggcgacagagtgaaaaaacaacacaaaaaactgtattgatgtctgggctgcatcctagaccaattaaatcagactcttggagagtgaagtccgggtgttaatattttaaaaaggctccccaggtaattctaatgtgcggcctaggttgagaagatcagctcttagaagaatacagctggccgcctttttgctttatacgttttgagctgctggcttctaattagagttaatatcattacaatataatgcctttgttttacattaaatttaataagaacaaccactctgctctccaacaatatagctactttctctggcttaagtgcttctattctttttttaaaaaacaaacaaacaaacaaacaaacaaacaaaaaactgagtttccgattaaaaacccaagcttaggccagaacagaacttttgaactgcagtcaaacaaaattttagataattgttttctaatggcttcctgacaaatggagactaaagacaggcaagggggctaagaccaggctgggtggggagaggggacagcagcacgttggtacctgggtcacctgccagaaaatgagtggcagtctgtgcccaggtggcttcaatttcctgataaaatgaaaaagccatgatatctctgtagaccgagtctacgtcctaacccccaaatcaggacacatagtcttgtaagtgggagagtatacacgtggacattgtagctggaatctgagcctcagtttccccatctgccaattggaggcattgcagagtcctcctcaggattgcagcacgggtgaaaagcttgctgacaaataaatgcttcctatgtgtcaaacaccattctcagttttaaaacgtgttaaataactctgtgagcagttaccttatcacctgtcttatactgaggaggaaatcgaggcacagagaagccaagcagactggcctggtccctggaatagctgggatttgaacttggcagtgattccagagtctgggcgtaaaacatctgtgtccagtgcacaaggtacccaagaccgtgtgggcacaggatggaccctcaaggcagcgaatgaaacccggggctggtaaggtcaaaggtgtgtgagcagcagtgatcccagcttcactctggagagccagggcagtctcacactgggtatgaggtgggtgggtatggtagtggtgatggtgttggtgacaggcttctttagaagttttggagcttttggtttctcaggtagcaggggagaatgaactcagaatattattaatgaaattatctgtaaggttgaaatgtacaggagtgcattttggcataatggtgtgtatgtgcatgtgtgtttttgtgtttgcataactgcatgcacgtgtatgcatttgtatgatagtgtgtgctcatatgtgtgtatgtgtttgcatatgtctgtgcgtgtgtatgcatttgtgtgactacatatgttatatttacatgactacatatgtgtgtgcatgcatatgtgtgtatgtgcatttgtgtgtgtgtgcatatgtgtgtgtgcatgtgcatttgtatggggttgtttgtgtatgcatgtgtgtttgtgtgttggagaattatataacaagcgactttgtctcattcttcagctttgcattctgtgggctggggatctgcatttttccctccagcctcttgtattacccaagctcactcattcacttgatcatacttttacaactctgtgacatttttaccatcttagctgggcccttgcttgttggtggttttgcccatttctaggtgtgtggcctccctggccctcatctgtcagcagagcccatggacttaccccagaattgcaaccctggaagcatcttagcatcatctgggactgatgcccccatacccctaattaaatcaggccctctgctcgggagccatgatgggtctagtgtattcctagggttgagaaacaactggctgtattcacccaacctatgagaagaggatgaggtgacatggagaagtcagtttacaagagctggagcaaagtgcagagccaaatatcttggcgctgggctaatgatgcccttttcattctcccctcttcttcttccctcctctccattctcttccaacactgcttccccaggtcccctctcccatgccaggaattaaaatgttttgtctggaaacaagtgagcttgactaacgtggccgggctcccactgcagctgagttctgcatgttctgatgtcagtgttgtgagctttaactggagattggtgtccaaaggcagccgatactgctctgtccatttctgttgtgctgaaaatcacatggaaaccaatcacataatgatcttgggaatgaagtattcaatgcacagtgttattaacatgtaaaagacttagggcaaatcacttttaagtatgacaaggcttcagatgtgtttggtttgagtatagggaaaagagtttggggggttgtttatcagcagtgccatgagggaggcttatttcttccctttaaatctggatgaatatgcctgtgtgcgccgcatgataataacaatcacgccagccaggagattagctgagcttttgctctagtaattctagcatgcaaattcaaaggactgcagaggaggcaggggaggagcgtacttagcatcttttgctcccctacatcctaacctttgtgctgtgtcttaggttcatcttagggacggctgaacgtgaaacctccatgatgtcaaaagcctggagagttgggtccatgcatgaatgctgatccactttctctcatagtgagatgtacaaacagaagggtacataaaacttaataattatagaaacccatgtaactacccccacccctaaggaaaaaaacattgccactgccctagaaggccctataccctgatgttatttaagaaaatggaccgcggaagagaggcacatgggtggccaggaatggagaagctctgttaggacttgggcatggcacttcttgactgtttctgatctttatgaggcagtagggattctggaacccaacagtttgggttgcaatctcatctatgttacttactagctttgtgtccttgggcaagtccctatgctccttgtgccttagttttcctatctgtaaaatggagataataaaagtgtctaccttgtaggataattgtgagcatatcaagtgtgttaatacatgtaaaatcattaatacagcatcaggcacatacatgttaactactattactttattaataatcttggttctaaaaccttgtgttgttttatatgtggaattcccagtcttctaaacagtatctctctctatagatgactgtattatcctggtcttccacgtcgctggtgtgctatcatccctggccaactcagatgtcactgggcatctccagcacagccactgttcttccttccactccatgcagaatgtggcagcctggcacacaaataatttttaataaaattttagtgtataaatgtggtttttggaaagtagggaggagggaagtagcattgatttaatatttaaacagtaccatttaaacctagtagcaaaacccctatacgataatgagttgtagtctattttacagatcaagaaagtgaagctcagagaagggaagcaactggcccaatgtcacatagctagtaagtgactcagctgggattcgaccacacttctgttttcagaagtgcccatcccttgcggggatttgagctctcacagcccagcctcccatccttgcaggaatccttccttccacactcccaaaaactgaccatgtaggcttcactaaagtaaatcataaatttggaagtctaggacatcttgaacatgctaaatatgtatcaatacacctgatatattgtttccagtcacagataattccagttgattttcaggcatgtgtagatactcatgatataaagattgagttgttactaatcactatgaggcacgggcaggtcttgaggtagaacctcatgaggggaatgttataagtacttttgcattcgtatgattttccccataaccttctctcatgctggcaggagatagctctcttttccaaattctcaagttggcacagttatgaaaaccttctaggacatcagtgtgatgatgtccagagacaggggcagactcctgatctgtggctgtgcttggtactccctcaccccttcattggtctaatgggccagctgaagaatttacacaataggaaaattggccaaagccttaacattgttaccaacctgcatttcttcatgaagaaagcacaatacttgccttaactgagggaagtttcgcaggaaggggtattcagctgtgtgagtatgtgctctgattcttgcctgtttctcagttccctgtgtgttactgccactttcatttattactgtttgcttattttagagctatgtaccttgcaccctgtatgaaattaactcaaagtggatcataaacctaggtgtaaaacataaaaccatcaaacttcgtgaagaaaacattggcaaaaatctctgtgactttgtgttaggcaagtgattcttagataagacacaaaaaccagaagccataaaagaaaatgatagattggacttcataaaatgaaaatgttattcaaaaacattgttcagaaaaatgaaaagacaaatcttgcccatgttcattcccaagcatttcattttgtctgatgctattgtaaatgataccttaaaaactgaaaaattcctaaccattcatcattagtacataacatttgtttttaataattttattttttaataatttgttttaataagttttgtatgttgaccttgtcttctgagacccattaagctcacttatttgttcttgtaacttttttgcccattccttggtattttctttctttctttttttttttttttgagacggagtttcactcttgtcacccaggctagagtacagtgacgcaatcttggctcactgcaacttctacctcctgggctcaagtgtctaccactacgcctggctaatatttttttttttttttttttttttaagtagagacagggtttcaccatgttagtcaggtagtcttgaactcctgacctcaggtgatctgcccactttggcctcccaaagtgctgggattacagacgtgagccactgtgccgggccttccttggtattttctatatggacaatgcttgtctccctccaaattcatatgtagaaacctaatctccaatgtgatgatatcaggaagtggggcctcgggagatgattaagtcataagggtggagcccttaggcatggagttagtgctcttataagaaaggccccagagagctgccttgcgccttctgtgatgtgagaacacagtgagaagatagccatctatgaattaggaagcaggtcctcagcagacactgaatctgctggtgccttggttttggacttcccagcctccagaattgtgaggaataaatgactcttggccctccatgtctgtcagttctgcatcagtggattcaacgaaacttggatcaaaaatgtttttaaaaaaaacacaaaaatacagtgtatcaaccatttgcaaagcatttacattgtattaggtattgtaagtcatctagagatgatttaaagtatatgggaggatgtgcataggttacatgcttatactgtgccattttatgtcagggacttgggcatcctcagattttgctacctatggggttttggaaccaaccccttgcaggaactgagggacaactatactgttgtttatgagccatccatttttatggtactctgtccaatcagcccaagttggctaagacatagatgatcatgtcttctgcgaataatgatagctgatttcttcctttgctatctcaatgaattttacttccttttcttattgtgctagctaggctctccagcatgatgttgcataggcgtggtgagagtggatatcttcccctagctcttgatccgaggggaaagcagtcagtttttcaccatgaagaatgatgccagctgtaggtcttttgagagcactgtcatttttacttttatttttggcacatggatgggaaggctaaagacttgcaactgactttcctcctatacctttaacattttgctgaatggtagagaaagagaagctgggccagatgtagtctggttagaatgctgctggttgggagtgagtttgaatatgttttagaaatactttgtctttctcttctatgtgccattcctcttagtctgttcttattcctgtacactccctagtcctgaaaaaagtagtgacagacctgacattttaagagcactatcccaatttaaactgtactttttttttttttttttaacagagctttaaggaaatgaacagctctctacattttcttgtatttgtagcaggaattctgatcaaattttcaccttttagtttccgtgagagaaaacaagggccttacacctttgatgataagacatcaagtaactgttactactgagtaaaatgtaagaagaaatatactttttaatttgtcagcattgcccttccctcagtgaccaagttgctgcacatttgatagcacaggcaaccacagcaaacgactgatacggacttacccagttaattacctaaagattatattactggaaaaagctaaatcatcaactcaaccatgtgtaaacactttgaacatcatctttaaaatgtctttgcagtttgtttaggtggtagtggaatttgtacaaagtatcagtcattgtaatagcattctaataattctgttaacaactgcttgaaatcagaaagtattatttctgttgtttagatttgcccaagcatttcttgtgtaatgttataagctgtttatgtgcctcttaatagatgagagaatgcactatgtgaagtctgaagtatctgaagtaggtaatggaaccagaggaacttaggttatgagatgggggtatataggtaatatcccatatatcatagtaataacaagacatagaaactaatatactcactcccagatttccatggggactaggaggagcctccattgtagccggggtcaggaatggcagggtggcagaactacagatgcatgctccctccatgccaatgtgtggaaagggagtgacggacaaaggcagtgggatctggtcacgggagtatgggttggtgtgtgtcaccctgcatggggtatgatactgggctgctacaggagctcatggattccagatcagcaaaggaatgccatttaggaggccttgggaggtgctgatggggttggaggggtggcaaaagccagaaaagatgggactggtaggaaggacatggctcctgggcttcattctggcgctgtctctgaagcttgagcggaagagtccagctgtggtcagtggaagtagcagggcaggggagggggaggcaaaggggacgcaggtttctagcttggaactctggctgatggcagagtattagcgtaggggcggaggttagggaatatgccaattagaccagtaatggagggaatatttgacctaaaaataaaagatagacttagaactcagtcttaagggggcaaaagaaatggctccacttgatattgtaaataccaattggaagttggagtgaacttctaagaatctagggcccaaagtctcccatgatggggatagtggactcaccagagatgggaaaggaggccaggtcactgggcagcagggactcaggttgcctgtagctcaccccttcgcttactcggatcttgattcatttgttgggccatgcataccaagaaccgattatgtgccacgcataggtgctgtgttacaaagatgaaagtgagtcttaaagaggttatgtgtgagaaggggacagatgggaccagtcattctcagcataacaccgagtggaaataaccatgacacagattggagcaaagtgaggaggtgaagcagggagaggatagggaagaagaatattctaggtggagagaaagagaaagcatgtataaagaccatttaaaatagcacacttctggagggccacctttttctcacagcaatctgggtcttacagccctttttctgttcaaagtcttccttaatacaaactgttttatttaaaatcttagtgcttttggttcgactatgtgatctttagctttacagtgagaaggcggttaaatgccagggcccctctgagccgaaggctctccgtgtctgcctgcagcctttgttctctgccatgtaaaagatgaaaaattgtgtcagcaatatcacacccagttactgtgaaatcaaggaatcgctctggtgaagaatctgggggtgaagaccagacaaatcgaaacggcttggcgtcatgatttaactttgtcaagccaaagagagggctcgtgtttcaatagttagcctcaccttgcatctatactgggccaagtcttctttccgtgaatcctgaaccctgaaggaatcggcctcctctggctggttttaggcattgcccataaatcgaggctacaactgttctccaggcatctccctgacacctcaaacgtatgctcagcactccttgggccccatgcccaggaatctttccgcttgtctcttttccgggcttgcagccaggctcaacttttcaagatgttgtcttccaaatcctgccttgattaactcaatctgcagccccttctttgtcactgttttcttgtcactcttttggtttctcctgcagtcatctgtgtgcctagtctgtcccatcttaggcatttgcaattgcaaatgactacattaacatttaattcacaccaggcagcatttgtctgctgcataaagacacacctggactgcacggaagactgaggacctgggctaatggtcccagcgtgctgtgggtttggttggctgaggtcagcatccacattgaggtgggtgggcctgggcagatttctaagacaagacaagatgtgaggactcgtgtctacatggtatcttctagcttggaactctggctgatggcaaagtattagtggaggggcagaggttagggaatgtgccaattagaccagtaatggagggaaggtttcggggaaggaggttagaagcagccttagctgtctgcacattccaaacagggatttgagtatttgttcctggatattttggtgagggtgtggagaggtaggagaggggagcctgcttccaactttgtaaagagagagaagatatgaaggacacagatagaggagcttgctgacagctagaaaagagaaggtgagccgagcagatggcgtgcaggtgagcgaaggcatggctaggggtggactcgggatggaggagcccaggaggcttcccgggagcaagtctatgtgtttggtgtcacgcaaccatgcttttcccacaacccttctgtcttgggtcttgtggcactgtcttggttctcttgctgcgtccactggaggcctcttctcccatgacttcccagctcacctcccctctgtgagctcaggccccagcctgcagtcctacgttcttcgcactctctcagcttcctcccctgagctcatccaggcccccagtctctgttttcacccctctggagcagactccccagcctgtctgcagtcttgtccccatccgccctcttgctccatctttcattgctggttagacgtgtctactgctatctctgtcacctccggctcagcgtgctgcactcagacatccaactggaggagtccatgagctgacctcagagatgccctccgacgctgagtttctttgtcaaaaaacaaactcttcactttcatctcttcaaatggcattttattctgtcctctggtgtctgtcaatagatctcatctccccagacaggctgccttcagcttcccttcacagccttgccgatcttgcccctttccctgttaatccacacagccatcacttctgaacttaattcctatagcccctgacgttctctgactcatccgtcccttgtgatctacccgaacatgattcaccatccacatttctggttctactctacctgtctagcccctttcccacaacttttctgcactcaccctcctctactatggccgtcccggtcacttcaccatcttggagcacctggcactcatgagatgccacgatggtcacactgcatcccttccctgaaaccttcccagcctgtctcggtcattccattgttttatttgacttcctctagaatcgataatctctgctacacaatttagcatgtaaccgtatatgctcagtgttccctttttgaagtatattggtcttatctccgcaattggaacatgtttaccctgttggaacatacgctgttatcaagtcacaacgatcattatttttgctttccccaaagtgtcaagaatgtaacacaggatcaacaagtgttgactaattgataaccgagattccagattaaagacaaattttagtctgatgatcttaaaagtaattatgctgggtggaaaataccctcactttgggtatggttaaaatgactatcttgaatatctcattaagaggataatgtctcattgacatttatactgacagcccctagcatggagccttacgtactggctagtgtgttgaatgaatacctgacttatttaagcttttcactttgaagatgtttggtagcatttccatccagtccttgtacataggtaatcattgtcacggaggaccaaagggtcttcaaaacctgtgatgccaagggggcattttactttctccttttgtgtgggtagccacaactctattcgccgtttttaatatttacttttggctttatcactccatcaagttgtttattttttattcattccttacaatagatgtagcagaatgggataaggcagcatcattttcttccattccattttatcttttatcagcatttagttctcatgtatagcttttcctgagtcatcagtattgggctaatggactggaagggcccaagttgaatggtaattacttactctgttgctgatagcccagatgagaataggacctattagatctgtaataatggaaatctgtgtttaatgcagatcttttaagcagtttgaaacgatctcaaattcatctctctttgccatatgttaaaatgtcacattatggttttaaaattcaggatgagaactgaagtttcaggagagcctgcctgtggaaaagtcctcaaatctgtcctttttaaaatcagaagcatttgttcatctcaaatcaagcctcctcagagatgccagctctgtctgggcagtccgtgcaggcagggtgagacgaagaagaatagggcttagttcacaaggatctaggacagaaggggactgaggggatgtgaggatggtggactttgtgtggtgccaggaggcttcccagaggcttgggccatggattcagtgaatgcattcaagtcaggagctcctttgtttccttcttcatggtagggtccagggctgaatgctcacacttgtgtatcattagctcatctcctgtttcagcagcagaagactttaacttttccccaaatactgctttcttctttccccttttcgtgtgaagaataaaggtacagaaatttgacccaagatacttctgtgcaaaggccatcctctttagattccagaccagacttacgaagtgaactggtttacacaggtcataggtcaatcaatgctggaatgggtgctcagagcagaacctagtccccacccagggctcctgccatcactctcagaagtgttacaactggaacttctggtcatcaggattgttgtgtttttgagttattttcaataacctgtatcattcttcttgtctgggaaatggccctaaataatttagcttcctcttagtacagagtcttgtctggagacatattgatgggggctgtaacctcacccagtttcataaatgaagcaggttcatgatggagctcctgtttctcaatagagaccttagaatgagaaatggttctcaagacttgttcagtttattacgtgctgtttgctgtttgattcaatgagtctcttgtatctttgcaaatggtagatgtattgagtagtactagtatggtgttgaaaaagttggtactggtgaaatgttccaaccttgaacctcctgtgacttggaagagtcttcacagaattcaggacagacaggtggtgctgattcattggtgggggattggtttatttcccatagttctaaattatgcactttgacaactcaataaacctgatgtaactgacaacacactgatggatatggtggaggataaagaatatgattatttgaatcaagatgcttatggtatggcatcctagagtcgattgctttttaaaagattcttgagctttgataactttttgttgatacattttctttgagttcagcgagctggcttcatgagtgtgttgttatccacctcttctttgggaggaaaggattgtgttttagtacttaccctgatggctatagaagtcactgtttcatatgctatatcagaattgacttaaaaattgcatgtaggtatttgctacatgttttggtgacatgatgtataccattaaggaaatttaagatctttttgatcacaaagttctcagcttacatctggttatttgttggcgttttatttattggcaagctttttctagcagcaggtctatggacagccctgaaatttctttaaaaaccagtcttggaaagaagaaaagctgtggatgcttagttgaaagttcaagttacctgcaaaacatttgtttcaattgaatttgtctatctatagttgatgtagagtgggattttagggaccagggagtgtctccttggtcctaagttaagaaaacaaaaataaagtgacttcactagaattactttgaaccaggtcaagaacctgttcatctcactgtggggtttatatcctccttaccgcttcacctgcctcttttttccaggacaaatattttacatctgatcacttcctaatgagtacatctattcctgagaatggcaaactttgtgattatatcagagcaagaaatcttatttgtaaagaggctgcctaattatccatgacatttaaaatgtctgcattgtccttgagctaagagtgtgaaaatcaggagacccaggggtgtattcacttcctgatagatttcgcttagtttaccatactctgacagtaaaaatcaaatgaatctgagctgcttaacattaacattccaggccggacacggtggctcatgtgtgtaatctcagcacttcgggaggcctaggaggggagatcacttgagcccaggagttcaagaccagcctgggcaagacagcgagaccctgtctctacttgaaaaaaaatttgaaataaaaacaaaaacacaataacattccaagcaggaaagtaattgaaaaaaactgctatcatccatattgctaattttataatgcggaaactaccacagagttataagtgcagcgatgaagatataatagacatatttttgtgtaagaaaaatgaaaattcaccttagtgactgaaagcatagattgactttgcatagacatcagtgtcaataatgatcattttagtaactcaggttttgtttcttcagttgaaattcaaagtaacccaggttcataagtaggctgtgatgttgaaagattggaaactctcaattttgtcaaagattggaactaggttgagatactttggaatgttttactagataaagaggcagggaaataaaataactgttgtttcctgtgatttgagaactacaggatggcaccagaatctcagacctgcagcccagtgaagggattccttcattaaggctcttgttcatttctttcttggtaattttgttggttttctgtttttactagaggaatatgactcttaggaatcatacctgcatgcaaatttctgatgctctgttgattcgtgagcactagaaagagttaaaactccctatttctcacaatctcccccttggcagagttcagttcactgatgactatggtgagtcagtcagtgccccatcctgtgtcatggcatcccacaggacaacattatcttttaataattgaattatttttgcctctatagtaatgtgataagacagaatcatcatctattttttaacatatagcaaaattacccagttttttgaagaagctggaaatacttggatctgcatgctaaataggtaccaaggacagaaggaagacagggttcatcttctctttctaatcgtgggactttgggctgtaagggttggtgtcttcatctttccagtaaaggggtgggactgagcaatctccatggttactttcagctctgagagtcgatcatttataattataatgcatattgcatctgtgtatttcagtcattctgaacagaagggtttttgtcttggcaaggttttgtcttggaatggtgtatatatttttgtggaatggatgctttctccctaatgtctggcaaggtcttgtcttgctttcttctttgttgacattcctggtttctggtccagccctgaatcgacccagctgatggggcatattaattgggagcatgggctgtggagttaaacagacctgggtttatgttccagttccaaacctcagtttatctggctttctcatgtgtaaaatggagaggatgctgactttgtgggttgaggtaagatattcaatgagaggttgaaggtaaagcgcttagctcagggcctgataccttccgatgccttcctggtttcctacacctctccccatgtaaagatttttatttgcagaaatgtcaaccccaaagttgttctaagtgggaaaactgtttcctctacactcacaaaacatttctgacaccaactgtatagattttccacaccaagccattctccagttctctgcagacaccaactgggtgtctaataattcaattcaattctggcattaacgacctggaattagaccccacagcttaagggactcagtccttcaaggctgcccccaacttcagatgccaattgcaagtccccaggttgtcacctgcacttctctctgacttgactacctgactcagtagtccacacaaccccctccttaggtttgataatttgctggaatggctcacagatctcagaataacagtttattatatttactggtttattgtaaaggatacaactcaggaccaacccaatggaagaggtgcataggtcaggtatgtggaaggggtgcagagcttccaggccctttggggtgctaccctccctcacagcaccctgatgtgtttaccaacctggaagctctaggaacccattgtttagggtttttatggaggcttcattatgtaggagtgattgattaaatcactggcctcttccctcctcagaggttggagagtggggctgaaacttccaatcctctaatgacctagttggttcctccgggagccagtcccaagccacctggagttacctcattagcataactcaggtaaggttgaaaggggtttgctatgactaacaagatgctccccttacccccatcactcagaataccaagggttttaggagcgctgtaccaggaaccagaggcagagagcaaatacatattcctttttgtgtcataattgtatatatttcgtgtatttttgtctggtatcagacactgttggaaattgtggtttagtttacttcagttgttgcaccgaagaaatgtacaggaaatcaggtgtttttggaagacactggattaagagctgtactaaaatgctccatctatttcttcactacttccaaatgttgccacatttttgaaattggaaaattctgttttagttgacttcctggactttacctcttgtgtatgacttcaatcttgataacgttccatgctagtcttcgtctctggacttctctatcaaatccaccgttaacccatcaaatatttattgaactctaggcactatcctagaaactggagataggtgagaatgagaaaaattcgtctacagctcccagtaaatacttgtccgcagatgggaggaggggacagaacataacctgtaagcagatatattataatttcagatagtgctacatgtttcaaagtaaacttaaagcagaaggcctggcagggagcagaaggggatgctattatctagagagcaagggtttgagtagaaacctgcatgaagtcagaaagtgaaatatctgcaggagaaatgttccaggcagtaggccagcaagtgcaaacaccctgtgggggtaagaatcttgagatgatcaaaagacagcgtgcagtatagcttgtgcacacgtaccctaaaacttaaagtataataataataaaattaaaaaaaaaaaaaacaatgggagaggaaatgaggccgaagacccatcagggatagattctaggggccctgtaggccaaagtgaagactgaaatgtatcctaaaagtcatggacaaccacaggaaacatggaagctggggatgacatgattgtatttacatttaaggcaattactgaggagaacagatgggtggagaggagcccagagagagggcaagagtagagtcaggaggcaattcactagcagaggaaatagatgaacttgctgggtcatgatggaggtggtgagaagtggtcgtggtccagacgtattatgaaggtcaagctggtgggacttcctggggtcacatagaggtagtctcaccaacagtgttagtgctctggagacctcacttctacccttgggtcatgtacctgcatgggaaaagcctttatcctgaccccaagtgccttggctcaacttcgtgattggtgtgcattttgggtgagtgggggtgagcaggagattaagtaagaaatttttttttctcttcaaaatacagacatatgggtgaaatacaagggtggggcagggagaggatatagttctcttggtacatgaccccatctacagctcctatctggatctcttggcttagctctgacctcctaactttttgaggctggggactagacagggaggtgattgaaaggcttcagggacttgcttggtttatcctctaagctgcagcagctatgtcaggtttcctgattcctgaccccaattccagatattcctttatttgacttacagaatgactaagaatatgcaaagtgagagatgaaggtgcaggctgttaaggccaagagtataaactaaactgtgtgtatcagttacctcttgctgaatgatgcatcacataaacctagcaccttaaaacaacacacatctattctctcacaatttctgtgggtcaggaatccggacacagctcagctgggtcctctacttcagagtctctcacaaggctaccctcaagatgttagataaggtggagagctcatctgaaggctcaactggggaaggatctgcttccaggctcacttgtgtggttgttggcaagattcagtttatttatttatttatttattttttatttattgtgggcacatagtaggtatttatgggttacatgagatgttatgatacaagcatgcggtgtgtgatcatcacatcatggagaatgggggagattcaggtttccaagagccattgggctcagggcctcatttccttgctggccatcgcctggaggccacacccagttttttgtcacatgggcctttccaacatggcagcctgcttcatcaaagcaccagagagagtgtcctagtcacagtgctttgtaacttaatcacataagcggctgtcctcagtgttgccatgttctattagtgagaagcaagttactcaaggagaaggctctaagtgtatccagctgaaatcctgtattttctgttttccccctttacatcagcatgcctttgaagcagataatactgtgtagaccaagtctttaaaatagcacattccatgagccaaccagccacctcacctgcctataacattttcctttatcgtctccactgatgctatagctgaccatgttaggaaccctcatgttatagcttagtttatcttaaatcttgactttgtgtttgctcttagctcttgaggactatttgccttcctagacttggtactcccttgactccctcagtcccagccaggagagtgtcattttaggccattgtcacactaggatgtaggaggtgataaagacagcttagttaggcttaggaccaaggctgtgtgagaaccaaccgaagacagacctgcaatgtgtcatctggtacttacggcctctgtttgccaggggctaagtgtgataatgggtcagaaagtataaggtttacaaagtagctgagatgccacctgggacctactattaaaagccagggcagaatcctacaactaggaggtcataacagtgcttggaaggccattgaagctacagtcaggggcagaccaagggtctgggagcttgaagaagtggcggtcaaggcaaaaatggttcaaaatatagaagttcagattgtggagaatagcaacattagtaagcagagagtaggagacaggctgatctctggctaggttatttgtccccacactttcttttttcaatcttttttcccactctaccctggaagcccaggcctagatacagaggcatagtgtttttctctgcgagctaaagaggacggtgtggcatcagggtgacaagctgagctggtggtggtggtggtggtggtggtggtggtggtggtgctgctgctgctgctgctgctggtggtattggtagtgatggtgttgacagtagtgttgttggttttgttggtataggtggtgttggtggtggtagtggtggtgatggtcttggtggtcttggtggtggtgctgctgctggtggtattggtagtgatggtgttgacagtagtgttgttggttttcttggtataggtggtggtggtgttggtggtgttggtcttggtggtgttcgtgatgttgttggtgttggtagtggttttttgttggtgttattgtgagtggtagtgttgatggtcttggtggtggtgctgttagtgttgatagtgatggtgtgttggtagacttgatagtggtgttattgttgatggtgttggtggaggtggtgttgttgccattggtggtggtcgggatggaagtggttgtgttgatgattttggtgttgatggtagtgagcagttccctcactgctctcttacacagccagcctcttaaataatccccactcttaccctctaagccccaccttagacactaatacattctaaacctcttccaaagaagcagaaagaatcagtttcctgcctgggaacagtaaaccttgataactactttctctctagatgtaaaaggtttggctggtgttattctcggtgaaaatagcagaaaatccttctctttccagactgggattaaatggcttgatttacattggattctagggttattattatttttaacacttccctgatcggtttttttagaaactagcaagacatttttaaggatgaaggcatattaaaaacaactctaaggatgccttgtctgatgcattcagcttgcctcgtccatctccccatttgttttcactgatctacttaacaacttgtgtagacaggtagagcaggcatgacctaaatttggtggatgaagagatctagattcagaaaagttagtttacatgtcaaaggacacacagtcgtataactgacaactgtatgcaaccaggattcctacctaggtcttcccactccaaatccagcactcacattgtactgaaaaatagcctgattttatcacttgacctgtgaaaggaaagaaatcaagggtgaacaaagggagagaaagtaaatgatgttgaataaaacatgagaataaacagtttgcatatgtagccttttgatctttattgcagggctgagacccggttcttaactgttctttcctcatgccttctgcttttggtaaacattcccaacatttaccatgaaatcctctctctcaaggctgaagggctgctgctccttttgcagagcccctgctgatctctcatctctggagatggctgtgcccttagcgaatgcgaatccccctgtggacaattggtgactgagggacagctgtctgcaaggggcatttcatcagtatgcatcacgactggggcttggcagtcattagaattcattataaattactctgagtcccaggaatctcatttagttctccctcagcagctggaagatgctaccagctgtggatctagggtttcccccaaagattttacctaagcattgtgggtaggggcaaataggcaaaacgatctgatgatgagtgggtggggtaagatggacaaccctgtttctgcctttctacctcagagttaatgccctgaagatgccactgggggaatcagctctgggcacagcttaatccttagtgcttctggtgggccgaggaatgctcaagggtgtctttgtgagtcattgcgagaaggtccatgacagaagagggaaagaaccaaagagagagcaatggagaagaaagtagcagatggttctctgtgatcttcaagagccaggccctggtggtattttctgtttcagctactgtgacgctttttgtggaatcctggatgaggcctgaactgaccattcactcagtcctctggacctttgagtcctgtgttcctacggaaacccactcatcttgcaaggctcaactctaatgccaggaccaagtgctttcgtgtgaatcaccccttatgattctcacaacagctccataagataggggtaatttccattcattttttttttcagagaaggaaagcacaactcagaggggttattgacctgtgcaaaggaggagttctgggttggggggagtggaacccatgggagctgcacactcagttcctttgtcccctgaccatggcactttccacacaatactgcatacgtatcggaacagcgtgcctcttactgatccttaccgtgttggaccaggacacagtggcaaggtgagccaggttggccttctgtgctcctggcctttcctcacgtggcccttttcctatcatgtattcacctcttcactgaaagaggtgcttccttgtaacctcactttgccatcctcttctcatccctgttctaggacaggggctggcaaacattttctataaagggccagatggtaaatattttaggctttgcaggccatacggttcctgtcacgatgactgcactctgccattgtagagtgaaggcagccatggacagtatataaatgaatgagtgtggctgtgttcccattaaattttatttaatgacactcaaatttgaatctcttagaatttgcatgtgtcatgaagtacttctaatggttgttcagccattaaaatatatgaaaaccactcttagctcataggctgtacaaaaacaggaggcaggctggatatgggtagctggccatggttttgccaatcccctgttctataactaattgagtagtaatcctttacctttgggtaaaatcatcactgtgttagttctcctgaaagcgcatacaatttaaacctttaactgcaggtgaaaggctttgttgcctcctaaagggatttggggtagtagtggctgtgatgggtggggcggggagaggtcacaccaagcagatagctgcctctgcctaacataacgttagtcctgccgtgctgctattgtttttttcagtggaaatgttagatttaaaacctatatgtcatttgtctttgagctctgtatggagaaaaagatcttgctttggtttttgtaaaaataccagccttagatctttttgtgtgagctgtcatcagtcattccgattgttgatcttgtaaattcatgctttttagtgttggcagagggttgcctttgtttctgtacaatttcatgaagtgtttctttcaattgggacttactttgagcttaactggagctatacttttcatctcaactagattttaaagacatgggtacctggcagcatgctacagaggattgttttagaatctttcctcagtgtgagaacttcgggaaatggtacgaccagccgctgattgagccccctttgacatttggtctccacatgatccacagtgactgagcatggcttgaaacttggccggtgatacctggagtgtcttgaagggtttcctttttactcattcttggatgtgtcctggagtaaaaatttttgtattccactatttgtggaatttggaaagaagcacaggaaaggaaatggagatttaatgaggaacttgatttacaccggtacccaagctaccttccaccaccagcttctgccgcatgttgtatgttaggaagcttactaggactgcagcagctagagtactgtgcaggtgcctgacttacacaaccaccctttcaaaaatcgttccacagcccaaggcaacattgacttaatacatttctcaacaaactgaggcctggaaatctgagaaataaataggtgggctatccactgtaatgacaaggcatgacttcctggtttgtatttcttcccatagtgttttgattacactaagcgttaccggcaggcaatagttatttgctattattgtttttaaattaatcctagaaggtcctttaagtgtatttgataaacatcatgttacctgccagcaaggaattgtactctggatatttctgtcttcagaggtagttctatagtagttctgttgtataacagaaagaactatcaattatttgatcttacagtcattatacatgtagactataaattcatgggatttaatttaatgaacaggttcctgcctcagaactttgaacattatgctgtgggaaggaaaatcttttcaatttgctttacagactttgagtatttgtaagttcaccttttaaacaattagggaatatttacatgttgaggatttctcacaagattaaaaaaaatacttcttttgaaatagttgaagactgaagagaagctgcaaaaatcgtacatagttccaatgtgcctttacaccagcttcccccaatgttaatatcttacataatcagtgtgttgtcaaagccaggaaatgcacattggtgtaatacttttaaatacagatcttatttggatttcaccagttattgtgtgcactttttttggtgtaagttctatgaaattatatcacatttgtggatttgtgtaacacagatctatagaactgttcatcactccaaagaaacttcctcatgttatcgtttaacagtcacattcctctcataaggttgtgttcagactgtttcgttaggatgtcaaaatagcaacaaaaacagaggtggattttgagaaagtatttagttttcagttgatttccacaattacggatttcgagtgaatgaaagaaaaagaatggggaactgtattcaggttgtgagcactttcacatttatagctacgatccatttaaagttaattgtcgtataaggtttgacgtaagagttggggtttattttgtcccatttagatatacagttgttccagcaccatttgctgaaaagactgtcctttcctgattgaattatctcagcacccttgtcacaattaaatcctgtcttctctattctgttccactcatttgtagaacttatgccattaccacactgtcttgattactgtaaccttacagtaagtcctgaaatcaggtagtggaagtattccaactgatagttccaaattgtttttgctattttaggtattttaatttttcacttaaactttagagtcaattcatcaatgtctacaaaaacctttctgaggtttccatcagctttgtgctgaactacagattaatttggaagataattgacatcttacagagtctttcagtttatgaacatgatgtatctttccattgatttctatatgctttaatttctctcaacagtgttttatagttttcagggtacagaccttactgacattttattaaaaatctccctagtatttcatgttatatgttgttattatgtaaagtacttcttttaaaaagaaattaacatttcatttgttgctactatgtaaaattatagtttatttttgcatactgacctacatttggtgagcttggtaaactttttagtacaaatagcttttttccttaggattttttacttacacaatcatgttgtctgcgtataaagtattttccttctttcatttttgtacgatttttatttctttttcttgccttttttgaactgactaggacctcactacaatgtcaaatagaagtagagtgagtgtaaaccctagcttcattcctaatttaaggctgagaacgttcggtctgttaccataaagtatgatgcagctgtagctttttagtagattttttttattagcttatctcccttgttgactaaaaaaagttttttaaacacaggtaggtattgaattgtatcaaatgcttttttgtagcatttattgagttgatcagattttttttcttttttagccagttaatatggtaaatgacattaattgaattttttcattgttaaaacaactttgaattccttggatgaatcccacttggccatgattgttatactttttatatattcctgaattcagtattattaaagaattttaaattctgtgttcataaaggggatctgtctctagttttcttgtgtctttgtctggttttggcatcagagtaatgtgggtcttatgaaatgagctgggaaaggttcccccttcctcttttttcaaggcgtttacataggattgatattatctcttgcttgaatgtatctagagtttctcagtgaaaatctgggagcatggagttttctatttcagattttctatttctcgtgttattttttggtgatttgtatcttttgaagtgtgtctgttattaatttgttgcctcttagctccaaatacatctttctgtgtaagctctgtgataagccaaggaatgtccttggtgtttcttgtttaatgtgagcacgacattaagcattgtcagtagagggcgctttgggggaggggggtcattgctggaggaagtctctcttgccatttcttttgtgggcatgaggaccttccgttgagcctgccccagtcatggccccagaactcagtctctgcgacctcaaaccctcagcctggtggtaatgtttctgcagccctccccacagggcaccagagcccctgggccgcccctgcctgtgccgcttctgtccgtggcagtgcccagcatccccgcagatgattccaaggcctcctgcccccgtcagtgcctggacacccccagcacgtcatgctgctagttcctgacaatctgcaatccagagggtgatgttgcctgtctggtgtctccagatcagctctggcctggccaagcccgcaaacttctcagccgtctggtggctgaagcacaccttctccaagacatctgagtcctttcatgtctgtcttccttgggcactttctgtcagtccgtgtttgccagagagagtttagatcacgtagttactattttattgtagtattctttatattagactttccattaacctactgtgtggtttgtgtctcctgaatggttatccaaaaatttcttgtaagcagtatctgagttgagacttctgtgacctatggtttttgtcattttcaagaagggtaggagacattgctatgtgttcaactggtattttttcctcctttctttactcatcccgtccttacgtgtttttgccagggacttaactaaaatctaaaatgaggaagagggagaccagagtgtagtgagactaagttcaggagtcagtaaactagggccatgactggtcgatcagcttcagcattagttttctggtgtctcatgaccgtgagcagagatgttgaggattttatgagacactataagcatagcgtcccattcttctgctgcttagactagaggtcctataaccttaagctgcttatggatgaagtatctaggctaataaatcacctagcttaatagcagcaacaattttaatgtttagattttattttatttttatagcaaaagggaaaaaacatattttactatagacatcattatgaataggaataaccccaccatctttttacttctgtctagtcagagaaaagagaccccagactcacctaaccaactgatcaacaaaacaaaaccccaccgaaatacagaatattctccccattgcagttaggcctttggcattaacttaaatttagcctccctgggaattttggaaaaacatttttcttcattgtttttgtaagccctatgaggcagaggtataacttccccaaacaaaacagcaggaaaagcaagtagcaatcccctggataatgcaaatgaataaaaattgccagaattattacaaaagtgctaaaagccctactttgatatcttacactctattcctagactttagtggttcagaaatgcctgttttagcaatgccagcacacgagggaacaaagtttgtggagaaaataaaccacatagagatagtctccaacttagaaatgggtcatgttctaggggtcgatttgtaaatcagttagactggaaatatattgttcctgtggaaattggcattataaagatgtttttttttttggcttatgtcattagttttcctttggaaaaaaattgcattatttttcttttattagaacacattactgtattaattttctatcactgtataatcaattattctaaaacttagcagtttaaaacaacactcatttactatcccatagttttcttaggtcacgattgtgggcatggcttagctgggtgcccctggatcagtgttcctcacgaggctgcagtcaaggtgtcagctgcattgtgttttctggggctcattcacagggctgttggcaagcctccgtttcctgccacatgggcctcttcatagggctgccttacgatatagcagctggtttcccccacagcaagccatctaaggagaacaagagagcacccaagatggaagtcatagtctatcatccactcacggaatcaaacccccatcactcctgttgtgttctgtttagtagcagtgaatcactaagttcggcctacactcaaaggaaagggattaagctccacttcttgacagaagagtatcagaatttgtggctatacctttagaaccaggggaggatctgctctcaagttcactgagcctttccaaccagtgagcggtagagtggatcctccccctaccaagccttcagatgagaccgcagcccagctgacaccttgattgcatgtttgtgggacaccctgagccagaaacacccagcttcctattctaataagaaattagaccacttaacttaaagtgtaccttgcaattgaacagtggttgttgtgcaacaagggagttcctcctctccatgggaagaaaactcattcctcagtgatgagtagcacaatgtggagatttctgtctatagttagtagctgaaaggcttaagcaaggatgggaaatgtattcttttcccctatcctagcttgcaaccagcttgaccagtatgtaagggtatgttcttgatgttatagggtagaaattagaatgcttttctcactgaaacagtattctgtaaatggtgctcagggtccttggaaagaattatatatgagactcattatgggctgaggaggcccttctgggcaagtttaccaccgtttataacagcatgttcatggaaaatggtttctaaatctcagacacccatttcataaacatgcttttgaaatgtgactcatttttaaattgggggtttgcccatattatattatgttctccccagaaaccttctcaacaatagtttacattttgagctataagccttttgggaagaaaaagtgacagaaaatagagattactataatttagtcttggcactaatatcctggcagacctatcaagacataattctcctcgaaatcagatttactgcaaggcctatgctgaagtcttcttatagctgaggtatgccaagtcacactcgtcttctacatttctagaattctagggtcttattcaggtgcttccaaaaacatctgatcagaattagcacatgagaaacattttgggcctgccttagaccccattcagcgcatggctttatggaggcctatggccttcccgctgagagagacactgcgcaggctccagagtgggttcagtgtgaggccgcctcctctgtctcccctgtgtttgatattttcagacactgcggtaattttattcagcaaagctccattcagtcattacagaatccatcaaagaagtgtccattgctagaatgtgcaagtttttattgagcatgtattcagggacgataaccaagcagacggtgctgctatccctaatctccatctgttagtgaagtcaggcacccagcagtgtgtttaaagagccactaccatctccactgacttccctgagttaagatgttctatttcgcctccatctttcatagaaaggcaagtgtaaaaaagcaccaccaagcgcctgtctgtgtcgtgtgtagaaccaaagtggaagattttgttcattatgtttcttaatatgaatatgcgctgggttatccaacttcccttaattagccatgggaccaagtctgctatctcagaatgacaggtccttagaagaaaatgttagagtagctgatttacatgtgctgtatctctagtaagggcaggattttttaaaaaaaatctacccacttattgaaaatcaattgagagcttcatagtaaaaacttgataatttaagggaaatatataacattccaacagcttttagaattcagaatgtgaacatataaaatagattttaagatactcttctgttatggaagaaaaattgcaagagagagagtaacagaaaggatgagagggaagagggatggagcaataattcaaacagcaccaagttccagaaaggcaaaatacttgctgctgtacgagtctcactctccccctctctcctccaaagtaaaaaaggggtgaacccacaaatacttcatttttgaataatcttttatttctatccaaaattttgcatgcttgatcctcttaaaatccttcccccccttaaaaagaagataattaaggctagcctccatggctcctgcctgtaatcccagcactttgggaagccgagacaggtggatcacttgaggtcaggagtttgaggccagcctgttcaacatggtgaaacctgtctctactaaaagtacaaaaactagccaggtgtggtggcagccacctgtaatcccagctacttgggaggctgaggcaggaaaatggcttgaacctgggaggcagaggttgcggtgagccaagatcatgctaatgcacttctgcctcctcatttccacagagtgaggaaaaaaaccaaaaaacaattaacatattactctggggactgcagcccaattttgtagaggaaatgaagtgatagctctatcttgaggccttctagggtacttacttggaattttaaagctgggttgcagtttttctaccatatgatacaaatgggatcatctttgacatttgtcctgggactggatgcagtttaagcatgaggctgatcagagctcaggggctgcttacctgcagctgccagccactcctacatcccagcctggccctcagccctgggaagagactcctgggcttccaggtgttcactgggggagcaaagactggagatgtttaaaatattttttatttccgtttctgaaaaagtaatacatcacacagaagttcaaaagtaacaagagtttttaaaaacaaattatagaatgcagtactattctcctgcactttgatttttccctcaattaactgtgtatctggtagatagtttcatatctgtaactatagttaccctattctttataacaatgctgattattgcatagcatggattattttatgcaaactgttaggaccagtatttttacaagcaatcttgtgatgactgtctttgtccgtgagcaaagcctgtgctatggaagctcaactgggatgaaccttgttaatgttccatgttaatttcctatcttttttgtttgtttgttttttgagtctcactctgtcgcccaggcttcagtgcagtggcacaatctcggctcattgcaatctctgcctcccgggttcagacaattcttctgcctcagccttctgagtagctgggactacaggcacatgccaccacgccaggctaattttttgtattttagcagagatgggggttccccatgttgcccagggtggtcttgaattcctcagctcaggcaatttgcctaccttggcctccccaagtgctaggattacaggtgtgagccaccgtgcctggcctaattttctatctctttatcactatattatttcctgtagaatcttctttgtcttctgaacctcagcaagagacaataattgaataaattggaagccttgtgtttttaatggaggccagctggcctgagcaaaactgatatctatgtttatatctacaatgattcctcttttcttcttaaagtcacatatttagctatctccttcatctctcatgtaaaaagagaatcaagacaagtttgctgtaaagtttataatgacacagttcatgctccatttttgatggggagcttccatcaagaaataaagccagaattcgttttcacgaacgaatagcagccagaaagccaatagccctgaccttaccctgcagcaggcctgctttgtaaagctgacagcagtgttcaagggtgaaaggttggtgttggtctggaacagattggaaggggaggtgtgggcccatcaggctcagctgaccattacctccgatcatttatcactgtcagagaggagagggtgcggggtgggggagccactggaccactccccgctcagctgctctctgacagctgacagtgccccttgcaacctccaggcatacgatgtgccttcaagggacagtgtggtacatgcttaaggccgctgacatgttcacaaggaagagagatgtgctgtatactgtggagcttctctagaaacgtgtgccaccttctcttcgtgctgtggtgtagaactgcttgtagaaacatttaatgatgttttggaggcacacgttgggctccagagtgacagtatgacttgggtgataggatgagcaagttcctcggtgggccttatgccttaattacatccacaatacctggggactctgtacaacactgagattttaatgtggcaaaaccagcatggacagatgctggggaggaaggaaataactttgctgcttctgtgggtcaggaagcgaggcccctacacgtctttgaaggacagtaccttttctaaaaaatgtatttatttatttttattttttgagacagattatcgctctgtcacccaggctggagtgcagtggtgcaatctcgactcatcgcaacctctgcctcctggctttaagccattttcctgcctcaccctcccgagtagctggaattacagggatgcaccaccatgcccggctaatttttttttatttttaatttttttttttaatttttagtagaaatggggtttcaccatgttggccaggctggtctcgatctcctgacctcaagtaatccgtccacctcggcctcccaaagtgctgggattacaggcatgagccactgtacctggccaggacagtacctttataaacaagaataataagtatgatttgtatatgactctttatagatatgtttaacattcatcttcaaaatgtaaaatatgttttagactcaataggaaacacatgtcttagtataaaacaaattccttttggtctatagccatgtgtttcagtacacctactttcaacgttgttattcacaagggtgtcacaggcatcaggctgaaatacagattttaatccttaaaataaccttattttcattgtcatttatattctcaagattatctaattttggtagtcattaggaattacttgtgttaatagtggtggtgagatttcataaaagtcaggtggaaaatttccatcaattaatgtaatattatatgcttatcacagacgcctaagttagacatggtacttaaatgtggcaattaataaaagtattacaaaggtgaaaatggatttcttctaaaaatggaattaatgatgatggagtgcttgtgttgggaactcaggctagtctggtgcttgccggagatgcaggatgcttggagagctgcaggcagtgctgtcaacacagaggcatgtgttgacgtgtctgatcagcaaccctaagaagtgggtcgggcattgcgggctggtgaaggctggagagagggccagggttgtctttccgtctgtatcaccaccagtaagcactgtgcaaataccagtgttcaggagccacattctaactgtgatggggtttggctgaaatgcagatccccaggccttggtggggcagatatgggttcccaggtctctctgccaacgtccatccgccctgcctacacatgcccacctgggagttgataagcttgctcagaagccctctccaagacagggacagtgacttggccctgaccagagaggatgtcaaagaccagtaatacagctggtttggtttattctggaagtccccgaacagcttgagtgtgcgtcacttggggcagtttcttagctagcaagccaggatagttcaaggtgcccacaaccctgggaagaaaagggctctgctgcaccttcctgtgatggagcaggcaagcagccggtcatgggttgttgtcatggaagagagggtgactgctttctctttcctgctcaaagaaaacagaggagtgggacttagaagagaacacgtagtattttacaacttccaaaatatacccgataggggctaactttccttttttcaagcgttgctttcagtttttttttcttttgataatttattgattagcaaagaaatatttgcttaagaaaaatttgggaataaataaaagtataaagaaggaagcaaaatcacccataaatcagcatataaatcagccacgactacagcatcaccatgcttccttcttgttattttccttgactttgttctttacttgaggaggatactttattatttttttttttgttgttcttactttttccccactcaactccatatatattattattatttcctgatgccaggaaaaaagtactcatggtcatactttaaaagttaccatataatactgtatcttagaactgtgtcacaaatttattctccatgtgtggggtcattcagcttatttacagtttttctgtattttaaacagttctgttgtaaacatctctggaattctttgtctcaattctgattatctcctacagtagctatttataattgcagtgactaggtcgaagggtggaaatgcttttgacattcttggttggttgtggtagttgtggcagggtctcctctgtcacccaggctggagtgcaatgggacagtcatagctcaatgcagcttctaactactgggctcaaatgtttctcctggctcagcctccctagtagctgggaccacaggtgcacaccaccatgcctggctaacttatttatttattttttgtagcaatgggagtctcgctatgttgcccaggttggcttttggcattcttggtacctattgtcagactgctttccaattagattgtagcgtttcatgtgccatgagcagtgtaggagaaagcttgtctcactgaagcctggtcagtgctcggcattgttttcgcaagtttgccatttgcacgaatcaaagctagtctctcttttgagactgagcatctattgtgtatttatataattaacaatttatctgcataatatcagttcccatcattcctccctttgtctttggtgatgcaacctctgtcttttgcagaatcatggatgcctgctttgggagcctggagaaatggtttccatgctgtcttctagggccgctgggttcctcttgcactctaatgggggatccctctgatcacctttcttcactccccagacagtctgcagtctcagggaatagggggcatggtaggctcaccctaggccggtaggctcactctaggctgggttttttgtttgtttgtttgttttttgagacgcattctcactctgttgccaggctggactgcagtggtgcgatcttggcccactgcaacctgcacctcccgggttcaagtgattctcctgcctcagcctcctgagtagctgggactacaaatgcgcgccaccgtgccctgctaatttttgtatttttagtagagatggcgtttcaccatgttggccaggatggcgtcgctctcttgacctcgtgatctgcccgccagtttttttttaatgaataaaaagggcttgtggttggggcatctccattcagctttgccatcctaggcttgtagtcacactagtgggcttgtgcactgagcagacttcaggaaatgcagcaggcaaatcatgagaaggaagaatgccctctatttgcataatgctttattctattaaaaatgtgtcctcatccttatttcctcactctttgggctaaaaatcctctcttaggatttttcttaataactggttgatgaaatggagtccttgagtgtaggatctgtgaaatttatctttgccccacaacactaactcctggcacttatcaatgtggagaacatccttgccagggagtgaacatgagccaaaggacccgcctctaggtaccagcttatgcctcaccaaggtgggttactgtgctggctgggctttcagcctggcctgttctgcccatcctattgtgacctcttgaagctcaggcttgttcttctgcagaaagagctgggaggtatgggggttgcctggggaggtatgggggttgcctgagctgggcatcggctccattaccagccgggaggtgtatctccgttctgctgcgtctggagcaaagggagcgggccagatggtcgtggagggcggggttgactgcggggaggccgtggtcagagcaagaggataaaatcctgaatgacacctgatttgtttttcgtgctgtgatttttcactgttgtccaattgtcctctgtttttccatcacataccttttgttttgggggcagcccccacttgcatatggtccctggtcaccatgggggagagcagtgagctgccttccccttcacctccagctttgagagtaaatctcaccttctgggtacccacagcagctggggacatttgccttattcccaccatggccttcctgggggactccctgccttgctgctcctcatcacgggtcccagctgctggttgtcgcttgccttccaggtcagggaggagcactgggaattcctgggacacaggatgagtgggcgtagtggtcagcagggaggggagaagcccctcccagtgactcacccagcaccatgtttgtccccacgtagcctctcctgacatatagaacatgctgctattgggggcaaaacccactcttggttaacttgcaccttaaaacaccatatcgcacattgtaggagctgtgagggacaaacacaaccagaacctcagtgcccctgggcatgtatgactagaggcgtgactccatcctctctcagagcccctgccccagatttgagtgacagccacctcatccttagcatctgcggagaggacctgggcaggatcagggcccagaacgctcagtcagtgtccttgaggggcccgctgcagagatgggagtggctagtctgaggccagggcttgtgggccacataggaaccttacttacttcctgactgacttgtaccctgaaccaccatgactttgtgacctggagaaggagccacaaagaaacagataagaagagggactgtgagaccatattttgttggggtgttgacagatttttaccatattactgagataaatgcactttactccagccccaccgtgaccctcctctctgctgctcagtgtagtagcagctggattagtcagtagaaacacttgatacgtcagtccagatccctcaggagcatgcggtatgggttgggttggcatggggttaataacatgacccgatgagattgtacttcttgatgaccggcagttctgagagtttagtctgatccaagactcttccagtcctgagatgattttgtgtctagtggctaaccaggactcccaagatggcagctgctgttcctggaatctccagttaggtggtgtcccctggtcacccagtccccactgctttccccaccctccttacccagaggatacgaattttaggtgttcccagttgagcacaggacagggagctcatccctgattggtttatgcctgattttgcattattgtagatgtgttaccaagcagttttactgtgcccttttcaaggaagaaagtcatacaatttgaagtgcatgagacattcacaaaacaaaataaaaagcaatgtcagtatcatcttcttaagcttttgaacatgtccccccgatccccttcaacatccagaagttgactttgacccagtcttggtctaattaactgctactctgcaagcactgcgctctcaagatgaatgaaaatctgtttcttgtcctcatatcttcttggtggaggacacgtcactgccatcagcagaggttgtcctcccagagcatgtggctttggcatgtgccccttgtagcagagaaggggctggggcatgtgcccaacccaccagttgggaggcacccactctgctatggctgggtaacagatgtccctgttggagactcttgtgtctccatttgacactctactggtaatcaatagttagggctcaattaatgaatggcttttctgtttaataaatttgtttctgtggtgaaacatgccattgattttgaaacaaatttgtaaatggtgggttaggttcccaggttagcccacccttcccccatatcttactgaacctatacgaagggtttaaaggatctttggttctttggcccccaaatacttgccttagcagaatttcaatgagaaaatgtctttaaaaactccaccttggtttctaggaatagagctggggtcatttcttggttgtaaagaacttgctattttcccattgtggagtggaaagtagctctcagatttccccttattcttttatccctagagcaatatatagtgtgggggattttcagaggtttgttatcacagtgtagaaatgagaaggaaaatgacttcttcccctgtgccatctttgttttatccatttaaaccagcaatggcaaaatgatttcatcacacatgatgcctctaagcgatgagactctatgggtactgtgttgagaaaagattctgtgggcacattcagggatcaagaaagtatgctgtgtttgattagtgatgtctgccatgggcatggtcgtggaggggaggtgactaatgtttatttgccgttcctgaaacagacctgttggaaagtaaagttcacacaggtgataataccagcctaactgttatatagagtttgttatgtactggacactgttctgagtgctttttgtatttaattctcaaaacaccccatgaagtaagtacaaatgaggaaacttaaaatgaagaaattcttacagatgaggacacagaggcatgaagaggttgagtgactaagccaagatcatatgggtaggaagtgggagagctgagagtcacagtcaggccgtcttgtcctggatcgcctgttcttagccaccagttctgtcctgtctcctgcttgtgagtgttgtgcctgcggtccacaggactgatgtaagactcagctgtatttcagtagaaggtgcaaaatcacgttttaagaacctgttatctttgggcttcaggctctggaattaaagacaagacaaagccgccagggacctcatgagtgatgagggaatagcaagtgaactccctccaccttctccaattcatgcagtatttctggtctttccatctcagccagcactgcccacctctcagttgagactaggtaaatgggaaagggaagaggggttgagatttaaggagtggaatagaggagttcccttgtatccaggtcacctggctggggaaactatttctgaggggccattttcaatgatcattttatgtaaggaacacacgcatgtacacataaagatatgtaacagtcatgtgccacataacaatgttttgaccaacaagggattatgtatatgatggtggtcccttaagattatagtggaactgaaagatttttatcacctagtgacattgtaaccatggtgacatcgtagcacaacacattattcatgtatttttggtcacactgttgtaaacaaacctactgcactgctagtcatataaaagttcagcacattcgataatgtatagtacataatagttgataatcatcataaacaatgatgttactggcttatgtatttgctatactatactttttgtccttattttagagtgtgctcctgcagttataaaaaactgtaaaatagcctgaggcaggtacttcaggaggtgtccagaaggagacattgttaccataggagatgacagctccaagcgtgttattgcctctaaagaccttccagtgggacgagatgtggagggtggaagacagtgatattaatgattctgatcatgcttaggcttaggcgaatgtgtgcatttgtgtcttagttttcaacagaaaatttaaaaagtaaaaaatgaaaattttaaaaatagaagttttcaacaaaatttaaaaagtaaaaaatgaaaattttaaaaataggaagaagttttcaacagaaaatttaaaaagtaaaaaatgaaaattttaaaaacaggaagagcttatagaataaatataaaaatattttcatataattgtacaatgtgcttgtgttaagttatgttattacaacagtcgaaaagtaaaaaatagtttaaaagtttataaagtaaaaaattacagtagctgaggttaatttagtattgaagaaagaaaatttaaaaaacaatttagtgtagcctaagtgcgtgatatttataaagtccgtggtagtgttcagtaatggcctaggccttcacacccactcaccactcattgacttacccagagcagcttccagtcctgcaagctccatttgtcataaataccctagacaggtgtaccttttttttaaatcttttatactgtatttttaccgtaccttttctgtgcttatagatatctagatcacaaatacttatcattgtattacagttgactacagtattcagtatagtcacatgctgtacaggtcatagcctaggggcaatagactataccacatagccatagcttaggtgtgtagttggctctaccatctaggtttgtgtaagtgcactctgtgttgcccaatgacaaaatgacctgacaacacatagatttccctgaatatatccctgttgttaagtgatgcataactgtatatatgtatttttaatggatcaaataagttatctttcataatggctaaagagagattttttagtaccatttacctcactcgttaatttaacaaatactcatcaaatgcccgttctgtgtccatacgctgagagaggattatggaaatggggagtcagagagctacgacccctgccctccctgagcttgcagtctactgatagatgcagtccctgtacaaacagtggcataagtgcaaagtgctacttgggtgagtgctgcagaggaaaggcccttggtcctgagggatcagggtggctgtggtggatggatgagggatgctagtgttctgaccatgcaggtgcttgcaggccatgccaaagagctttgactgtggcctgagagtcatgggatgccatggaaggggaggaggggtcttggagtttgtgtcacatgattagatttttttccctttggaaagataattgtggctaccttgggaagaatgaattggacaagggatatacaagagttagaaggcagatgtcggagtccggaaaaaggggtcatgacatttggggctagggaggcttcggtaatgaaaaaaagaagtgagggggatgctacaggtgtctggagggggacagtcgctggctgtggtggcagattggatgtggggagtgaaggaagagaagggataaggacagttagaaagcaggagcatggcaggcccattcccaaaggtgggggatgctggcacagaagctggtttgggatgggaggacatcctgtgtagttttgcggtgttcagaggagatgtcagatagggtgcactttggattgtgaacatgtgggtttcagctgggccatcgacagaccttgatggattgtcctgggaaaccaactactgtggaaaaaatagaaaaatctataattttcatttgtttgaattcaaacattttcaccctagacaaaaagaaaagaatctaacaatgagaaaggaaataaataaaaataaatgtcttgcatagtctttgtgttttcatttttatgttcttctgccagtcttttcacataaatattcatattttaattagttgtcattatagtctatgtagaagttgtaataggattgtgtttccttaccattatcccaaatattttcccacatttctgtatctctctcaaggctgcatttaaaacatgttgggtaatattccattcatttgataaatcataaatggtaattttctaagcaattcctctacttttggatatttagttgattttaagattttgttattacaggtaatactttcatagatattatgtgtatcaccttttcttctcgtgtgtttttttcttaaggtgtattcttacgagtgggattcatgggtttaaagagtttggtttctgacttgtgatatgggtcaaggcaaatgttttccaaaccactgacagggctgtgaggcaagaacgaaagggcagatctttgatctccacacggaagctcagcatgtttatttgaattcagtaaccagtggtcctaaccagatcagtgaatgcttgacagggtccttccatcacacagctgggaccttccatcacacatctgctaattgtgccagttagtggctacagacctctataaggccactgagcccaccaccttgccctcagaaccctgggctgggttctcccttttcccaggctttttgcttgtaggaatgccacaatgactttacaaccagtggaagccccagaagggaactgatggaatccctaagggctacaggcagcttcccatgggtttggatgggtgctcaagatcttccgtgacctagtctcggtctaagagatttacttgccattgcttctcaaaatagcacctccactgcaccaagacagattgttctctggcccgggaagatgactcctggccctcactgaagttgctctctcacccttgcctttgcaaacctgacttctccttcggactccaggagtggcagcgccttctggcagcacatctgacttcccacccagctctcctgctacaattacctgcactcctgcagaaccctccgtccacatggcaggacttagcacataattatatgccttctttaatgtttgtttttgcagttgttatttcttgaagataactgtactctcctcgagggcaggaactgtgtcatccttccctagacccctccaagcgtggcttcagtgctgagccctttgcctgaacccagccaatccagtgtgacccattacatcaaagcgtctctgccgatgatgcagtgtgaagcgtcttagctatccttttcttttgtgttttccacataagtgctcctattcaaaacctgctgaggatattatttagaaaatgctcatagatggggaatactcatattgtctattgatcacagtttgggggttgtaagatcaagttaatgctggaaaacaataacctggtcacttgttacttccgagtcctcagtgtttactagggtgggaagggtgactggttaggaggacctgggtggggggataaggagctgtaggaggcactggaatatctctctggctcttaaggaggctggtgtctttggcctgggtgaacagtgcttgtactgtactgaaatgacatgttctgctattgtgttttttgaaaaattgctcccaatggaaccttgccctttttacttctcactttaaatactgagtgcatcagtgttctgattgttaggagtctgcagggggactcacccccagttcagcctggaagttggagctttgcttgttttttagagatggtgtggcagaagagggactctggctgggtgtcgggagccttcaggcccggctgggtctgtagccacccattgtccagctctgcacaagctcagacctcagcctactcatttataaaatgacatacctgaactagatgatctctaggcccttctgcaatggagatgaaaaacaaaataattgaagctctcttcagagggtaagcttgggtgcatttttaactcaaaggagaaataggctcattgacacatttaatgacatgtgttagtatgtgttagaactttacacttaaacttgcatttctttttttttttttctagccaaacatcatgtcaatggcaacagaacagtcgaacctttcccagagggaacacagatggctgtatttggtaagatatcaattctgaaagaaaacccaaattgtgtgcaaagactagtgccaaatttcttagttttagcaagtgttctcagggcttcaaaatctgggctcttctagatatttacaagttgttacagccaagaaaactattgagttcctagtaatttctggggttggaaaagcttattctatagaatttagcgtgctttattttctcacgttgacaaccacgtatcaaactgagtatttgctatttcttatgtccacactgtgaattaacctgctaatttagggtttgagtttttctttgctagcacggattttttttttttccgcatagatatatcactttgttaaaggctggaatttaagtagttttgacttattattacacaaagattaatctaattgaatgatctcttccttctccatcatgaattaagcacgctccttaagagaaaacattaattaaaaatgttttcagcaaaggccaatccctgagtgatatacttaaaatgtacaattatgtggttgagcagaacttctctgttaaaattccaaactgtttggtgaagaggtcctttttaatctgtgtttccttccctccatgcctcatgtcatctaaacttccttcagaatatctctgcacatggccctttctttgcctgccttcttttctccattctttccttccttacctcttcttctgttgggcccatctcccacctcccctccccttctctctagcagtgctctggggttcatccctgtgttacccactgaaaatgacgacctctgtgctctggaatttcaactgggcattcagctgcctcccttggttccttcacctccacgtttagacaggttctgtgatgtctctcatcctaaaaatgtgaggtcccctgatttcacgcctcccgtagcttctctcctgctctggtcttgatggtaatctcctttgagggtacaaaactgctttgaagacttgaattgcgtttgaactggaaattagcctcagaacaacctggtctataaatgagcacactgaagttagattgttcccttattcccagagatggaaccagaattaggcatcagtgaggattagcagctgcagagtcataaacagggacccagttccacctcagtgttggtaaatcatgctctgtgtaggctatcaccttttaaaacatactgatcagtgatgagaaatcattatgcccagaaatttaaatggagaagttgattttgtagaaggcataatggcctctctaaaccatgtgctaaaacgtttgatttgctaactttcctgtcccagcatggtgtctgttatcatgggacagcaaatgtcacatatatcaatgttcaaaggggtcttttgatgatttatttatttattttccagtctctcagattcgccaaccccaggcatatgagaaactaagtcttatgtcatattgggaaatagtaaatgacactaacctattattagtgggtttccctctgttgtgatattgaagtaaaacttctttcttgaagggcagattcagtaccagatgggctgatgacattgtttgactacagaattcgaaataacagggaatgaggctctgtggcaagtctttcttttcttttctttctattttttattttattttattttattttgcagtggggggttgcagtggaaagatttggtttatagcggcttcctcaacattcttccccaaggccctcattgtttcactttcagcgggcaacttcccctctctaagcctccgcttttcgatgaggaggctgacaggtgaactctaaggcctctgcagctctaggcccttggcctttacctcttacgccttcaggactgaaagctcttggagcagggggcagcccctgggaggcccactgtgcatggccagcatgtgtggttttagaagagatgaatcatgtgcataatttctacaagttaacaacatataagaagcagaattctacagatgataaagtagaatatgtttgacatctaagaattcttactttagaagtgcagtttagctcttccagatgcttaaattaaggccttattttggttaagtatatgcaagcattttatattaatgtcttcaagatgatcctcactttctatcacttgtcgccctgggctagggtagagtaggggatttggggggttttgagggtggacttctgccattctgggttgtttatcactgcaatggaaaggtcaactcagcacagtgcttgactctttgggatacattgggcatttcatcctgccagcctcttgcaaagctgatggactcatatactcctcttcctagcgaggccatgtgacttatccagagccacttggccaaggaggtggttggtggagctacagtttgagcccaagtctaattgacctggaatctatgttcttgttgtgatgttccctgactctctctgcactggttcaaggaaccatgggaaggccttatagattcagggacacctttcagctgggtccacacacaaaagtatgatctgcagccaggcccatttagcaaatcgatttgtatacttgcatgccttcccggagtgctctgaaggagtcttgagaagtagcctttgctgggagaatactggttggagcaagatctcctacggctatcatgcttttccatttgaccacagtagcatgtattattaatgcacaggaggatgtcttacattcccttgactgtgagttcatcaaaacagtgatggcacttgtaattgtttagacccgttcttcagccttggaggtcttcatattttgtgataaaatagtatcactaattataatgtcattttttttttttttgagatggtgtcttactctgttgcccatgctggagtgcactggcacgatctgagctcactgcaacctccacttcccgagttcaagcgattctcctgcctcagcctcccaagtagctgggattacaggtgtgcatcaccacgctcaccttttttttttttatttttagtagagatggggtttttccatgttggccaggctggtctcgaactcctaacctcaagagatccgcccactttagcctccccaaatgccgggattacaggcatgagtcatcgcacccggccacaatgtcgttatctgttggttaatcatttgaatataccttacctttagaatgctaccgaaataagaactttgaaatgtaatccactctacagatgaccattgaacttccatgaagcttttagattagaatgtgaaatgtcaggaaagacagatagagtgtgggataaaggcattccagtgtgaaaaatgcatgaatggtcatatcaagggatcagagaatagatagatgattccttaaaaactgtcgctggcatacagtcttcacagattttcttatgtagcccaacagttagtttttctcctggtctccttttctctctggtttttctgcccccatcattcttagcttcctctgtggctctccctctcctctgcccttttggacaatgagaacgaaggtaataggcttggtcctcctggggggcttctcctacctgtgtgtgatgctgtctttcaagtcagtgggagccctctgcttgcaagctggaaaagtggagccacacattttgcaattacttcctgtctttgttcctggtagctgtgagtgcccccttggctctcacccatttgatctttagagcgcccgccctgtgtagtgggcatcattgtgctcctttataggcagacaaactgaggcacccagagattaaagaaacatggccgaggcttcctcaggtatgagaacatcttttgccaccctgctgggcctgtcttagaaaggttctctctggccgtcaatatcttaatgaaagtgacattccgttggccacggtccactctgtccacgtggagggccgggttccagcctctgcagaagtgcttgttctcagcacagaccagctactcattgccttaaaaatactccatagtcaagaagatgggtaatttcacgagaaaatcaaagcttactaatttaaaagggtggaaaatggagggcaggggattccaagcttaatttgtgaagattcttggtacaattaaaaaatattttatataaaatattagctgggtatggtggcatgcacctctaatcctagctacttgggaggctgaggcaggagaattacttgaacccaggaggcggaggttgcagtgagccgagatcgcgccactgcactccagcctaggtaacagagcgagactctgtctaaaaaaaaaaaaaatttaaactttactatctttgaacataaatttgtcatccaaactaggatacattcgagagtaaaaagagtgctgtgaacaattatactgaaataatgaaataatgagggataaacctggagggttttaggcaattaggatataatgtccccctttaacgaggttgtatattataacgtattgcaccaagaataataaatacacaccaagttaagtagaaatggaaaaataatgaacttggatagacaaagtgaacaaatggaaaaaattgcaatgacatagattggattgtatataatgtcacatccacactagtagttacgctaactttggaaattatattcaataaatattgttgtgttcttcctgaataacttcagtttgaaagttaatgcgtattcataaaacctagtttgtgatacttcaataagagtgagggaattgatctgattttacagttgcagttttaatattgtactaatactttccagggatgtagggtaatgaattctccattacttgagatattcagatggtagagtggtcatccttaaccagtttggaggtggggctatgtagcctttaaaaccctttgttctcaattactgagaattgactttgttttggaacactgaaacatttaaaaaaacattctgctaagtcaaaattctttgaacccatcattatttattttttaatttaaaagttttgtgggtacatagtaggtatatatatttatggggcatgtgagatgttttgatataggcatgcagtatgtaataatcacatcatggaaatggggtgtctgtcccctcaaacatttatcctttatgttacaaacaatccaattatactcttagttatttttaaatatacaattaaattactactaactatagtcaccctgttgtactatcaaatgctaggtctcattcattctttctcactattatattttgcatccattaacgatccccaccttctcctgtacccctactacctacccttcccagcctttggtaaccatcattctactctcatctccatgagtttaattgttttgatttttagatcccacaaataagtgagaacatgtgatgtttgtctttttgtgctggacttatttcacttaacatagtgttgttgcaacactatgttgcactatgcactatgacagggtctcattctgttttatggctgaggagtactccattgtgtacatgtaccacactttcttttttttttttttttttttttttgagacagagtcttgccctcacccaggctggagtgcagtgacgcgacctcggctcactgcaacctccgcctcctgagttcaagcaattctcctgcctcagcttcccgagtagctgggatgacaggtgcgtgccaacatgcctggctaattttctgtctttttagtagagacggggtttcaccatgttagccaggatggtctcgatctcctgacctcgtgatctgcctgcctcggcctccccaggtaccacattttctttgccattcttctgtggatggacacttaggttgcttccaaatcttggttgttgtgaataactgctgcagcaaacctgggagtgcagaggtctcttcgatacactgatttcctctcttttgggtacatactcagcagtgggattgctggatctgaaggtgtgaacccgtaccatttgggaactcacgtccaggctttttggtgaaaggtaagattctgcagtgagaaaccttaatgttgataaattgataccaagcagcaacagcagaagtacctctgcaaattctttgggttgtcgtgagtttttaggctcctagtagcctgatggcaatgtctctctgacctcaaaccactggaaaacatgttttccgggtcagattctctgaagattcttcaaacaagagtggggagcaaaagccaagccgaggacttaggaaaatgtgttttttgtcgcacggcacatctcttttgacagctaaggtgccgagtgttcgcgtgacctttttttgaacagctgtgtgaatggacaggtcccggagcaggggcccgtggctgacaggagcccagagacttgtccctctctggggtactcaccttcggcccctccaaggagagtgagatcaatgtaagatgaaccaatcacaagaaatcgtttcctgtctgacatgaatgggaggtgagttttgaatcagccccggttatttgtctgccagccaagaaaacaacattggaagcagccggcaatatgtcagacttcaaagggaagtgtcttggtgtctcactggcacatatccagcatgatgttggtaaataaccgagtcccggtgtggcgtatttctccctgaatcttgactgaaaactactgaagcccattctgtgaactctggaggggcagccactcattccaggaaaaaggccagaaagaatgacattgaaatgtgtttataattagcgaaacaatctaaattcacaagatggtcagaactgcaggctgctaactggtgcaaacttcttaaatggtagagcacttggagagataaaaataggccttcctccctgggtaatttgaagcaacttgagggggcaatggtcattggagacatagtttaagatgcattttattttatatatcttgtgcatgatttcaactttcgttttcttcttgagtgtagagaagtcagataatatagagaaggagaaagagacctttgaaaacctgtgttgaaaatctcttttggtttggaaagcattggctgggatggtgcagccacgttgacctgggctggtccagaaaagaacaaattatggagtcacagaggagggtgggttcatatgtttagagtatggaaggtggactgtaggttggaggatggcacagaatccattgtagaggggagtaagttagagaatgtttcatataataacactttacttgtatagagatcacttatccatgaacttctcccatttcggttgtaagtaagaaccagaaagtgaagccctcctcccacaaaaaggttatggaggagtctgtaaagaattcagaattcccaaaggtcactggagtcctgtaatccttgttgactctagacaagtttcttccgccttcttaagccccatctctcatctgtaacatgacaagaaaactgtttgccacctaggactgttgtcagagtgtcaggaaatgatgcattggccccttggcatggggatgacagaccagccggacaggtgctccctggcagaccacctgctctcctcactctgggtgagctgtgatcaagtccccgggagagtgacgccaacatcactaggctctatgggatccatcacctctccttcataacaccagacgagtcccgtaactcagggattttgaaggataacagacagcattagttgagaactcacctaatattggctgggtactgagaagcccatgttattaaactctctatcaggctcactctcaccatgtgtccaagtgagactggttgtttgcttctgtgtcaatacagagctctcagaaaatactatatttctcttttggcctcaactgtaaagctaatcagatgtggctaattttttcactttttgcagtagtgtacagcaaccacccacttgactgacgttttttcctttaagttttgacaacgagaaagatttattttacaaatgtggcggacatttcttaaatttctacagagaaaatacattcaacaggatgttcaggagaaacaatcaaatattttctattacttctctgttaattaacttttttaagaagagaaacataggtatagagaacaactaaaaggaaaaaagttactcattattaaatttaacccaactagcatttttaagaaaaatacggagcaatcaaggatcaaattcagataatataaaacctaatattctttttcttgttctcattctccccagccatttatcttgggacttgttataaaatggattaaaggaaaattaaaatatatgcaagacacagccaactaacatgcattagaattaggtaaatattaggccaaaggaaaagaaagtgaaatgaaatacacaaagaatgcatgtcataatcttacataatttataaaacttgctcataaatttggctctatgtttcctagcagcaacatgaagaaaaatcagttggttgcatgatggacttcatttttaaaaaattgtggtaacagatacataatatgaaatttatcattgtaaccattgtttaagcgtatggtccagtggtgttaagtaccttcacattgttttgtacccatcaccaccatctagctccagaattattttatcttctcaaagggaagctccatagacactaaacaccgtctagtcctccttcccccagcccctggtaacctctattctacttcctgtctgtctaaatttgactactctagggacctcctatagatagaatcatgcagtatttacccttttgtgactggcttattctacttcgcataatgtcttcaaagttcatccatgttgtactgtgtatgaaaatttccttcttatcccattgtatctatagaccacatttggtttgtccattcacctgtcaatcaatacttgagttgcttccaccttttcgctgttgtggataaggctgcgatgaacctgagtgtacagatctctcttcaagtccctgctttccattcttttgggtgtatacccagagatggaattgctggagcatatggtaattccatgtttaattttttgaggagctgccatatcattttccaaaacggctatacttttacattcccaccagcgaaccacaagggttccaatttctctgtatccttgccaacccttgttatttatttatttttaaaaattatagccatcctaatgggtgtgaaatggcgatggatttcagttttacttactgattctaaaaatgtacacgtttgggggaatcacacatattttggattctggaaccagaaagaaatttttcaagggtacttaggaggacactatatgtactacaaggcatttaggcagcactgctgatggcaccctaggagtgagcggcgcgcaagtctcgtggctgtttgccacactgctcttctctttgggctcgtgaccctctccccacaagggactatttggtccttgcatctctgcaggtgctagcgtgcttgtctgctggctctggtttaacccagaagttaattgcgttgtatctaaaacaagcaatggaccagctgtcttctagaagattttctgtcaatatcatttctctcagttgagttttaaaaggtatttgttttttactttgcaattgtgaaagatttcaaacaaaaatacagagcttagtataatgaagccttgctcgctcagcttccacaggtctcagttatggctaaatgtgccttgtctacatccccactccctccccctcttctatcctagcatatttaaagcagatctcagctgccctatcaactcatccatgaatattttggtatatatctctaaaagataagatggattttttacacctaaaataatactttttaaatatcatcaaatctccagtgagtccatttcccctgttgcctcataaatgttttttaaaactgtttatctgaatcatgagccagatcgtgtatacattgcaattggttaatataaatagtttcttttcatctgtaagttcacccttctttctctctttcccttgctatttatttaagaaattaaataattcagcctgtcctatttcctttagtcttgaccgaacgatcatgttcatttgtcctcttgtattttctacaaaccgagagtgagagggctgatcagcatctgtaagtggtggtgtgtttcattcaggaggcatttaacacccggttccttttctatttatttatttatttatttatttatttatttatttatttatttattttgagaaagagtctcactctgttgccgaggctggagtgtagtggtgcggtcttggctcactgcaacctctgcgtcccaggttcaagcgattcttttcctcagcctcctgagtagctgggattataggcgtgcaccaccacacctagccaatttttgtatttttagtagggatggggtttcaccatgttgccaggctggtgtctaactcctgaactcaggcgatccacccgtctcagcctcccaaaatgctgggattacaggtgtgagccactgcgcccggccctggttccttttcttttggtgaagttagcatccccttactgatcattgcctcagtccattattttcttagaaactgcaagatattctaattctagcattttttaaatttgtgagctgaaatatttctataaatagagacttctctttatcaactgtatggttactgtgagatccagtttgctgaagaaagcaggataagtggtgattttccttatgtaccattttgctccatgtatctgagcatggctctaaacgtgtattcccaagtgtcagtgtatatatggatagttgtttaagtcaaaagccatttaacaagggatagaaactgccttaatttgacggaatgaccattttcacttgggcgtttaaccagattattgaaatttgtaaccagttgggtgaatacttgaaaatagagccacagtacagattgctgcaacagatttgagtaaagcaagaagcaggcacactgtcaggtggcagaaggcaggttctcaggcaaagctctctccacggagcagcgatcttctctctcgttctttccccagatcttgtgaccaggggatgtgctgcagtgcaggtttgagtcctgaccctcagtagctcaggtttaaaaaagcaactccagagagggcctgagggttggaggaggtcttgcttctagatgtgcaatgccttcaaactgttgaaatgatagaaatggagaagcagtcaagaaattacaaagcctgctcagggatgctgcccatagcgaagattaacagctgggccatttcacctggagcgctttttcacgcctctgcttaatatcgtgaatgagtttgagggtagcagaagacactccccagagtggattttccatacttccagttctcacagaaggtgtaggtaaaactgttcgtggttatcactgccaaatttttggggattcaagaaggggagatatttactgacccacttcttttttaatctcatacacatctcgtgtatgtatttttgtaagtggtctcaaattcttttttggaacagtgttgtgtatgaataaggtaaataaaaataaaataattcccatgaatgaaatttggctgggtgcggtggctcacacctgtaatcccagcactttgggaggctgaggtgggtggatcacaaggtcagactgagaccatcctggctaacacggtgaaaccccgtctctactaaaaatacaaaaaattagctgggcgtggcggcggacgcctgtagtcccagctacttgggaggctgaggcaggagaatggggtgaacccgggaggcacaacttgcagtgagccaagatcgcaccactgcacttcagcctggacgacagatcgagactctgtctccaaaaaaaaaaaaaaaaaaaaaagatatttgttaggtccagtacaatgtacacctttttggtttttttttgtttgtttgttttttgttttcccctggtaggcaatcaaaatcaaacagtgccagttcttttttttcaggaataactggaaatgttaccactgaaagcctaagaagtgggattcagttgaagcaacatggttgaaccatgtggagaaacagacgtttagcttggcataccttaggcccaagtagtgtgaacagtgatgcaagaacctgtgaactttccctacattcttatgtacagagtcttaaaagcccacgatcattgtattattctatgtccataaccactaggtgttattaggaaaaacacttttcatcttcctgggtcatcagtgtcccagacttacacaaagaattatatttgaccaagaccaagtttccttgctgagctcactgaccttgggagcaacagtggtgcctgcagatggatgtctttctgatggaggtcccaccctatatccttccagatttcagctgggattccaacattcatgataatatggaaataatcagtgatacatcatggtagacattaccatgaagaaactcaaaacaatctttcaaaaatatgcttagcataagctgagtgaacacatagtcagatgtggccttccagaaccaagcctactcagggtgaatcagcactgtgttttcttaggaaaagaaattttattttatttttttgccatatgcctgttgtctcctaaaaagtcctttgaatctcattcatgtttttatgtgatgacccttttccagtttcctaatttccataattctgccacttgtcaggtcacgatggagctgtttctagtgggagcctgcgtccatctttcttccagcacccttatatggattcagtgcttggtgacattcttattaccctttctttcaccagcattctgtttcctcagcatatgacctttatcagggtggcagtgggcactcacattgggaagcatggaagagttttgattcatcttacaaggacattaagggaggaggactggggagggtcgtctggggaatttcaggaatgtgatgacactaggagcaggaagtgacagctacctgaggacagatgagcccagaaaccctttcccgttccttgctcttggctgaataacttgtgcctggcgggtgtgtctttggccaggcctcacactgacagctctgcagtacagatatgcagtgggatggccacatgatggggaaagcccaatagcatggagtctgtgtggggctctgctttcccacgtgcagaaaatgagagccgccttcccgagcaaatagccagtgcatgcttttatcctgctgccaagacataggtctgcagtgatgcataagaaatgaccagacatctgcaccaactgaatgacaaacagcttttcaattgctgtgaaggttttggtaactgtattgaagtttttgtccccattttttctcccatgtaagacatttttaatctaccttgcaatgaagaggctgttaaacacttgtaccagcaccacccagcttttccatgtctatattaagctacatattataaatatatatatgtatatatgtgtatatatacatatatatatttgttctttacacttaactctgagatgagaaaactaaggctcagagacattgacttccccagggtcaggctactagttaatggcagaactagttaatggcctggcactgagattatttattcacatgttcatcagatggtttatttattgcaacaggaaacaaacaaaaatctctagcagcttatactccagtagggtgggacagaaaatgagataaatatgtaaagcatatggcatgtcagattatgataagtgctgttgattaaaataaagcagggaaagagaataggaaatgctaggctaggttgaggggttgtaatttaaaataacatagtcagagaagtcatgaaggaaaaatacctgagacaggttgttttgcacagatttatggaaaaagtgtcccaggcagaaggaatgcaagtacaaaggccctgaggcaggagtggcggaggcctgtgtggctggcgtgtaatcagcaagggaggaggaggagcagctgaggtcagagactacgagatcatgaagggcaattcacaggtaattcgtgggtaattgtggggactttaacatttattttgcacactataggaagtctagagggtttaaggcagaggtatgacgtgacttttttttttttaaagccaccgtgagtgctctgttgaagatggcatgtttaggttggtgagagatgcagcaggaataccacttaggaagctattgcctcctagttcaatacttttggcttttgaacgtaactacttttaataataatacaaaaaaagctttaggcctttatagaccttctcaaatgccatattttcatagttttgtaaggttttctatccctctgttttgagaatttaaatagcccttttaaatgacacattagcttggctattatcaaaaattcaaaagatggcaagtgttggtgaggactctcactgttggtgggattgtaaattggtacagccattatggaaaacagtgtggaggtttgtaaaaaaatttacaacaagactattatatcattcaacaattctacttcttcatatctaaaggcaatgaaatcactatctcagagatattcatactctcacgttcattgaggcactattcacaacatacaagatacaatgtccatcagtggatgcatggattaaaacctgcggtatatatacacaatggaatacgattcagtcttaagaaagaaggaaatcctgtcgttggcaacagtattgattaacctggagaacattatgctaaatgaaataagccaggcatagaaaaacaaatagtgcacgatctcacttgtatgtggaatgtttagaaaagtcgaactcatcaaagcagagagtacaatgatggttaccaggggctggagagatgttggtcgaagggtacaaagtttcaattggacctgaagaataagttctggagatcttggtgactatagttaataataatacattgtacacttgaaaattgctaagagagtagattttaaatgttctcaccacataacagtgttaagtgtgtaaggtgataggtatgttacttagcataatttacttattccacagtgtgtatatatatcaagacatcacgttttacaccataaaattgtgtttgtcaattaaaaagtaaatttataaaaagtgacactagcaaaacacagatacacgtccttcctagagagtatttaggtattactattgctttacttgcaggtcaatattacctgcatttttagatagaatggtttgatttaaaccactcagaatcatgttgaaagtgtgcattggatctcatacaaaatgggtcacttcatgagagttgaagttgagaagcacttcagattgtacttctggtatacttggaatggagcacagggcaaaggaacattgtaatgtgatttagaatatgaaatcagtgcttgaaataagactataatgtatcgatgaagtacatcagcatttgcgtctatctcttaactcttttacctccacagaccactgggatagaatgtcagatattggttatcggccaaatttgggcttcagtcagtgaatttgaagacaggtcagtagaaattctccaaactgtagcacatagagaaaaactattgttatggaatgaacagatcgtcagtgattgggagagaatggcaggtggtgtaatgtatgtgcaattggagtgtcaccagaagcccagacagatactgggacagaaaatgtatttgaggaaataatgaccataaatttgatgaaaaattgtaggggtgtagttaagatgaatgccaaatctagatggttaaaggcaggggtcaaatcaagaccatggtacaaaagattttgggtggggagaaagatgggtataaaacgtgaagacccatcttactcaaagaccgcccctgtttcatttccccactccgaattccttttagaacaaatgggttttggtgacagtgtgttcagatggaatactcacagacttggactcacacctgggttcaaatcccagctctacctaatctaactagttctgggtccatggcaaatcactatagtctgcatcctaggatcatcatttgttcaatggagatagtgatatctctttggcaaggcaggtctaaatggtgtagaatatgtacgttttatagggtggtgatgcgcacatcatagctaggcccttaacagatagtagcttcttctcccaccaaaccagttctttttgtggttatctggtgtcaccgttcacccacttagctataaaccagattaagaaaattacactttttacaaagggcgtgaagaactatggaaatgataggatcatctttgcatgttagaatgattgctccagcctgagtgtgaagaatggcatgagggtgtgagacaagatttgaagaaaccagattgaagtctctcgctacagcccacacacctcttcatacccttcccaaacaaacaacagtattctcctttttcacaaaagagcttgattttcctatttaaaccacagcctcaactattaccagaagaaaaaaaaaagaccaaataaaaattatctgggtccccttttctcaagagcagagagggcacactctttaatgggttagagatgggggctggaccaggtggtagtcttgtgtatggagtccagtggacagagctgagagtccctctactgacagtccctggattcatcaccaccacatttctaagaaatctgattattacctccccatcagagagagacactcctcgtggtacagctgtgatcatatcattcctttgctggggaaatcttggtcactagaaagattcctgcactccttagtctgacatgtaaggttctgcagaacctaatttcaatctactctcctagccttttttaaatgaacactactactagggccgggcgcagtgggctcacacctgtaatgccagtactttgggaggatcacctgaggtcaggagttcaagaccagcctggccagcatggcaaaacccatctctactataaatacaaaaataagctggccgtggtggcgcatgcctgtaatcccagctactccagaggctgagggagtagaatcgcttgaacccagaggcagaggttgcaatgagccgagatcgcatcactgcactccaacctgggtgacggagtgagactccatctcaagaataaataaataaatacatgcatacaacttctcacccaacctgtgttgaggccttgtcatctcatcccttactctaaccactgcacaccctcccatatattcagttgaaaccctactcttccttgaagtctctgtgactttcctcagtccttccccctcaacccttctttgtgcctttgtttatgggataaggtttatcgccttgcattatgattagagattgaatggattacccatctctgcctgtgctctaagctttttgatgatagggcctggtcttggattacttggggcctagtctcaaatataagccctgaatataaatacttgttagatgaatcacgttctttacattgtcgatagaagtgggaaaaattctttttattcatttatttaatttgcccagagttgcggaagaactaattttaaaagtttaggtttgaatagaggagcaaaaagtcatagagagggacttaaagaggaagtctcaagggaacttctgaaaacttctttgggctttagctgttgatgggccgatgttctttatggtgccagctctcgttttgatgtagatgtctgacgagcctagttttctgggtactcgttggatgagtgacactcggagcctcagagaggagggatgcagggtgcaggtgctaggtgaagggaactagtgtttactgaccatctaccgggtgccaagccatgctgaaaggcagagatttccaagggaggaaaatggttgggagataggaaagtgacagaggaagtattctatccatgccagaaagacgtaaggtgtaaatgactgtgtggcatgccataggaaaaaatgggaagtgtgaaattcctcagattcactgcacagtaacttggggaagagctcatgatgctagtcaagttatttcttagcctctggacctcatggttcctgttatgagatttggctaagctagtggcagggaaccacggcttctagtgttttcttcaccccatttctacagcaggtgactgttcaggtgactataggggaggggtcacatgtgatgaaaacactgagtatctcaaaccagctgtcttgcctaggcctcagttttgaatgtggtagatgaaaggtttaactttccactaatagccctcccagctctgctgttccttctgggatgaaatggagtgatccaggctgatctgctgatgttttactgcttgtcaagaatgctaagaagagggtccccttgtggctgcagattgctttggggacctttcatgaagatttcttcatctgggacctctttcccacatccatatgtcctacattttctcttaggattgagctagagctgagatcattctactatattaatcaacacctactgcagtgtcatggtcattggctcattggaattccatagatctcctacccactctagtagggaaaagcaaattgcagaaaccttagaaaagtcagtgcccatgaacagacacatttaggaaatagaaaattactaaaggatgcctcttcggcaaactgggtgccatatgtgtgcatatatgagtatatatatatgtttgtttgtttgtttgtttgtttgttttttgtttttgttaaggctttctttactttgccccaggccagctggtgtgcatatttgtcaggtcctgttagagctctacagctcattctcagcctgcctgatctcagccttgctctcaggtcctcaggaggagtttgattcttttggaccgtggtgctactggctatttaatcctttatcgtcaccatgtccagctagcaaccacttgccttccagcagctgggagaactgtgctggtccagggagctggttttgagaagcctgggcttccacgagcagaggtcattctgtctagagatccatggctcaccagtccatccctggggagcagctgtggctccactgtccttcagagatacagacacagtgaggcacattctgaggagagcagatagtgagtagatcctaaaatgtgttgaatgaggagcagatgaaggagcttggattctgcttggtgacgacgaggcccgtggagttaccagagttgtcttcaagaggtcagagtgttggcaggttgtcataaggaagaggggctaaatttgtcccttgtgacctcaagggagagaattagagtgaaggaagaaacataccaggggtttgattcagtgtaggaatagctttcaagctctcattagatctgtaaaggggaatgggctacttcaagaggcagagggtaatttgagctttgactgaacacttgtttgctgtaatatgaaaggggttatgaagatttccagggcattgaggctagatgagaaggaaggtcccttccaaccttggaattctgattcttgacccctcttggtaaatacatacctggtactcttcagagaatattcccggggttaaggctgaaaaatagcaatgtgtataaagaacctggagctgcattaatcacagtgcagaggtacagtggagtgtacacgtgcatatgagcacattttaaattagggaaggggctgaaaagaaaaattaatcaaattaaagcagcattaggaatgatgtggacagaaggtaattagttgccatcaaatactgaaaatatcaatcaaccgctaattgctatatggtttcttttattagcagaaggtattttcaaattttgtagatttcaatcaagagtagggataaggaaggtgtcttgttgcattatttaacatgatgtagattttcagaaaagtaaagagcacagaagataaattgaaatgtttacattttttgccacgtattcatcttccttgttcctagcatcgtagagctgaaatctgtctttgaatcccccctcccctgctctcttctttgctggatagctgaccagaagagacttactccaggccaccaagatggtgtctgggaatgtgtgtccgtggccagggtctggctgtctctcgtccactgagctacctttctagagttgagctcaggatatttctggtctctgcctatgttccaccttctgatcaaggacctacagctatccagctgtagccggaattgagggtccttttgttgccctggtcagaggtttcatcaaggtgcgcccttttgcctttgaagaggccagggagccgtggagaggagcaccttggaaatgcgctgcatgtggtttgctgtttctgtgcccctgactctacgtgtactttattgatatccagtaaatgcccagtacagaaaatgcacctctaatagggtgctccataaaattatgctcccttcccgagatccacgtgaactgcatgtcatttatcaggtgccactgaatctatgtaatgaataatttgatcccacagcaccatccttcaaaccctgtgtctgcacggggaggctgttaattcagcttgcttgcaggcatccgtagtggtccacagagaccagcttctgacgttgtttccagggaggtatagcagaaaggacgtcggctttgaattccaggccttccttcatgggaatccagagtctgccttggttctatctatgtctttgggcaagtggcctaacctctctgaatctctgttttctcatccttaagttggggctagtagcatcttccttgtagggttatcaccggattccacatatacagatatcagtgtgtggctcacagcaggcatttggtggatacaaactcatttattcctttcccttaacttcctttttcttcatactctttcctagaaaacgatactcagttacttgctgtttgtagggaaaattttatttactcactgatcacaattgtaatgtcacagttaaagttgaggagaagaaaaaaagacgaaaaaagatcttgattctctttatcatttccttccacagagccatcagatcattctatgaccaagtgagatgttataaataatttagttctactcattttttacatgacagattaaggcttcagacatcctgctgtgtgactcagagacacacactcacctgcccttggttgagactaggtgtctttgcaggttttgggtgacaaagacctggctggtgatactgagccaggagatggtgagaaggtcaatatatgaagacgcattaagcttttgcaaagctgtgggttcagaagtagccattagagagggatcatctgagttgggtgataaccaaagagttttatgcttgagaaatggagaaactggctcaggaattctgtaggcagcgtccagagaggctgctatgaggctgcagtatggtacgtttcatctgaggactgggggccggctctgaggctgtaccacagcatgctgtgattctcagagatcagggtgaccagaggagcagctctgacctcgagtggactgagaggggatttagagggtgtgcctgcgcatgtggggagggcagaggtggtgcaggcagggagcctaagagaacagagtggacacgaacgcttactgagtacctcatagatgaaatcccctcagtgactgtgaataatattctctttactcctagtttatagatgagaaaaaaaagggttagagagtacagagaatttgcctgaggccacacagtaagtgtttcagcacgtaagtctgatggaaatatgccccattcaacacttctgaatccacgtctataatctaggaatttggaagaggaaagggagaggtgaaatgggagctctttttctttctgtgtttgactctgcattccccgtcctccccatataatcagtgaatttccactttcgaagcctcaatggatgggctgaattctccataaactggcattcttctttttaggaatccctccattatgaactacactacattgataaagatgctctgtgaaaatttcaaagtgttacagtttaattcagcagattttttccacccgaggagcctcatacgtgcaaggtgcaatgcatgctgtgctatgtgacagaatacagtgtccagggaggtgggccccatgttcagagttctctgcagagagggggttacagggaagccagcaggcattccatagggtagactatgtacgtgcctgagttaagggggtttggacatgctttggggttttaagaagagagctttgtatctgattgacattctggaaagacttaagggagaaggttataccggaaatggcactgggtggatgggcagggtttcctcaggtggagatgggggtgtaggaagtgaagtatgcacacagtcaggagggtggccataggacaaaggttcaggttggctgatggtggggtatggatgttagaacttcaacaactgccctcattttgtgggttataaaagtaatgcatgctcattacagaaaatatggaaaatatatgaaaatacaaaagaaaaccagaggcaaccattattccaatattttattgtattttcttccagactatctgtcagtctgtataaacatttttgaaaaacttcttttgacagttggaatacatacttcttatagaaatttggaataaactgaagagcaaaaagaagaacataaaaatcacctgtaatcttagtcagtaagattcttaagactgtttaagattcttgcatcttacctatttgtgggtttgttgttgtggtggttttaattgagatggagttttgctctcgttgcccaggctggagtataatggcgtgattttggctcactgcaacctccgcctcccaggttcaagcatttctcctgcctcagcctcccaagtagctgggattaccagtatgtgccaccacgcctggctaatttttgtatttttagtagagatagggtttcaccgtgttggccaggcgagtctcgaactcttgacctcaggtgattccccccaccttggcctcccaaagtgctgggattacaggcatcagccaccgcacccagcctgttctgtagttttaaagaaggaagatgacaggtttgaaagtgcatgagatggagactgactggaagggatgagaaaggcggcaaggagggagctgaggcgggcggacagggaggagggctgcagtgagggagctgaggcgggcggacagggaggaggctgctgtcaccgtctagctgggaaaagaaagtacataaaatttgagagactggaaacggtttcatttgagatgagtaagagggaagcacagaggggactcccagcttttctgtgaaggatctaggaaaatggtgatgctgtgaaaacagagacagaagatattggcttggtagtcagcttggtggtagctgtattgaatttcacgtgtcagggagccccccaggtggggatccccagcaagagttggaaatgcctgtcttttttaagctttctcaggtgggtggttaggggtttgacatctcgatttaagtcattctcagatggatgatatgtggtttgaactatatagaaagaggctgctctaagaatgtgaaaagggtcgggtgcagtggctcacgcctgtaatcccaacactttgggaggctgaggtgggcagattacctgaggtcaggagttcaagaccagcctggtcaacatggtgaaaccccgtctctactcagaatacaaaaattagccgggcgtggtggcgggcgcctatagtcccaactacttgggaggctgaggcaggagaattgcttgagcctgggaggcagaggttgcagtgatccaagattgcatcactgcactccagcctgggtgacagagcgagactttgtctcaaaataaaataaaaataaaaataaaaataaaagggtaaacaggaaagcgtgaagtgtatactttacagcaagctaaaacaggcaaagccagtttgttactttgaacagtcagcagctgtgacggcactggggaaagtgtacagtctcagggtggaatggctgtgccactcctcctatccagcctaactttctaggatcccaggggtggaggctgccctggaaattgttgtgtacgtggctgtgttctgagtgaagtctaaaagcaggggaaagagctggaagagagggagcatttggataagacactgaaggaacatgcggtaactgcacatgttctaatgggagcccagcctccctgttggtttccactctgacaagacagactgctcttcctaccccatctgttgttggagggtttgttattcagtggtacccttagtaggcagaggtggagagtggggcattctagttaacaggagtgtgctagttagcaagagaatggagtgtactagttagtagaacttgccctagccaatttatgtagtgaacccataggacatgtcagatctggaaaactgcctttcatgagtgcggaagatgtagtggtcggcctcttaggtatttttagagaatcacatttgaacaatcacaatcacagatctttaccagtcaggtcaaaatttggagtgtcaatgtgtttggaaaagggctttatgaaaatttgaactttctttaaagttcttcctgaagatttcatatgagaacccaaatcttaagggaaactaaaatctcataataaaaaatctcatagacacagatattcatgagtaatgacagattaaaattgtgagtagaaatgcaggaatcttaaggtaattctaaataaaaacaatccagtaggactattggaaaattcttaccaagtaatgattttgtaatgattgtgtcaaaaatgtaaatttgattcagtgacacagttgtaattttgatatgttctttaagtctcttaggtgcttaagtcatgatgtaagtttgaatatttttttccttcaatttaaaactttatttctacggaatgtagatgtccttcagaagttcctaggggaggtggtggtggtgacaggtaaattcattgtgtctatgacttccaaaggccagttttcagaccactgtcatcagtatcaccttaggttaaatattttgtaaggaacaattcagatatatcccggaagaggtaccttttatgctttagtccaggccctctgggttttacctgtttcttgttgtagccactgctgcagcagggaaccctggaaactctaatcaccttcgtgtaggtacaacttgaaagtgcttctctcttcttgccttctgcccaaggtgacacacccatgtgtgtgcaactgtgaaaatgagcctgcaaactcaaattctaaagaatatgaataatgcaaagaaaggaggcaacaatatgaagaaatgaaatataaattgactcgagttaattttttataacaaacaaaagcattttaaaatgtgtgtttaggatgttcaaagaggtcagtgaagaaataataaactatgacagaaaataggcaaaataaaagaactaaatataaaacttggaataaaaaatagctactgaaataattccatacctggaactcttagattgaacccagttgatgaggaacttagttaatgttttagtgaatagttctgatgcacatagagcaggaaaaagaagaatgtatctatcaattaatcagcagttaaatgacacagaggataagttgagatgtgtcaactgacatgtaaagggagttctggagaaatagaattgcgagaatagtggagaagcaatatttgagaatataatagctgaagactttttagaaatgaagatgtgaatcatcatattcaaagtatattttaagccctaagcaagataaataaaaatgaatgacatctagatttataataaaccccagaatattaagaataatgaaaaaatattaataactgtagaaagaaaagacattgcctacaaagaaatgaccatcagactgacagcaggcttatgagtgccaatgatcgtgagaagacaatggagtaacatcttcaaagtattgatgaaatgtatacccagctaaacttacattcgatagtatagacataatagaaatatttcagatataaaaagacttaagagattttataactcatagacagttactataaaacccttttaaagatatatttcagtaagatgaagaattaaaggagagacctgaagcataagaaacagtaattagttaaacaatgattaaaatgttgatcactgaagcaattttaaaaaaataaccctctgtgtgtgtgttagaagaaaataaaaaaggcaaatctttacactgcggtaatgagatagagattgttcagtgtggcgggttttgagtttgggagaaggttagaaatactaactttagacttggtttggaaaacatagtgaagtgggtatgtaacaattgtaagggtaaacactagaagaacagatttttttttcgttttgcctccaaattggccaagggtcaaaggcagtcagaaaagactaataggagagagaaaatgagggaaaagaaattaaaggaagaggatggtaagtagaaaacacaaaatgaggttatggaaagaagtttaaatagccagagtaaatatattaaaattactaattagaggaagagattatcaaattggctaagaaccaaaatcctgttatatgctgcttacaagaaatgcacctaaaataaagacacatggaaaggttaaaaaagaagactgggaaaacatacgcctggtaaatgaatacaaaaaaggtaatgtaggtatcttaatattagaaaaaataattttaagaacaaaagactttaatagcattaaaaatactaaacaataacaaaaggaatagtagcaagaggataataagacttgtgtatgctaatagcatagcctaaactgtgtaaaagaaaaactgacagaactaaaagagaaatcaaaaaattcacaatcacaggaggaaattttaattgaatctctaagaatcagatgtctcaatttgccagaaaattaaacagatatagatgatttacataacaaattgataagcttgtccataaatgtctgtaaaaccctgtacctaagaaacacatagagagaaattttatgcttttcaagcacacatagaatagttacaaaaattcaccaggttgtaggtgacaaaataagtctgaacaaatttcaaaataatgaagaccacattctctaacatgatgcaatcaaatcggaaataaaattgtgaaggtagtataacaggccatatgtttgaaagcaaaaatgtatacttttaagtaattcatggattaagaaggaaatgaaatggaaattacatcagaagagaatggcaatgaaagtactacatatctatacgtgagatgtatctagaacaaaccttagaggttaaaaacatgtattagaaaagaacacttgaaaataaataagctaataattcatatcaagaaggtaggaaatgagcagactaacagaccaaaaagtaaactgcaaaacaagataatagtaaagaaagagcagaaatagaaaacagaaaggaaagatgataaagaggatcagtgaaacccaaggtttgctctgcaacgaaaacctctaaaaagagagatataaaaatatgaatacatgacaatgaaacaaagcatcccctaatgattctcttccttctctccaaagtccaggtgcttcaggaaattttattgtaacttcacggaacaaataattttttttctaatgcggtgttacataggagagaaaataagaaaggctagccaaccaattttctgaggccagtataaccttgataccaattctggacaaggacaatataagaaaataaagttataataaatcttcataaggaacgtaaatgacaaaatctgaaataaaatagcacaggtagttcagtgttaaaatgctctatgagtaggtaagatttactgaaagatgatttagaaaaatctgttaatgtaatatactaccttaagagattaaaggagggagaacatatgatcatctcagaagaaagcatgcattgttaatattcagaactcatgcatgataaaaagcttttcaaagtaagaatggaaggaaactttctcaacctgataaaggatatcttgcaaaaacctacagtaaatctcatatttattggatccttcccactaatattaagatgagacaaggattcctagcattgtcattattcagcattgtatggaaggtcctaggccaatgcaatacaatgagataaaggcaggagaataagaatgggagagggagacagaaaactcatttgtacagaatataactttctgtataggaaatcaatgagaaggtggagtcaaaccattagaactaatagaattctctactctttctggctgtatggaaggcatactaaaatcagggtgtttttatacaccagcactaagtaatcaaaaagtatagtagaaaaaacagtatttataacagcaccacaaatcatggggtacatagaactatatgtaatacaaatatttaagatctttattttcttgcgatggagtctcactcgctcactcaagctagagtgcagtggtggaatctcagctcgctgcaacctctgcctcctgagttcaagcgattctcctgcctcagcctcctgagtagctgggactacaggtgcacgccaccacacctggctaatttttgtattttttagtagagatggggttttactatgttggccaggctggtcttgaactcctgacatcaggtgatctggctgcctcggccttccagaatgctgagattgcaggcgtgagccaccatgtctggccaaatgcttaagatctttatggagaaaattataattataacatggtattgaaggacatccaagaagacttgaataagtggagagctatgttattgttttcatagtagtaaaataaaaccttgcgtaagtcctcattctaccacatgttaactaaccctctagctgatagtacaaacactcactgcgggattttatttataagggctctagaataaaatatgagttattcacactaaaatcacctgttaagtaatattctgaactagttaatgcaggttttcattgtgttgtggttggtctcataactaggttgagtttttctcctctgctaagaggaaacaatactgaagttgtttttcttgtggcatttgtattataaaaacttggtgtgggggtggagcgcaaagctccagcccactgaatgtctgccagttaagatgatgttgggttaggttacatctggctactgtcctgggaaaatcacttttatagagatgggcttccaggtggttttaaaatttatctttctattgacatttgtaggtcaattatatatgttgactaaatttacaaataaacttgtgtgtccaaaccaaattactaatatgacaaaatatttccaaattcatctaagttcaataaaattctatttaaaaattttaaaggatatgttatggaatttgacaagctgatattaaagctgaatagtaataggccaagagtaacaaagaaaaatttgaagaagtataaggtaagaagacttactctactaggtattttgactcattaaaactagcctgattacaaccgcctgatcttttcctacacgtctgctccatccacaaggttccccacttaagccagtaatcttcgagtcagccataaccctctctttctctcaaactctgtgtcaaatctgtcaggaaatccttttggctctatcttcaaaatatatccagattctaatcatgacccatgacttcctccaccaccacttggtctaaaccaccattatctctcacttggattacagccatagtttcttaaccattcactgcatctgtgcttggttcactctagtctattctcaaccgaggacagccagagtgattttgtaaaacataagttttatcatttcctctcccgctcaaaactccaatgtggctacccattttactcagagtaaaatccgtagtccttaaccatcccacaaggtcctacactatctggcttatctgatctttgtcctgctacttcctccttgtttattccactcaagccacactggcttccttcctgccccttagaaatagcaggcacattcttgttgcccctgtaggactgctttctctaccccttgctggggatatctgaatgggtgagtgcctcactgcctccatggctttgtttgcagtcaccttcccttggaggctcaccctatttaaaattgtgctttcccagcccacctgatctctctgacctgctctgcttttcttttcattttttatagctcttgttaccttcaaactatgtcatctacctaggatttttggtgtttttaatctttttcccactagagtatacacactaaacagggtaggatcttgtttgctttgttcactcatttatcctgggtgcttagagcacttcctggcatatagtaggcactgaaaaaatatttgttgaataaatgatgaaaaaacagtataggattggtgcaggaatagacaaatgaatggagcgtaacagaaagcccagaaacgggactacttacaacgatgtcatataaaggtaacattggagataagtgggagaaataatggattatttaataacaatttatttgggattcttggttatgaatatggaaaaaagtaaactgaatccccacctcaccccctacataaaaattatttccatatggtctaacaacctaaaattaagcttaaaattttaaagcttctgaaaatataggatattatctttatctttatatatggatggacttcttatacaaggtacagaaaacataaatgataaaggaaaagatagagaaatttaagaacattcaaatttaaaacatctgtatgacaatagacataagtgaagggaaaagcaaatcagatatgaggtaatatctgtaatcatataactggcaaaaaatagcattcaaaacataaaaattgcaacaaaccaagaaaaatagaagaacccaatagaaaaatgaacagaggcactttataaacgagtgtacgtgagtggcccatatactatgtgaagagatgctcaacctcagtggtgattagctatgtatatgacataatttttttttttttaagatggagttttgctctgttgccaggctggagtgcagtggtgcaatctcggcttattgcaacctctgcctcccaggttcaagcaattcttctgcctcagcctcatgagtagctgggactacaggcatgtaccaccatgcccagctaatttttgtgtttttaggagagacggggtttcaccatattggccaggatggcctcgatgtcttgaccttgtgatccacctgccttggcctcccaaagtgccgggattacaggcatgagccaccacccctggctcgaaatatgattttaagcccatccaattggcaaatatttatatactttgtaacaccaaatgcttgcaaggctgtggcacaacagagatcctcctacactgcttataggacgattgtacctggcaaactccttttgcctacttgtccctgtagcagtgatcccagagtgcccaggcaatagctgtatcttataactcaatggagtcttgctatattcccagataaaagtgtactgttttggggactaggacctctaactctacagagccaagagtgtgggaacaaaagctacaaagtctcccgatgggtccctgagatagtaaatgaagtcaatcctgtttctctcctttgctttccaaacacgtgtattattcatttggggaacatggtgtgtccctacctttggagtgtttgattcagtgtcctggagtccggcacccacctgcacagtttgttcactgaactggtgctgtggctgtgccttggggctattccagtgctttttcaggacggcagttcctggtgacgtgcagtaaaataaaacaggtggaaaccagctgtgggctcactgctgcattttccttgctgcaaagtgagttgcttggtctgatggatgttatttaggggacagaagttggccaagaccctgaaggcaggaaagtcaaacacgtgccaagaatacatgtatgtgagtgtaagaacacatcactggccctttcagcatggaaggggcccggtgtaatcctttgccaccttatggtgggttggtcctctcaaggagtggtgctgtgtgaggcacttggtgacagtctctgttgctggccatttggacatttggtggtggcagtagctaggtggaccttggtgagcgggtgtgcatgctgttgggccatgtgtaacctatctctgccattgtggccagttcgttcctgcatccattacgcaggtactagggtagccagtgaagacactggctggcatcccctggctgggcccctttccatgctttgtggatgagtgcctctttcatggtagatgccctctggctggcattatcatgtggtaaagagatcttcatgctgcatactcactcccacatgtccacctatgtctctctaccccagatttcctaattcttcctcttccagtctttgtgtttctggcctctgactaggcagccaagccacttgctgctgcccttgagtccacagctgtcctgaacttgggctattcttccctctctgaaggaaccagttgggaggatttttcccttacccctgtctttcctggccactctagagtaaggctgcagtggagctgccctgcatttccagcctgcacccatataacaaaccaaccattcaacaccccaccccccgcacccccatcccccaaatcggcctttctctctgcccccagctggttttacaggatcgccacacagccgtaggtgcgaagtgagggagggagttggtgcagcctggtgggtgctgggggagtctggcttcctattcgtgcagctcacgcgtgccctctggtcctgcttgtgcatgattcccgatgtacaacttcctctttatgatagactgtggctgtagccccttgaccttataatctggtgggtctgatgggacttaccttttgatgggaaatttcagccacatcatcccctagtgctccatggctgccatggtgtgcactgtgcagtgtgcttcattatcacccatgtcatgatcttgaagtgctttttcccattaaactaggcttcttggtgaaatggtcgattctgggactggggtaggaaatgtgcaaggtgagtctgggacatcctgtcaaaccagagagcaaagaagctatgagacaactgaggagaaggagccaatttgaagagggtctcactggccaaagatatgactgctgaagcttacatgagagcagtcattgaaacgatcaaatatgtttaaatgaatatgtttgtgatgatgtttaaaaaactcttcgattagcctgggagatagcaagttcgtcatcttgaagacactatgtaaatggatgaagcaagcatttatcttccctgtcccatgtgaattgtaccactgagtaacaaagtagtagctgaggggaagcttttcattataaggtatgaaaatgaagtgatagaattagaagatcactattttgcaactctccaggaattaatacatctaggcattgagcacccatcaatgctaactagacatgaaagagacaactagacattttgtgctttctaatcaaagaccatccatagccccacctctagtcttgccagaggatcaagtctgagtctgatgaagcctctggatccaattgtcaacttgcagaaagttgtcctctgaggacggttgtgtgaattgaattgcaccatgagaacacagtcctcagaatccacagtgtgagaaactgaacaggtcaagtagactgtgatcttcaagggataaggtcaaaggaaaagaatggagacaatgtgttgattaaaatgacttaaagacagccggatgtggtggctcacgcctgtaatcccagcactttgggaggcggaggggggcagatcacctgaggtcaggagttcgagaccagcctggccaacatggcgaaaccccatctctactaaaaacacagaattagccgggcatggtagtacgcgcttgtaatctcagctactagggagggtgcggcagaagaattgcttgaacccgggaggtggaggttgcagtgagccgagattgcgccactgaactccagcctgggtgacagagggagactccatctcaaaaaaaaaaaaagaacttaaagacgtatcaaatttaaaaaaatgagcaagactataatgtcaggggtggacacttagatgataaagtgtaagaaacataggaagtgattactgtgaaagtcagataacggttgctttttgggctataaggtttctgttgggattggagtgtagcacacagggaggcatgtctagggtagatggcaaacttctgattcttgacccaggtggtggttgtaagggtgtttgcctaataacagtgcattgaaatatatgtttgttttgtgtggtttttttgcatcagttttgttttataacaaaaggctaaaaataagtatttaaagaaaatagtgcatactatattttatttgctgatattcataatgatcaccagattattgaaatttatgagtaattttgctataaataagcctgttttctttgtttaaacacacacacacacattttcacactcacaccttcaaagccacataatagaatgtttagcttaaacctgcagccgctagttgaaatgttgcttcatggagttttatcctcctaacaacctgtgtcctaagtcacattcctctccagaaatgtggacattgaccatattccagtccctgagacgctgtttcagccacacgtggcaccccagacccttgcccacctgcatcctggtcattcatcctcctcctcatggggtcatttcttgatccctattaagcattaaaaggggattaaatatctctctacttgcagctaatgttttgcttggtttggccaagaacattttaagttttaaaaacctggggctattggagtgggaccatgggcaaaggtcaggacaggctagctactaaaatggcctgccacggaccttgtacgtgaaggttgaaggattctggtgctctctggtgccatcgctgttagtcgttgtgcagcacagaaatattttattcaacaaactctgcagactcctgaactttaggggtgggctgccttctgcctggtgctctgcacagatcctggagctctcgtggtcatttatgtgcagtgaagctgctccactcacctacagcttgtccttttccagagaatccctatcatcctcccctcatcccaaggaatgcaacaaaggaaaattaatagtgaatgcttttgccggagacctgtggatacttaatttttatagatactcaataaatatttatttatattcactagcagcaagcaattcacttgtaaactggtatagtggcgggtaacataagcataagcagattcttatgttatttctttgaatattttgcttttctttaaaaatgtaaattttttattcttaaagtaataggaatttattacagaaaaatttgaagaatgaaaaaatattcctaaattgtcaccactgtaatacagtagtggttattatcactttagtatacttagtatattttcttccagtctaattttggtgtgaaaatctttagtagttataataaaagtgcatgtaattgtgttttttcctttttactttagccttaggtaattatgatatcacaaacatatttccatgttgcaatattatcacaaaataattttttactgcattaaattttattatttggccttatatttttattttaacctatttttgattaacacattttagcaaatagaatatctttgtataatatataactttattcaaattactttttgggttttgttgctttggatttttagagtagaatattaaagagtgtcaagaatttcagtaaacttctaatttatctttcagctctgtcgtcaaatctggtaaatcgagtgagtgtaggagtgggaggtgtatagtgtatattaatttgccaactgttgttccactcaggatctcagttatacgtaacttcataaagccatataaaatttgagtgaggcagtaatcttttttacatctagaagtgggccatagaacaccaattgtactggacagtttagaaacttatggtacaaaatgaaggttctgtatttggagcccaaggaagtgcatggcaacatttgcgacgtgcgtgagtgtgtgtgctcttgggagatgggttgtgattttcatcagatgttcaaagagatcctgtgcccactggtatacacacaatgtttgctagttgaatggagtgctacttttgtgagtttgtttattgttgtcattctctccctgcctcccttccaaacccttctcctgcgttcattatatccagaaataaaactcagaaaaatttacttttgggtaagcagtgatttatcacatgcaagtttatagtgattaaaaaaatgaaaactaaacacatatgtgacattgttaattggaaatatgcatgaatttatgttgattttggaagttttcacattaaaatgggtaacttagtgctatactttggtaaaatatttttttaaaaatatgtgaccagggagtggatcattcagtaaattttctattgattcaagttatgaattggatgtggaaatatgaaaatagttacccccttactgtgttatttggaaatgtgtagatttactaactcctttaaatttgaggccttctaagtttttgcacagctaaagcaaagagatattctatgcaaataattgtaaataaaattatttaccaatgttaagaactctccttctttaaaagataaaatcttagtcatttttggttatcaaatgacaggagcaactttttttttttcttcatgtaacaggtgtatgtggatgtgcaatgaccactttgttttgaataatcagtatcctttttttttcttttttcttttttaaggaatgggatgtttctggggagctgaaaggaaattctgggtcttgaaaggagtgtattcaactcaagttggttttgcaggaggctatacttcaaatcctacttataaagaagtctgctcaggtaggaagaatttgctttattgtattactaggagaaacaagggagggcttgtcactactgttgggtgacaggctctttaaaatggaaatatgtttttttaaaaatgtttcttcaatctttattatttgtgtatatatacttgtgagcttctcactttatatgtttagaagatgataatcttcctgtggagtgcaccatttagcttttgctgtggaacaaccactctaaaacatggtggcttaaaacagtcattttattagcttgtaattctgatgatcagcagttgaggctgggctcagctttatggttcttctgttagcctcacctgggatttgctcatgtggctaaggtcaacctgtgggttgcctgggggctagtcagcctaggctgctttactctttggcctggcagttggtgctggctgctggttagcactaactgccagctggggtaatggggatgatggaccatatgtcttcagcacactggcctgagctaattcacatggtggtggatgcagagaacctaagagcagcaagagaggatgaggcccattctctgtttgtgttacgttcacttttataccattggccaaagcaagtcatatgcgctagctagaccagagccaatatgggatggctccccaaaggcaaggatataggaggtatcaagaatcgggaccattatttcaacaatctaccacatgagacagacatttcagatactggttgtgttttctgtaaggaaaaacactgaaagccgtgctataatgcagggatcagcaaactattgacttgactcataggccaaatcccacttgctgcctagcaaactattgacttgacttataggccaaatcccacttgctgcctatctatataagtaaatttttgttgaagcacagctattctcattgttattattatatattatctatgagtgttttcatgctacagttacaagagttgagtgcttgcaaccaactatgtggtctgcaaagcctaaaatatttaccgttgggtgctttacaggaaaaaaatttgctgacctctattctaggctaacagggtaggcagatgccctcatggcaaattctgtctcgaataccagattacctctctggacttgtttctgacctaaaggatttcctttcctttcctgccagctcagatagcatttgaaatgtttttctaaaaaaaattatattcaccattttaagaggtcttaatagggagggagtatctggagttatagtccactattattgatgaaaatggggtgtaaaatgtaaacagttttatctttctaaaataaagtcttaaataagtgtggtttgtggaggatgcgctcagccctccgagggcaccatgaatgatggaggggaaaagctggagtttgggagcttggtgaatagtgagcatgttgatgtgtttgctacaatatgaattctattttgaaataaaaattgagctgtacaacaatgaaaatattataaaaatgtgcatgttcttattttttcttgctctagagaaggattgaaatattctgattcgtatggagaatgtggtgtaacaaacaaatattttaatggttatcctatttttttttaacttctgtttcaaaattaaacgcttatgcatagctataaatagactcaaatgaatcctggagatcacccaggtgtatcctctcaagtcttaggaatggaaatgagtagattccttcctgtaattccagacgtgacttaatggcctaagagaaaaaggttgctaagaaaacctccaagtatctattgctttatacctattatcctcaagcagcaaaatgttaacaatcagttagaatattgtgattccttgtttgctcgaacccttttcagttcagctgtttaccttaataacaacatgataattgccatgtgttaaactcatgctatatgccagacactgtaataagcactttttctgtctttgcttttctctaagcagttccatgaagtatgtcagcttctatcttttacagagggagtgtagaggctcagagaggataaataacttacctaaggtcatacctagcaggaatccctccctcattagctctcagctcaaagtctatgccattgaccatggtgtaagtctcccagctgtcatcatatcccagccattctccattcatccctttgcactttcttccaccaagtcacaaattctctttcatatatgtccctctggtatatttttaattatattagtgtgcttttaaatgattaaggagaatgccaaggaaattcttttgtctttcttatgtttagaaggaaaaagggccaagccagttcatgcaaacagctggtatgttagaggcctctagcaagtggtaaagtatggaaaccacagagactggtaaagaactcgattggatatgaacactacctgctaagttaacagtagcattgggaagcatggttgtcatggaaacttgttcctgattggaaagggatagttatagggtcttacccatacacagaaggagagacgatttctttccctaggcttttttgttgttgttgttctgatcataaaagggaaaaacaaaaaggcagagaggagctatgatagaaaggtccctctggcacagaagtggtacagccttcagatccctgggaataacagggaaggagaacaaataaggtccctcgctagagtaattatggtaaccagctaattaaagatttttgaccaaggagaggggtgggggagacataaagcaggttacactggcgggcctcccctctgaagcctctggtgctcaaagccttgctgaacaagtcagccctggagtggtctgacttaagagaaggaaaataaacaaacaaacaaacaaaaaccccaaggctctggtaagatgcatagtaattgctgaggtccattgtgggagaaatactagtctgtactctagtatctgcttgcaattaagtttgtaaaactttgatcacaatccgtgaatattttgtaaagatttttacttttattttgtcaagaaaagaagcatagagacctggattgtgtgcagattccttctctcataaagcggtatgcttgagcttaaggtaccatgtggtttcttggggcagatgccagaaatataggaggaggggttaacagaatccacagggccagctttaccaccgctctgtgcaacctcttatgtgatgacgcacatcagagcttccacaagcattatctcagcacacaggtgggtgaacacaggccaaggaaccatcggctcaagtttgctacccctgctgtgccagtgggtctgcacagcctcaacaggggagaagtgagcgagagagtgtggatgtgagtgtagaagcagtgtgtgtccagagagggtgtggattcatgtccgaatggtatttctatgtggaaattgataggccagtgactctgaaccccaaatcggagttgtgactaggcatatagaaaagataacatggcttctcatagtagctgagagaggaggtgtccccatcgtgggctcactaatggggctgttcatggtgggcagtctccattgcttggtgccacttgcacccgacatgcgtagagaatacaagggggcggtctcttaggaatttagaataaagtcgcccattgagagtggcagtataaaatcagcctgctctgaatcacagtggagatggacagtcacttggaagagagattggtttctgtgtctgtaggatttcagagtaacctagtggaatgccctgactgtgtaaaaggagcataggtcctcagtaggaggttggtgagctagaacagcctgggagaggggaggtcctggccactctcttgggtgttctgggcagacccacagagcctgataccctggcacttttaagttgtatcactaacctcgtgttctgatccatactctgtaaaactttctaatcttttgtcctcctgtggggattatttacagaaagaaaatgcaatgaaatcaggttagtcaggcagacagttctaattcttatttagaattcaataaaatgcctctctgagatacatatctcagtctattgtgagtttagtctgcacaggtcattctctccaaattgagttaacctcgggctgagttatatgacaaaaacagagttttggtcggacctccatgatcttccaaggcttcagttgcctcctgcatttccctggagatttcctatcccttgcatgtgcccataatttcatttaaacctgttttaaaagtgtatgtaacttttaagtaacctataatcttcccttcctcaggttcattaagcactgaaccaatagtgcacaggctgagaaacttacctcacccagatgttttgggcctgaattctaacccctctgaaagccacccaccaccagcttctgcaccaggcacccagtcttggctgggacacagggtagcatctctcatggccagcagacctctgttgggccatgttctgatgcatttctgatctgtctctaagagatgtgctgagaagtaattcatgtcttagtggccactgttttgtacctaaaatgatgtccaaagagtcatccatccatttctgtttcctacaagctcagcatctggctggcactagggaacccagaacgtggactggaatagccatgaggagcctaacttgtatataggccttacttgaataaattaaatatgccacttactggaaaggtgccacatgtaaagcattgcaccaggtcctaggggaaggttggttttgatgtaaagaatactagttcctgtcttccagaattttctctatagtcaaatgaaagcttgatctttcacatttgttttaagaagttgggctgacactggttttctctttacacatgcacacacacacacacaccctcaaacagttgttatgcaaaccaactgattaactggcatgctgttgctttactacattgattttagaagtaattgagctattcagattcctgaatactctgatagagaattattcttacattttgtaataacgactgtacagatgaaaatatgaaaagacattctgcaatggataagcattctgggttaatttcagtgcattagcctaatatacaaataccccatttctggcaagaaaacccaggatgttcattcactgggtaatatcttttcatattttgcttacagatgttcagaacaattccatgtttattagtctattcaaaagcttttagaaatctgcacagccaagtggcactgaatccagaagcatgaaaggagctgcacaacttttcctcgtaagatttacacaagcagcacgggaaatctgaggcccagacatttccttatcaacagaatactccggtggattttcaagcaggctgttcagcagaggtttcgagcaggagcccaggtgtgggaagagcggagtgtgggagtcctcgtgtgaccctctgggggtggtgatggaactgactgtatggtctgcaaaacctaaaatatttactgtcaggtgcttatgtgtcctgtcctgagcccgtttcctctcttgtaaaatggagcaatgctgcttgatgaaaccagtcaagttgtggttggattcttatatgtaataaacctgcacattgtgcacatataccctaaaacttaaagtatgataaaaataaaaaaaattgttgcaaatctgagtatttgagaaaatctgggatacacactttctagctcttgggctcgttaaagatgaacatgatggatcatgaagcattgcttggcagggctggggccagcttgtggtaagtatgcctggcacagcacacggaacccgttttcttctcttcttcatctgtgttcttaggaggtcaggtcatgtcacccccttttccaaatgcgtgtgatttttttccttgatgcttgagagctctaactgagcaaggaataataatttccccactaatgtaagacaactcagtatacttttttttttttaagtttgacttaatttctgaagtgtttgggtggaagcgcatgtctatgtatcttacatgagatgaatgatcccattcttcagagtagggatgagttctcttattaacagattttatcaagcaatgtaaaactcattctaaattccttgcagactgcattaaatctctttttagtgcatagtcagtcttattgtactcatttcaatgtcagtcaaggtaaattactaagttattgacatactcctgaaaatgcaagaattctggtgttcagttcttgctacaagcaatttgatcgctttttattcctcttattttaggcgtaaaattggaccttaaacttgtagcaggcaggataaaaacgcttatctctctcaaaccaagaggcagaaagcaggcttcaagagcagagacccttgactcatacccttaggaccaaagatatctgctcacccaaccatcttccccacacccacatccaagcagctatgcaagacagattagttcagtgaatggacccattgcctgaagaaaaagtataggtaatgagaaaacagctggttttgtttattgtaaacctcaatcaccagaaatagcaagcttggcttctctaccatcggcacccctctgaagggttgacatggtggggggggggggacataggtcatggggacgtcaaagcatttgagacctagaagggccttaaccatcttccaatacaacagctttcaaactgggtgaccatggaaccctcaggctttcagaagggttctgcaggagctccagaggtaatgatgtttgaactcggtaagattcaagctgcttggagaggccattcacagctttcagctgtattatatgttgatgtcctgactaataaccttattttgaaaagttattaagaatgttgggaaacctccaagactgctttctttgtcgagtaagggaactgaggctgagagagatgaagtgatttgagagattttattagaagggttgaaaatgtgcttgtcttctcagatcacagtgtgactagaacacccaaaagaagttcgaatcgtacacccattctgctcctctcagtgaggtggacggtcaaggattcagagtaggggtggctttggagtgggaaatgttaagatgtgaagagatcatagttttgtcatttggttcctgtttatcatttctgttaggctggattttttcaccagtattgagtcctggggtttcctgatagatagttcttgtgtctgctagatgctttaagtcctgtctgcgatggccagtagcagagctaagggtgtgacagtaaagagcgcctgcaggagcccaggacttaggactaagaaaggaagtcattgaactggggagtggtatccttgctccctcacctccctccctttcaagcttctgcaaattggcttcctggcctgggctggggactgcctgggcctgcagaatcagggcaagtggactgcaaattgatttgtccacgaagcatgggctgcagaccttacatataataacctagtacgcacctgctccagtttacagtatacaagggtgatggcattgcaataagtaaaacatgcactcagccagtgctattgaattcagagcaatttttcaccatcacataggtccttcatccaccggttctaaaatttgagtgactctatgggggttctctggcagtatctaggcgaaatcatgtggtctctcatactcacgtaggtatgaaccctgtatgctgataggtagttcaaagttgaaaccaaagagacgtgcacattttgctagaggtatcccaagtttgcccagttatttaaatccagcattagacatcagagagggtgaggattttctatagcttcaaataactgaaggctggcaagcagcaaaacatagggccccacaatcctgctgtcctcgaatggtaaaaagaggcatttagtgcctttccttccccttcaggccattggctaaagactccaataatgtcagggtctgttctttgtcattgaagggcaaggggtgagtgaattggatggtttatggactctctaaagactattgcatgtgctacgtgttcttcatatgaccttgatattttaatattctatagttggtttggctgttcaactcacgtctctccttgaacagcttaaatcactgctgaggaacaggtgcagcggtcaaaggtcaacagactgacagactttaagtagttaaatgtgtcaatatttcagcaattttggtggtaaaattcaaatagggcatttaagtagaaaacaaatggaaaggaacaataataaaaacatccttttacccattcaacactagaaataggttattctttcattgttttaggattatattctcaaagacttagaagggagattaagaggaatttgatatagcaagcagtttttaaaacataattgcaaaagcagttgatgaatgtgcccacactgatgttttcaaatcacatctaatggagccataatgtaatatgagaaaataaccttatggggggtcagggggttgagcttctccaggaattttatgggatatgctgggtcttaattacttcataatgactgacaatttttagagccttagaataaaggtttctttttttttcctaagttacattaaaaataaatatctgggtcaattactggcccatccatctgccaagtgaaaattgcaacaagacagaaaaacacggttgctcgtcatgggagtgaagcacccagacgtgagcggagcggcttgggaagaggtcactgttgtttcctggggccgtgcctccgatctgccggggactcctcagcctgggagtcatttacaaaccaccgaggcccctcagctgcgggagaagctttgcttaataaatcctggcctctgaggcgtggaattgtgaagtctctcagggaatgccgagggacagaactaatttcagcgtcttcgttctttgagaatgggaggtagcatcacgtctctgactggagcgttctgatgagggtgaccacctacccacaacgtgttttgaactcttttatttatagttgttgccttcctctttctttcttgacgtttcctcttcctcctgcttcccctctcttctcttttgcttcttctttccttgagttaaggataagttgttttttccactctggtttattgttataaggcttaaaagaagtcacagaaactggtgacttagcacataatacccatcttaggtttagaagagcaattgaaaacataatgttctcaatgggtattacaatagtagtttcttgccatgaccactttgtaatccacaactcattctacctactaatctctgtcacagtcccatgagatagagcagcatcagtgctgccccttacacaggtgccaggggtcagagacacttgcacagttagtcagtgtgccacctggctcattagaggttttgacaatctccgctggtgggattgaaaataaaacagggtttatgtttaagactgtctccttctaagccttcactcatttccagcaaatgcattttcacatgtctttcgtgagcattttaggataatttaaaaatattaagctatgctagagctgtgccaaagttttgaaaatggcttataaaaaataatctagagatctggaagcgtttagatggatgtgatctacagaaacacgggatttccttttctttagccggatggactttacaggtcatctgttccggtgatttgtttgaaacttttattaggcattacaatcttttcttcaggcaaaaattttgcacagaagtctattaaaacagtgtgcaagatgctgtgattgggagagggggcttcccccagcactgtcctcagtattctggccctagagtgctgcctcaaaacctaccaggagcttagtctgtaaagcagttgaggactagggccaagttaactttgggctgaaacacgcagtaacatgagaaggccttccacacctcgctcatcactagcccactgcaaggctgcactttgcatgctcatggaaactcgcaggattattgaggaggctgtgcagagggaaggggccttttaattctctgcctccttagaggtgcaccctggcaggccaggagccccaggcagagatgtttctgtacaggtcccaggttttgcagcaaggtcccagagcatcccgttctcccagtgaaattccgttttcaatttcagcctgattccctgagtgaatttaatgtaaagctgtcccttccccctcggtcccggcaggtaaggagctgctggcgactgtcacaccagtgcccctgtcagcagacctgcttggctctggaaggatgggttgacaaaaagccataggtacctgaacttgtgtgtctttgtgcacaagaaaaaataatctgtcaccttgtttaaggcgtgttcggttgcgtttgatagtttgaaaatgctctggggaacaatcatctgtctggttttgagagtcaggtcgtaaaatggtgaaatcacatactgggggctggagtggggcggtgggcagtgtgggggcattgggaagctgctggtttttttttttaaaaaacaagttttaattttttcatctaataaactgttttttgtttaaagagcagttttaggttcacagcaaaactgagcagaatgtaaagagaattcccatctatcccatccccccaccatgcccgctatcaacatccccacctgagtggtgcatttgttacaccccaggaaccacactgacacgtcctcagcagccatagtttgcgttgagttcactcttgatgttctgacatgtataatgagtgacctgtgtccaccatgaagttattgtacagagtaatttcgctgccctaaaattctctgtgctcagcctattcagcccatcctccccccccaacccctggcaactgctgatcttttcggagtcttcatgtgtttgcctttttcagaatgtcattgagttgaaatcacacagcctatgtccttttcggattggcttctttcagtaatatgcacttaagtttccaccctgtcttttcacggcttggtaggtcatttctttttagcactgaataatattccatggcctggatgtaccccagtttgcttgtctattcccctgccgaagaatatcttggatgtctccaagttttgacaattacggatgaagctgctgtcaacataggaaactggttttaaacgttcagtagagattaatgcaagaactctggagtgggggaggcctggaggcctgggttgaaatgaagttctaccagagaggatttctgctagctgatatcaggcaactgggggcttcatccatcaaaagcacttaacattgaaacttacttttcttttctgagccacataagtaagaagaattcagacggcacctctgtctaggtgggtggctggtgaaaacttccaacagtacttttctctctccagagtgtaagagttcagatttgcatgtgtccattcttccctttctgtggggcagagatacatgtatttctctgtccccccgaggcgaagctatagtctctgaccccctgagtttcagcccagtgggagtgtttcttgtaagatttctcagtttgggaggaccttgggcttcatctcctgccctccttctcctgccccaaatggctaccaaggtgggtccagaagaaactctcagaggtctgtagtttgtttatcttctaggctttttatacatttctttccttcataatagctcagtgaaaaatgttaaaatattttaaaaatatattgtacccagcattttagttatatcaggcaggaagattgcttcagatgttgatgtgccctttcttggccagggcattgcaaggcagggttagtgctcgtagacaaacaaggattttttaggaggtgatgacaccatttccatcaggggtggccaggaatgggcacgtacagacagaagcattcaagtgacttgagaggatccttaggcagcctggaagtaagaggaagatgacaggccctctccgtctccacaaaaaacagtgtaattaaatgtggaatacccttacccccggaacatttgacctcagagaccttgggtctcaatgcattggacactgacagcccatgtattctactctgtgtgtgtccataaaccttcttcatttagtttatttattttttgagatggagtttcgctcttgttgcccaggctggagtgcaatggcgtgacctcggctcactgcaacccccgcctccctggctcaagcgattctcctgcctcagcctctggaggagctgggattataggcacgcaccaccgcgcccaagtagttttttgtatttttagtagagatggggtttcatcacgttggccaggctggtctcaaactcctgatcccaggtgattcatttactttcaattaacggcacctcaatggcctcccatttgactatagatgttaaataagtacagttgtctctccgtgtttggactaactgctcaaggctttgatgagcagcagagtctcatttagaaggagacttgccttggttcaagaattcactctcttacctaggatgtaattctatttttctgacaggacatgcttgatgggactgatgtctccagccaggtcagcgcagcagagaggtgaacaccagcatgtcttgttaagaagcaggagatgagttcatgagatttccacacacacacgttgatggcctttacatatgagcttggagatagaaaataatagctaataggttttagtcgtttccaagtgcatggcataattctaaattctttacatgtgaccacttcttctattttcataacagctgggggatagggagggggtaggctagtgtccctgtttttaaaatgaacaaatccaggcataggcagattatctgacttgtgtaaacccccataattagtaagcggcagagccagaatggacgcagggacggtctatgtctagagtcgttgttttgaactcctatgctgtgtctctctcaaagagaacaagaaagtacaagtcactacaatgaaaagaactccattgtcagtgagacatacaacacccttccaaagtgagaaagacaaaacacccagctaagactcactggctaattggaaagcaggacctgttattatgtaaaggctcctgtcctactaggtgagattttccttgagggtagggactatgtcttttcatctccctattcttgtgacacctggagcaggccttgctctcaataggctcctgatcaatgccgagttgtcacatcccctcatgcgttaaataaggccgtgtctgaggatcccactggaaagtcttggaagactctgggactcttgtaagccctgcacggtgcttcctgattatatgaggagttggagaatatcatgagaaaagtccaaagtctctcctaagttctgaactatagctcccttctcccacgtggcaactcttccctgatggtttaaagagcagaggtcttggcaaaaccaggctttccctcagattgttcagcagagggctgtcagttatctaagacctttttaagaagcagatagacagcgaggtgcggaggctcatgcctgtaatcccagcactttgggaggccaaggcgggcagatcgcttgaggtcaggagtttgagaccagcctggccaacatgtcgaaaccctgtatgtactaaaaatacaaaaactagccgggtgtggtggtgcaagtctgtaatcccagctacttgggaggctgaggcaggagaatcacttgaacctggaaggtggaggttgccgtgagctgagatcttgccactgcactccagcttgggtgacagagactctgtcaaaggaaaaaaaaaaaaaagaggcagttatatatgttcatctgttgcctttgaccttgtcaaatctattgaagttctcaatgccctgaaaacaaatggacttagatctatggccactctctggcaaaactgagggaattttaaactctagcatcttttgggctgtagcaaggtgacaaaattaagtttctggagtgccccagaggctacataaatgcaattttgtcatttctggagtgttctgtaaatatcgagcctataaaacagaatgcagttacaagaagagttaattcacaggttggtgaaaggaacactgctcataattagagtcaggtggtaaaggacatacttcctggtgaagcaggtgtgtagggacccgtgacattctcccatctggagttgtctcctcctctctccctgctcctgtggctgggggtgggattcctaagtcactttccctccctttccccattcccatttcttctgagtacttactaggtgcaaaacatttttctggacatttgggaaagctcagaaaataatatgttgatattcccctccaggaaggtagaccgtcctgggaaacccaggactagggtttcctggggaaacaagggaaagcagtccaggcgtgtgggggagagattcagggtgctttccaccctctcccggacctcagcttccctgcacctggctttgcttttgtaggctggggctgctgctcctctcggcttcttccatggcagtcggtgccacccagctcgctggtgttcctgactcgggctctgcccgcctcaccccctctgtaggctctccctggtgggtgttctgctgttcacagtcctgatttggcacaggccctctgaggacctcaacacagacgctccagagaagaggcctggacctgcgtcactgagaatgcatcagagggagcagttccgggaaagagaaaacaaccaagtcatttcggttggacgggacataaacactgcaagacaaaattgatgcacaataatgatatgatctgtcagaagaagtggcaaagaaagggaagaaatgagcggctgtgtgtgggcgagccattgatgcaggaggctctccttgccatttggtccagttgcagcagaataaaaaaagctccacttctggatgagggatctcacatgacaagtatgcaagagctgtttaataccaccacgcctggccagtgacaggggcacggcatcctggttagtaatgaaagtggagtgagaaagctgcaggagcctgagatggatggaacagggaaggagcaaagtttccacagaggagacagaggaggaggaagcgggggacagaataccccacgactctagcggcacacgtacacaagcgaggcagcacgcagagttgacaggcacagatggactggtcacgtagcctggagttagggcaacagatggacaagtcattgcataaattggctacccagggaccacaaatgcctgctaggaaatccaaggacgtatcatgttgacccagtgacaacatacctgggcagaggtagacacaggtgcccctgatgtgaaagggaaatgaacagcagtttgcattggtgggggggaataaaaagcaaacgagattaataaggaaaggaaggaaattacattgtgtgcgtgtgtgtgtgcttaatgtcttttgtaagaggacttacctttaattcatctttgtaagacctgactttaattatgtcacttctgaatgttgtaatcgtatgactttcagagcagtgggagaggaaaataacatttggatatttgatagatattcaaaatatagctgaaataaattttctaaacactgaatctttagtctaagcacaaagtgaaaaacaataactttcatggaaatagttacttgtaaaatgttgttcagctttcagaatgaagtataaaatacaagatggagttgtcatttaaaaaccaaatagtactaaactaaaacaaaagtaattcttgctagatatatttaggttgctgtaatagtgtacccaaaaaaaaactatagtctgctgtgatggtattgattacctttttatttatggtaaaaatggatgaattgtcatgtctttaagttgctatttactcaatattttaatatacatttagtatatacatttgtgttaattcttttttaaagctttaaaaattaatcacgtaatctttgaaagtcactatgctagggaccggatacagtggtgaacaggataaaattgtttctgtcttcatgaagggtatataatctattacttaaaaaaaaaaaaaaaaagactataaggccagatgtggtggctcatgtctgtgatcccagcattttgggaggctgagatgggaggattgcttgaggccaggagtttgagaccaggctgggcaagaaagcaaggcattcgtttctacaaaaccttttttttaaggactttaatttttagagcaattttaggtttaagcagaaaaagtaagcaggaagtacacagagttccgatgttaccgcctgccacacatacatccattttcttggctattaacatcttagtgtagtacatttgttatcactgatgggccaatactgatatgttattattaactaaagtccatagtttacattcgggttcacttttggtgttgtacatgctgtaggtttgacaattgtataataagtgtatctaccattatagaatcatgcagaatagttcactccctaaagattccctgcgctccacctgttcatctctccaccctcacaaacccctggcaatcactagctttttacctttgatagttccgccttttccagaatgtcaagcagctgtgtgattcgagaatgggtggaagcatacagtaaatagcatgtttagataggtctttttcacttagcaatatgtatttaacggtactccatgtctttctggggcttgatggcttatgtctttttatcactgagtaataatccactgtttggaggtaccataggttattttatctattcagctcttgaaataattgcagttgcttccagtttttggcaattatgaacaaagctgctattaacgtttgtgtacaggtttttatgtgcacataagtttttaactcatttggacaaatatttaagaatgtgattgctggatcatgtggttagcctatgtttagctttgccataaattgtcaaactgtcttccaaagtgactgtaccattttgctaccagcagtgagtgggagttcctgttactttacatccttgccagcatttggtgttgttggtgttttggattttggcaattctgataggtgtatagtggtatctccttattgttttaatttgcaattctttaatgacatatgatgtggagtatgttttcttatgcttatttgctatttttatatcttcttggtgaggtggctattcagatcttttgcccattttttatttgggttgttgttttcttattgatgagatttaagattgttttggcctttatcagatatgtgacttgagaatgtgtcctcccagtctgtggcttgccttttcattctctgaaaaatttctttccccaggcatccattatttgtgaactgtgtgggttgggcactggtggaccagagtagttctgggaaggtgaattgcaggcctccacagccaggctctgttagtcccaatattctcccagaaagtcaggttggactgttgcatgcccgaatgttggcactcacacctttcttgttcacttgcttctattgaccttgttactgggttgtacctatggttttggcctctcattttttgccgtgttggtcattttgtgcttctgatgactttagtagctgactctggccctggtcccttgacttcctgcaagttctgttacctgactgtggccatccaccctcccacatgggtgctgattgtcttgtttgtgtaccggcttggcctttgccagtgacagtttatcctgaccccagcccgaggcctagtgtctagaaaaattatcatattttcagtggttgattataaaaccagcattaggttgggtgtttctcagtttaatggctaaactcaaaatctttattgctgtcacccccaaacgaagttgccttgctgactttcccatttcttccctactggcctcaccattctcccagtaactcagactgtctgtcacagggccatctttgatttatccttcatcacctgtagacagtcagtagccttgttctcagagtgcttcagtgcttaccattcattctattaaaggacttgagttctaccatgataggaaaaaagactacatcattccaggaaggtatgtgtgcacgttcagacaataggttaatgccatatgcatttttctgaaaaccctgtatctccctatatggcagcctctaagagcctttgtggtaccaaaaccgggaatcattctttggctttgtttttaaacactgaaatccttcttcagtcttctctcttttttattcccactgccaccgatgtgaaactggccctggcttcatggctggccccttgaggcttcgtgctggactcaacaccttgggtctttctgaagggaagcctgctggggacaggaatagggaaagagctgagtaggacaataaggtggagagaaccagaaagcctttcaacccatctttagagtgagatcttcacagtgtgatttcgttattgtatttgaagtgaatgctagaatagctgatgcttttagaaatcaaatatagatacagaacacattacaaaactaagatttggtcattttaaaagctttgttatttgctttttcatcctctcctttcctcctattcactcaagtaaataatgatgtgaccacagttttctttacttaaaaatattttttttcacaggcttcagatctgtgtgtctacttgtcatgaaaagtatattttactttaataagctaatgatttatttcaacagaggaagcagagccctccaagtttatatgagattgattactccaaagctttgactagagacctgttcttgtagaagccagtctttttgtgaaagtcaggtgaattttagattgccttctcaaactctacctgtgtgtcataaagtcactgctatcattgttttcccctcatttccagtagcttatgagaactccagctattagcatgtagcatttaacctcctatactattaggtcgtttctttgattgcccagaacaatcttatcattggatgaaactattataaattatatgcacatagttttaaatgattgcaagatatatttgattctaggtcttttcagaagtttagcattgaatctttttcaaaattttctctttttgcaacatttccagctatatttcaacttgtttatcagaacgatggctgcctgggctaaaaccagtgctgccaggcaaagctgctcccagtggagcccaggtgggtgcaacagggagctggctgtcgggcagggctgagctgcttggagagcaggagtgagcaggtgggcatgatgagggagatgctgggggtcccaaggtgaggaaggaaaagagcaaatggccttctggtgcacgtggtcattaaggtgagatgactagtgagaagccttgagtcttgatgaatgggcgagggagacaatcctttatatcaagtcccaggaactaacttgagagcccaatgtggagggcactggaaagtcagttaaacagttagatagtcccacctgctgaggagatggaagcaagggccaaatcgcagggtgggggtcaggttggcctagagccctctatgcgatgagaagcttgaaacccatctctcagtatgtgcagccactggagctggggtacagctggggtcttggtgagtcctaagtgactgttcagattaggtcacaacagactgaggtatttgtctttaattcaggaagcaagagcattgagagctcttgttcacattttacctgcagctgattcaatatcctgtctgactcttcaggtggtgttttaccaaattatgtcctggaagaggccagtccatattccagaagttagaccagatgctaatatgctctgcagctggctggaggagggctgggtcatataccacgtgatggggagagaagagggaggcagaggacacagtccagcctggagcagacatggagtcaaaggctgatcttggctcttggaagatcctggggggagattgaggtaggacaggtgtgtcacaggggcttctgggcagcattcagctctggggtgctcacaaagtgtggtggctgctggaaatagtgacctatgcctctcattagagtatttcagctgaaagggcctttggaatcttctcttctcccagggtaggaaatagaaactcaacaaaggtgatgactcagcattgtcaggcagctagcccatagcagggactagaccagaaccctggccttttcacttttcagagttcttttagaaacagttgaattgggctgtaagtgatctatattaaagtacatattttaaagtgaacagtatacgttttgacataggtagacactgtaaagccctcaccacagtcaagataatgagcagatccattccccaaaaaaagttacctcgcatgccttcatcattcctccccctgccttcctcaccccgcaggcctggtgcccaggcaacctctgatctgcttcctgtcatgacaggtgtgtttgcattttgtagaatttttttctggaatcacacagatttctttttgtgcctggcttctttgattccacctgttttgagatgcatccatgttctcggatcagcagttcactcctttttcctgctgaatgatattctcttgtatggatgaagcatccttttccctgctgatgaacagtcaggttgttttcagtttggggctgttacaaataatgctgccatcaatattcatgtaccagtgtttgtgtgggtgtgtcatttcatttctcttacattaatacctagaaatggaatgaccaggacctgtggtaggtttatgtttaactttttaagaaatttccaaactgttttctggagtagttgtaccattttatattcccatcagcagtgtacgagggttccagtttcttcacttgctcattagcagttggtatggccagtctttttacttctagtgattgtaacaggtgtgtagccgtatcctactgtgtttttcacttgcattttcctgacgaccgaattatattattttgtcatgaacttacttgccatgtgtatgtctttcataaattgtctgttcaaatctcttatgtatgctttttattgggttattttctcattgtaattttgacagctcttgatatattctggaaacaagtcctttatcagacataatgatttgcaaatattttatctgagtctgtggcttgtcttagcattctcttaacagtgttttttgaaaagtagaacttctaaatttcgatgagatccagtctatcggtttttttttttatggatgaaacttttgtgtcatatctaagaactatttgtctaacacaaatattttctcttattttttcagaaattgtatagtttaagatgtacatttaagtctgcaatccattttgattaatttttatatatagtgcaagtcatttgacacgtgtgtaatatagcaaaaggcacatattggatctgtggattaaggtcactttacccaccgatggtgacagaagtcttctaccagtactgtcatattaaaatgcaaaggtcaatcatacattatatatgtacatcactcaataaacccctaaagtacattgcccagttttcataatacatttaatgaaagaataataaggtcattaagggcaatcagtgttttgttatattcctgattatattcttgattatagtttgttgcatttctcgaacgaacatggatggagcaagaagtattcctcttccccctttaatgcgaaccaacatagtctcagactccagtttaaaaccttgtcaacagcagtgattgcacattgtttaccccacccgctcccggttgtagtaattatggtactttagatttcctggagaggacacagtgcttaatcatgtaattatgtctctggacggctatcccaaacaatgtggagcacgggctctgccgttcatgacaacagccaagagagaagtttgtttgggttcttattgtgcagacacagtgggaggggaggctgcagtggctggggagagcaactcgtggagggaaggagttgattttggaaagacaaaatggggttgtgtagggatatgtggctttttttcttcccccagttcttgtccttataattattccaggagtaggagtccttagcaccactgcattgactgtggtatatggctcagtctccacaccacagttatctagggctggggcaagtggatttgtcccggggaattactatgggtcctagtatttagccttccattgtgcttctagcccagaagtgtgcttgctttacaaaagtcaggagagagatacaggaaggagcaccggagttggagtctgacagtcccctacacctgctgggggatcaggaatgagtcacttagtctctcccgacaccaatttcgctatctgccagaaggggaagagtatccttctggtgtacccaagtggattcagtgagaggacatgctctccatgtacataatgggccaaaggtcatgcattttttcattttatgtggaaaaaatgacttgcacgtgttcgtttgggaggcaccatgaaaactggctttaccttctctagggaccttccctaaccccatcccagaccctgaggcggggttgccacattcattccccttgcatatttccctcattgcatgtcctgcgtcacaatgatggctttgctccctgctgtgagagcaggaatttcttcagggccaagacctgtaatttttatttataactctagtgccatttcataagcatttgatgaataaacaactaaatgaatacatatgaagatgagcagagcagtcctggtgttgaaggaattcataacctggtggaggagatggacacgtgtgtgaataattgcagcacaccgttctagctataacaagcagtttattcacttttaaacaaaatgggaacgcttctttctcatctaataaaattgcttctgtgggcactccagacatttgggtagaaagtatgttgctgaaaaatgatttctaagaagagtagaggagatatggggagactacactcttttattccagccattactcatctgcaggctttcactttccatggcacctgaacttctactcccgaggttagggtggggcattcattacatattttcacagcaccatccttctcttttctgacactaatgatttgtttcccatctgcctcttctctccctatcatccagactagcgcctagcacatagtaagacctcaataagttgctgctaattgactaactatacaatcaaacaagttcacaccataaagactttcttaaaaaataaccctggcttcagaaattttctgaagaggggaacgagttctttccccatcatgggatttgaatatgggcctgtggccccaggtttcttttgagcagggctacagtctgattttcttaatagaacacattacaccattaaatggatctccacacacctggaggagctaacctattgaagagaatgatttcctgttatcctcctggaattcaggtacaatttaacttcttgccattaaaacacaacttgatagtggtaaccttttcccacctcttgggacgcttatttttagttttctggagaagatgcagattggaacacaatgactacagatagataaggcatagcccgcaaacccatttgcaggtgcgctgtgtttccttgcacagtcgtttgtctccaggtttgaatgcttctccaacgcctttattggcagttgaaaatagagttctagccaatgtcgatggattgttaccacaaaatgcaatttgctgctgcacgttgtgctcagataatgggcaagagtagaattcatccaaacaattgtgctccaacaattgtgttcaaagaaatgataccacagagtgagccattctcagttttctgaatcatttaagtggtttcattgtaactcatccctttgtcaactattcttcagtgggaaaataaaggcttaaaggaatttcttttcttcaagaaacagaacttatagcagaatcagaaatatgtcatgatatataggcctacttatggaagaaacaacccgtgttaccactgattactcgatcacttctgtagggctgaggcaacactgttaattctttgaattttctggctgcaccaggcataggtttgtgtgaacaacagggaagtgttacctacagagagccggcagggcagagtgtcaaatgcgtgggattcagaggcagaaaatttggacatcagctttgctgctaccgcttactctctcttttggttttttgttgttgttgttgtttgtttgtttttttgttttttgagacagagtctggctctctctcccagcctggagtgcagtgactcgatctcggctcactgcaagctccacctcccggggttcacgccattcccctgcctcagcctcctgagtagctgggaccacatgtgagtgccaccacgcccggctaatgttttgtatttttagtagagacggggtttcaccgtgttagccaggatggtctcgatctcctgacctcgtgatctgcccacctcagcctcccaaagtgctgggattacaggcgtgagccatcgtgcctggcctgctaccgcttactctctctgtgaccgtggaaaaatgatctcatctaccttgaagggtttgttatgagtgtcaaagaagataatgtgcaatggatagcatggtttaaacagtgaaggaaaaaagttttgtagttgctatagaatgaatgttttcttgtatgaactgaaaaacttgagtcaagtttcacatgggagctttggtctttccttaatggaatattatcagaaaaatgtgttttatatatctgtctttgaaagttttacttatataccggattctgttacaaataataaaataaagttctgcttattggtagctatttctgtttcaagttaatgcacagagccacaaaatgccatacaaaagaaaggcaacatgatgtcctttggctgaaggcttcatttctattcgttttccatagaaattatgtgtgtctgcttttgaagaagcatactgaaaaaaaaaaaaaactatcctctactaggtgccttatttgtgtaatagaagttctaatccaagtttagtaatacaaagaaagagagttttgcagatggaagactgccagcttgacagcagtcatgcccaggatgctcataaggactgctagaggagggaggtcaccaggagccagcacagggccactgaaaccacgtcagagcagctggagttccacacgttggtgaggggtgaaggagaggggaattaagtgttatccaggtggatgtacctgaggttctgtgatttcataagcattcataacgagtattgacacaatattcatcattagctcattcacatcagaccctatgaagaatttaggaaagctgtgattccaagatcttcgggcttttcttcaaaagaagagagttatgaagccaggctgaaggcactgcagggtggaatttgtgctgcaggggagaggcacccggacacaatgggagccaggcgccttccccacagcttggctttgccacggcagaaatgctgagctgacaggaagctcattttgttcctggaagagggctttattttatttcaaaccctcagctgcctggtgcacatttttgttctggcaataaataactttaagctcatgtttgagttctttcttctttttttttttttaatattccatagaagaaaaataaaagtttttatatgaataatttttaagactcagtaagaagtaaacaaacagctttttaaaagtgggcaaaagatttgaaaagacatgtcactatatcaatgatacacagatggcatatagcatccagtttacaggaagcaaggggaatagagaaatgctttctgtgatacctaccatggggaagcaagcaggcaaacccagaatttgggatacactaaggacagctgatgtggcttcttaaatatatgagtgtgttttttaaaaaaggggagagggccttctcaattatgtaacatttagagtacatgaccaaatacgatgtgaggactaagggatggaaattgactaggggaaaaataactttaaaaaacttttttagggtgacaataatcaggggaacttgaatatggagtgggaattagatggtgctaatgagtaactgttaattttgttggatgagataatggtattgcagttatgtataaaaatagcatttagcaattatgtataaaaatattgagggctgaaatgatgtgagatttgctttaaaatactacaaaataaaggaaaaaggaagaaagaagaaagattgatggcgtacatgtgttgaaatgttagtaattgttgcatctggagagcgggtggataagtggggtttattttactatttttgcttttgtatatgtttgaaaactttcgtcgtaaaaattcttcataaccatctttctagaaattatgcagattgtaaaatataagtaaatagtgacataatttgaggcatggattactatacatcttatatgcaagaaacacctgcccgtaaattcaattaaaaattgttttatctctacaaaaaattccgatttatcagacagtcaatttgcattacaaagggcactgtttcttttataaaatagtttgctgtagaattccattaaatgatttatgtaatttccatgggtagtctttttttttttttttggagatggacttttgctcttgttgcccaggctggagtacagtggcgcgatcttggctcaccgcaacctcggcctcctgggttcaagtgactctcttgcctcagcctctcaagtagctgggattataggcacgtgctaccacgcccagctaattttgtatttttagtaaagacagagttggtcaggctggtctcgaactctcaacctaaggtgacccgcacacctcgacctcccaaagtgctgggattacaggcgtgagccactgtgcccggccaggtactcttttttaaaaatcctccaatttagcccctttctttcttcagtctcttctattctccaaccatggatgctggctcccttcatgcctccaaaactttatgaaagcttatttcctctatctggagttattcccttcactttgttctttgtaaaagcttattatattagtcaatattctccaggaaaacagaagcaataggatgatctattgatgagttgatcgatctagaggttaatgtattataaagaattggctcaggattggctcatatgattatggaggctggtgagttccaagatctaagctggagaacaagagagctgatggcatagttccagtccaaatgccagcagcctttagatccaggaagagctgatgttttagttagagttcaaaggcaggaaaaaaatcagtgtctcagctcaatccttcaagccggaggagtcctttctactcaagtgttttgttctattcaggccttcaacttactgggtgaggaccatccacatcaaggagggctgtccgctttaccgggtctacggattcaaatgctaatgtcatccagaaacaccctcacagggacacccagaataatatttagccaaatgtcttggcacagtcaagttgacacataaaattaaccctcactcttactcgcgctttaagactaccctcaaacgaattctacaggaaagcgtccaaatgtcgatactatgtagatttatgtgtttattttttttattctacgctgtacatttcttgagggagagaaatttttgtcacattcatctttcaatcactagacactagcctaggacctggcataaaacaggtatcaagtaaatatctcttaagtgaatgaatgaatggatgaataacagcatctgtagcaaatttaggagaaactgcacaagttagaaggtatcatgttttaatattctaaatttaaatatgactagtaagagggtgggttttaagactggtataagcaatcatgaagagtgatggtttgtgaaaaagtagaccgtgtaacagcagcaaaataaagttagtaagataattctgaaaacaaaagctattcacatgcatatttgagactacagatatgataaaattagcattcagtaggaactatttgaattttgttttagtctaagttatagtgagttgtttaatctgttagcatttaagtcgattagcatttaaaataaaaatggtattcttccaacttattctaccctaccttaaaacctgctccccagaattccacattattttacctgctccttctagtagcatccatatcttgaaataacacatttatacctctattccttactttattcacttagacattagttacttctaccccctagtagttgtgcaactatggataagttatctgattttgctgtgctgtaatttcatcttttgtaaaatggggaaaatagttttctatcccacaatattcttttaggattaaatgaattactgttcataaagtacttggtatgtaataagagtcatgtaagttttataatcatgagaacagtgataattattaatatcacaattatcagtgatagaaagttagctttcttatgcaacctcccaccatctcacttcttctcattctttctctataattgtatcaaaacttttcagtaaatcaacactgtttaccttatgctatgtttatgttatgttattgtggctctgtgaatgtgttctcaactgaagtcgataaatacactgttagggctacttttcaggcaacacaaactattccaattacttcaagcagaacctgagaaagagaattggaggcttacattatgatcctcgagccaacagtgggatttggcagcttcctatctgcggatgaggcagcagctatcctaagaggtctacctgagcctagagagaggcagctgcgttataggaggtgaggataggagagagttgtaccctgcaggggcctggtgaaggaagcctctgggaaccaggaagggagaagccccttcttcctcatgtgtccctccggcgccctctactgacaggggttagcatcaaggcatctggcaaaggacgcaatttacaaggcccagtgctattatcacagagcagagaaagaagggtaggtttggagcagagttaataactggaactcctgttacattcaaacttctaacatgctagtgtagttaaattccagacagtatgtaaaaggcttgggtatgtatggtgggccaggggagcaggtccattgttttcaaatatttgaaaaacagctgcctgagggagggaagacatcattagtatgtgtttctcagagggaccaagaccagggacagttatgggaaagcagatgttggcatcccatgagggttttggatgcttcactccaaatgtcaccattatcctgacactaagagtgatgaagctgaggctagggtgatcctcagtcattttgcggaagttcagctgggataggaggcagaagtgggtgattcccaaggtccattccaatctggagaagttatggacttttcagacatacctgtgttacctaaagtgagttgtgctgtatatatagaggtcagcctacccatttatttatgtatccatgtgttatccatatgcctgattatccatctctctacccatccatccatgtatctactcatccgcccatttatccatgtatccactcatccatctgtacacccacccactcacccatccaccatcatccattcagccatctgtccatccactcatctaaccattcatccatccatccacccatccacccactcacctgttcaaccaagcaaccatccatctacccacccattcagccaaccaaccgtctatccgtccatccaaccattcgtctatcttcttttgagttgctttaaaactcagtaaagttatttcactcaattaaactaatattatttggaacagtgtttattggttggcttccaaggactatatatgatattaatattggaattaatcaaggacatgacgtgcaaatgcattattttcatcagtttagatatgagaataattcttatttgctgcctttcatattccaggtgtccttttttctgaaaatttctcataatgtgccaaagaagataagagtaatgtgagcaaagttactgaataaaaccacatatgaccaaagcattgaaatgagaaaacagaacatgttttcatccccgtgattgcaagataattccatacgatcaagtttgaagtttcagaaatcttaaggaacagctctctaagcagaagagcttaaatgattatctgggtcttctatgactccccgtgttttatttccttagtccaagccttgtgtaagggttcacagtatgattttactattttgtagatgcatcttcttttctgacacatgggaattttaaagaattggagttgtgaaacagaaatgaaagcacaagaagcatttcctctgtacagcctctttattgttcattggtgaaataagtagcaaagagtccaattctctttctcaggttctgcttgaagtaattggaacagtcatagtaaaaagcaagagatggaactaggattcacacctgagtctgtgcccttcaccactatgcactggcatctcccaatggattaggaaatgtgtaagtacaaggagatgccatgagaaacttgcagtcggtcgactctgtcacttataagctgtgtgacacaaaacaggaaacctcagtacaatccatgaaaaaagcagggcccagagattaacatggattcctcaacatcacacagacaaagagttgcacatctagggttggaaatgacgcctcttgacccacaatctggaactcgtttgtttttaacctacttttttagttttgttccatagaaaatcattaattgctcatgaaaagtgaaatcgcactgctgaaaacctgtcctctggtactgggggtttaagttccttctgttgctccaacactggctggtgtttacacactggtgcctgggcaggcctctcgctccgtgtctgggcttcctggtggtcactgcagcggtcgttactgtgggggaaacaggcgacacatgtagggtgacctccgtggtggtggctactctgtttctttatagacaagttacctttctctaatcagcagtccacagcagtggctccctgactgtgcctcctggagcagctgtttggggctcagtggccgagcacatggtcgcagtaagtgcacgccacccagcgagagttggttaatcatatataatccacccaacagtgggctgccttgtaattgttacagggccctttcagtttcttgcaatttcctttgtctcagcagttttggttgcatcctgaaaactgtcaggctttcttgtttctgtaaggacctgacaattccggcctcacaatgcagcttaaattggaccagctgctgcctcaatggagcagtctgcccatctccaaggcattaagcccaaaattatttcgaaaattgaagcctttgacttgctctggattaatgtgattaagcagggcttgctttaatttgtagccatctcgtcctttattaataacatctcatcatttggagcagcatgcgtgtctgcaagacaacagaaagttaggttgattgcagtttctaagagaagtctttaatgtttcaggagcaactgatatgcagcttcaattgtgggggcagatttagatctgcttgttattcttaattttttatgtaaaactaataagcaaatgaatcctccttccctcctccactttgaccccacctccccgaggtctacatatgatttatcgttccctttaagtaataaagaaaggatctttttttcatctgaattgtgtcagctggtgaaatctggaagaaatatccttcagggttaagaaaggtagaattaaatggatttgattttttttctctgtgtaattgaatgtgtattaccattaagataattataaataatctgttagcttttctaaataagaaagtatatacctcattacttgagacctagattttaataataacagcagtggattatagtggaaggaattaggacgtgttttaaaaatgtccttaataatttttaagctcaatgacattattcttataaaatttatcctggcaaacttaagacagtaataatctaagtctcgtatctttttctccttacaataatttagctaatgaaagtacatgtccaggtatttttctgaggttaaatctgatcttccttctttattatcagagccaaagaacacagctctaggagtcagtaaccctggagctactccactttctctcaccaaagcgctgtgttttcttgggaaggtcactcaccctgtttatgcctctttccatatttctaagattaggaaattgaggaggaaactttctaaaatcccttctagttctattctgtatttccaacttctgatgtttcctacccccatttacaaagtgtgtttcactgggtctggttccaatacagtcgtcttgctttttctctgtatggagtaggtagtataagtggcaaaatgtactgatatttgggtcaaatcagattatttctggaagtcaaagagcctcaaataacccaatgtcattgtatatacttaattgcttatcatctttcttaaaaataaatggctatctaatttacggttctttggctacttattagcttataattttttgtattcagatctctttataataagtatgggaggtaatgcatatgctcattagcttgatttagcccttcaacaatgtatacatatttgaaaagttcatgttgtatatcataaatatatacaatttttatttatcaataaaaacaaattaagaaaaacaactctttacataggcaataaaaatacctatgaaggaattgtaggagtagtacctgttattacagcaggggcaagttgtaaacctctttccattttttcccttcattttgcccaatattttgatatctcctgtaatgtcgatgctcgctgtcttgttaaacactttattatcacttgaggcatttatttatttattctacagatatcattttcagaaatgatttgtggtggttcttctggactgagaagagcctgggtttcacagctgggtacagcaggggtggggttgccacttggtctgagtagaaggaattctggagtaccttcgggtctctgtctgggccatctgctgcataaatccctttacaacacaagaggcagcatacttgctcttgacctggttctgtcactgtggaattggaccacctgccatcacaagtagatccagcaaatgtaccgtggctcgcacatgcacaggttgacttcttgttcatgtaacaaccaaaaacacacttcggtgggtggctttcctcacgtggcaattcagggggccatacagctttccttctgtggctctgctatctcccataaccccattgaaatctacatccagcccatcagatggacggagagcacatggagtgggcacacctatggcctgtaggccttggctcagctatggtgcacctcacgtctgctcacattcttgggagacctcacctgcatggccacactaactgtgagagaacctaggaaatggaatttttagagatgagagatagagctctacctccctgtggtgacatggtaactcctagaagaaagggcagaaatggttagtatttgtgagtacagccctttactgaacttcagaagttttagacagtcttttaaagttgatttcaaaggacctgggcatctctacattcccgtcagactaatttgacttgtggcttggtctttcaaagatttttggagctgtaagtcttactggcaccatgtaggtggtagtcaggacagttctgctagtctcattgagcatgcctagtaactggaatagatttttgccttacagtagaattgaaaaaaaattgccccgtgatggttatttttacaaaggtcatttaggtcattgattatctgggcatcatgcagttgttttcttgttgtttcctaccataatttttaccaggctctgctactaaatggctgcatgatcttgcgtatctgctggagcctctgtctcttcattagtaaaagtagggaatgtaattcttaccttgttgggtggggtgatgattaaagcgtgcattgcgtgtcttccatgtagccactcagcataactttgttaaggaaattaattaatacagagtagctgactctccagacatatgtaatgggtgaaaatagggtggagtttggacattgattttagaaacacattctcagagttttaagaaatcagcaatatcaaagctaattccctttgacaactcaactttgtctaagagataacaactccctttggcatctcatctttggggcagcgttttctgatcctacaagtttgagtttgattgtcatcctcccaccctaccccccacacgccttctctgtatgactggtttacgtctctgactctcccgttatatcaaaaacttttttccccatatgcatccccacccctcgcaaggttgaaatgcacaaaattgccatttaagtagttaaaaaatggttgagtattaacagtttcatttggttgaagctaatacctagaaggcacaagatattttgtgagctattgagcaacgtctgacacctgaatgtagcgtccatgctgctcttcttttgagtcctgtgctatgtttagcatccattatgccatcactgacttcatataggccatgaatatgtatatatgtatgatgtaatcctgagtgtgcttctggagctatttcaaatatctatgactcagtgtgcattaaatgtggcaaatctgtttcttggatattctgttgaatttacctctaaagacaactaggcctgatattttccttttggaaaacatgtttttaacttacaatccattttctaaaatagttattaaagatagtgcagccttgctttttcttctttctgggcgaactttgggaagttatatttttctaagaaatttttgacgtgaagtttttgcagtgtttttcttatctttttaggctttactgaatctgtagttatggcccccttttatttgtgatataatttatttgtgctttctttttttttctgatcaatttttttgccttcgtgaacctttctataaagtgttctatgcttcattaacttttgcccccctcttttagttccatccttcaaataccttcgtatagttgtcattctctttttaacttattttgttgatattttttactttttgctcctttctaataattaattcaattcaagttataaatttctattgctgtatcccaatcgttttgatagtagcagctccattataattcattttaaagattttaacattgtaattgtgatttttcctgtttgagttatttaaagttacctttttgatagtgatgtctaatagtcttaagctagacaacttaaaaaatatttgtaaccctcatacactgctggtatgaagggaaaatcgtgtagtcactttggaaaccagtgtggcagttccttaaaaggttaaacatagggttagtctatgactcagcaattctactcttaggtatatacccaagagtcatgacaacctgtgtccatacaaaagcctgtacacaaatatttatagcagcattatttgactattcataatagccataaagtggaaacaacccaaacgcgcatcagcgtgtgaatgggtaaataaaataaggtatacacgtacaacagcgtgaactactaatgcacacaacaacatggtcgatattgaaaatgtgctacatgaaagaatccactcgcaaaaaaccatagagtgtatgattctatttatttgaaacgtccagaatagggaaagctgtagagacagaaataagacacattagtcattagcttggacgggggagatggtgggtttgggaatgatagctaaagtgtatggagtctctttttggagtgataaaaatgttttaaaattgattgtggtaatgattacccaactgtgaatatactaaaaaccactgagttatatttaaataggtggattgtatagtatgtgaatttcatctcagtaaagctggttgttaccagagaaaaaagcattttctaccaaaatcaccaataaattatgatagctctaaactacttactttaaatttgtttgtgctgattcttactctctctcacctctccctctctgccattctcctggacttctccccatcgttggaaatgtcgaataacaaagtttggattatttatcaaaaaggattgatttaatgaaaatgaatggagaaggctgacatgaacataattttccagttcccaccctcataggtaatcatctataaacccactgggatggcacagccttgacaatgcggcggtgcttactaacaagcacacccgacctagacagtatgattttgcaaaagcagaatcctgaaacaatgcaagtgcagtgaacataggagccagtacaccgcatataacacaacttagaaaaatgctatcgataagaaatggtctttcagagacgatttccggcatgtgctacaggggaaaatggtatcaaatctacacaatgaccgggttctatggagtggctcctctgtggggaattttactttattctctttgccagaaaccttgaccccaccctgtctgtgaagtagcagcctgctttgtaaaggggcgctgatcaagacgaaggctattatcgagctgggatccaaacatctgaagcttatcaccaagcacaatagtgacggcttcttagccacgtttctaattatatttttttccctgctttttagataaagggacaaagaaatacggggcttactttgcaggtttttcaggctgctctgaagtgttctttcgaaggtggagggttatagttttgtgtaatagcagtgctgggaacagggtgggttcttccagactctccccccacgtacaatagtgtgtggatggcagagatgcattgggagctgaaataattcatttgtcctttctaatgaatagtaataatttataatttgtactaatcaaaaacctttcatccacaaaagccaacaagttttataaacattctcctctcaccagcctctacagtaagtgcctgacaaaggtaggatcgtccataatttgcagaagggccaagatagagaacacagtgcagaaatcattactaatttatctgcagcttggaatttatatttggaaagtcactttgaacttattttcatcaagctgttttgattgcccagaaatataatttatactgacctccataatggatatctgccaagatgaaagctacaaaagtcattgatccagatgttttctgttatctgcaaacctagcaaagccatatttgccagcatagtcgacattgtggggacaggtgtccattctgtgtccccttggtgtccagccctattatctctgtagcctccggtgacagagcagccatagtggcactgtgcttgatgcaaagataccattaccttctcgtctgttctctgatcagtgagtggtggcgatatgagctgagcataaagcaggaagagtggggatgcccttgtattcagtatacctccagaccttatcactaccaagtgtccaacacagggctgctaagtaatcttgaaaatataccttccactcttatcagtgcaccttcttgacaccaaatctgtattcttgatcctggaattcagaattctccatcaaaaacattgaaaagcaggttacttcatcagctctcctctatatactgtgttgaggaaaagatttgcatgtaattagcctccttccacctccctccagaaaaaccccccaaatttagagaccagtcctaacccttagaaaatgcatagtgttgcagactgcttttgaagattaaagagatgaaaattccattcttaacttcaagagcttccttaaacctggtccaaaagactttcctaaaagcccagccagttcagatgataggtgcagacacatcatattgcatatattcacattacacacacacacacacacacacacacacacacactctcacccttctctttgctggggaaaggtttgttgcagaagttaccattccaatacaccatgcaagatgcattcagacgttctcttagatttcagtatcacacggtggatcctgcattttgtcatataaaaattgcacatcatttttagctgccttcagaaccctcttcatatttattaggagtattgtgctcctatccagcagctaaagctgcttcgtgttgtccagttagggtgaactatagaagaaatgtcctatctactgcttttcttttttaaaaaaatttttatttccttaagttttgggggaacaggtggtatttggttacatgagtgcattctttagtggtgatttgtgagattttgttgcacccatcacccaagcactatacactgaaccgaatttgtagtattttatctctcacccccttcctcctctttccccctgagtccccaaaagtccattttgtcattcttatgcctttgcatcctcatagcttagctcccacttatgagtgagaacatacaatgtttttttttccattcctgagttactccacttagaataagtctccagtctcatccaggttgctgtgaatgccattaattgattccttttttggttgagtagtattctatctcatatatatatatatatatatatatatatatatatacacatatacacacacacacacacacacacacatatatattacagtttctttatctactcattgattgatgggcatttggattggttctgcattttacaattgtgaattgtgctgctataaacatgcatgtgcaagtatcttttttgtattatgacttcttttcctcttggtagatagccagtagtgggattgctggatcaaatggtagttctacttttagtttgttaaggaatctccacactgttttccatagtggttgtactagtttacattcctgccactgcttttctgcttttcttgagggataattggttaattaggaaaactgactgaagagagaatgaatcattattattattacttttttttgagacagagttttactcttgttcccgggatggagtgcaatggcacaatctcggctcactgcaacctccacctcccaggttcaagcaattctcctgcctcagcctcccgaatagctgggactataggcgcccgccaccacacccggctaatttttttttggatttttactagatactggggtttcaccatgttagccaggctggactcaaactcctcacctcaagtgaaccacttgccttggcctcccaaagtgctgggattacaggcatgagccaacatgcccggcacggaatgaatcattttttgaaaaggtttacagaaacctttaaaaaagaaaacttaaataaatgtacgttattgtgccaaacattggattcatgtccattatctctcctttgacctagagtcccctccctacttggagtggctcctcatcttccttctttagcacagtgtggaggtaggagtgaagattctggagctacattatggaggtctgggttctgactccgcccctcagtggtggtgtgatggtggctgtgccatgtaacctctctgtgcctaactgtcctcatctgtaaaatggatataatgaaaatagctcttattggcttgatgggagaattagttgagttagtatatgtaaaccacttatagttgtgcctcatccagaacaagcactgtttgccactattattatcaaatgatctctagttttgcatcttcaaaatctagtgagaatttaaagacattcgtgtagcaacttgaacaaagaatttatctagattttcatgacttcctccccaatctttttttctttaaaaaaaaaaaaaagctggaaaaatacacataacataaaaattactaacagccatttttaagtgtattgttcagcagtatggagcccattcccttcgtcgtgcagtcatcaccaccatccactcctcgagctctcttcatcttgtaaaaccaaaactctgtgaccattcaccaccaattctgcatccgccttctccgagcccttgacagccacccttcccaatcttacggagtagtcttgcctgcatttaatttgacagtatttttaacaactttcttttattaagctttctaaagcatttcccttattttttattttttggttttgttattttcatttgacacctaaaaatggtacctatttatggagtacagggtgatgtttccatacatgtatacaatgtgtaatgatcaaatcagagtaattagcatatccatcacctcagacgtttatcatttctttgtgttgggaaccttcaaaagctgctcttctagctgtctgaaaatatacaataaatgattgttaattatagtcagtctgtagggttctggaatactggaacttattccccccatctcaatgtattttgtacctgttaaccagtctctccctatatccccttccccccgctccttccccgcctctggtaaccactctactctctacttctataagatcaactttttcagcttccacgtatgagagagaacatgcggtatttatcttcctatgcctggattgtttcagttcataaaatgtcatctaagcttatctatgttatcttaaatgacagttttgttctttttttaaaacaaaattaaatattaattttaatagaaacaaagctgtatttcttcttctgcttttatttctgtatgtgtgacatttaattaaaatttctaattagaagataaagtgcaattggcctaaaccagtttgggaacagtcacaactaattgggtaagggtacccctcagctggagggagcttcttggtgcaggcatgtcagagggagctatggggttctgatactgtgggcactgggcaccgtgtctgccagcaggaatggtgtggcttatttaatctaagccatcctgtccattctaggatcttcttcctgtgttacggtgctcgtcattttcaacatctgaagcactcttacctctacctgtgtgtgtctaagtagttcccgtttttcaacattgatatggtttgactgtatccccacccagatctcatcttgaattcccatgtgttgtgggagggacctggtgggaggtaattgaatcatgggggcaggtctttctggtgctgttctcatgatagtgaataagtctcacgagatctcatggttataaaaaggggagtttccctgcacaagcactcctctctttgcctgctgccgccgccatccatgtaagatgtgacttgctcctccttgcctcccactgtgattttgaggcttccccagccatgtggaactgtaagtaggataaacctctttattttgtaagttgcccagtcttgggtatgtctttaccagcagcatgaaaacagactaatacaaacatccagttagatatactgtctccattaaaccaaagcacttgtctgtgcccctcccatggcacctaacactttctatcctgtgttttcagtgtttgggtgagttctccaagagcaggctcagtgtatcacatgtctttggatgtctcctatcattggcttcaagccaagattgaaggctcacatgtattgaattcctggcctgtccggctgggacagagagaatgagtagagaaactaagtatcagcacactttatagttaaagcctgtgtgtacgcacatgtgtgtgcacacacgtgtataatgtaatctttatagcgtacctttttggcgtttttattataactgctgtgctgacaaggaagtcgagactcagagaggttaagcgattcgtccaaatcaaatattctagctacagtgccaatgcccttggcacagtttcccagcacttcattgttgaaacgtttggtgtgttcctgagggcatgtcttggggctcctacattaattactgaccatcatcagagatctactagtcaaggctaaaagattcccaatatcaatcaaattacagccgagtctgcatctatacgaagtcattggtagcaataatttagtagttaccattagctccaatgtttatggggagaaagcatgaaattatggaatcaaacctactgggccctgaatgacctgaattaagcaaataatttggcctcattgaggcttagttttctcatctttgaaatgtaaaacagacatcataatacatggagttcccatgaagatttaatacgcaattaatgcatatgaaagcatttcatgagctacaaaagtgttacaccaatctaaggtatcatcatcatcccacgcttacagagtaaccaggaatctcaagtcaggaaaagtccagtgcagagttcggaataacacagaacaagctacctaagtccagaagtggggcctctggtgtttgttactgagagaacccctttgagacacacaccgttctcatgcgttggacttactattagtgtcttggtctggtgaatttttgctcagggctttgtttccctcataagttaaaataacgacaggcaaaggcacgtagtctagctgaatgctctccatttttgtttcagacctggatatcctacaggtgtgaagttgccaagaataagggagacccaggggtcaaggggaccatggtagagcattagagtcaccctttcctctgtaaagttgtccctgcgttctcaagctgtgtcactgaactttgagaatacccttctccagcagtaattggttcatcctggagttgccatttggttgtttttttgccctcctagactgtgagctctttgaggtcgggacctgtcttaatcctgttttggctgcatcccagagagtgctcagagctcatgctagggtttagtaaataattagtgaatgaatccctcctgtggttgtgatgttggattacgagccccatacaaaagtgaaaatgaggctggaattatagttggtttggtcaccattttgattgtactgatatttgattgaatcagactactgtttttcaggctttaaaaaaattatagtcgccctaagcggcctttttagacatttctctcttgtctcccccagtccccttccattaaatttaataccacagatatactatataccactagttactgtggccctttagaagccgtagccattttcatatgtaagatatttttgtcccccaagaactgatttttgcccccttgaagtgacaccacccttattgagaaatcataatttatagaatcaggtggtttggtgctgtgcagatattctaaagagttcctatttgatatgtacatagtcgattataaagttcttaagcctcagttgcttgttgtgttggcatgcttttaagataaagctgttggactgattttttttggggggctgtggtgtaaaataactgatgcttttggcactgtctaggaggcaaggccaagactttcctcagaccagcaacagtgtttcagtgtgggtctgagttataaacaaatctgaagttcttagttccattttttaaaaaaaatttagactaaaaatgtacttacatttattattaatagtttagttagagccatgcttcctgagcaatcctgccacatccttcctatgtgagctatttgtaaataatgtactatccaagttgggagaatatgttaccaccatatacacttaaaaagcaactataatgtggctaatgtgcagaatgaataggcaattttcattgtctttggatgacgtgaagtagctctctggcaaaaatggtgcaagcagccacggtgtttgaagtggtgagcttcaataggagtgccatttctttttttttttccttttttctttttgaattattttactttatcttatttttttgaaatggagtctcgctctgtcgccaggctggagtgcagtggcatgatctcggctcactgcaacctctgcctcccaggttcaagccattctcctgcctcagtctctggagtagctgggtttacaggtgcccgccaccatgcctggctaatttttgtatttttagtagagacggatttcaccatgttggccaggatggtcttgatatcttgacctcataatctgtccacctcggtctcccagagtgctgggattacaggcatgagccactgcacccagccttctttttaatttttgtgtgtacatagtaggtacatttatggggtatacgagatgataggcatattatcttgtgtatcaagatagtgggtatatatatttatggggtacatgagctgttttgatacaggatgcagtgtgtaggaatcacatcatggagaatggggtctgcatcccctcgagcatttatcctttgtgttacagacaatccatttattttcttttagttattttgaaatgtacagttaaattattgactatagtcaccctgttgtgctatcaaatggtatggagtgccttttctcatccatcgcatggagagtttagaacagtttttgaagaatatgaaaacatattggacttgatttcaaagaccccttctattatcatgctcgtagggcctctctagttgtcttttaactctgaggtggaacacagacacttttaggaaaacgtacgcttgacaacttacccagagaaacctgtctttgcttggagagccgtccatgttgttctgtttgtactaacatagatcctaaacatttgaagtcttctggcatctcattgtgaagttctgcgatgccatggttgatcattattagtatatggagttataagatttgattaccactggtaagttcccaaagtgctttgtgctttcccctttatgtctgttattgctcttaaccatcttctaagattgataggacagatattagtatgcccattttatagatgagcagcctgtggctaagagaagttaagtggcctctctagcagattatgccctcaaatgtagaaaaactcaatgtggttcttcagactccaaagtcagtgccatttacttgcccgtagtaaatgccttcagccttcttaaaagccatcgtggaggagtgagcaggtcccaagaagcactgcctggactgtgagtaggaggaggcagaagttgacttaataaaggcatggatttctagcaattaggacatcccaatagtggcatgaactactttgagaattagagagtgccctgtcttgaaatggtcatctggaggttggagtgggctaaactatatagtatgccatttggctagatgacctttcaggtcccttacaattctgagactttgttgaaaaaaaaaaatgttctgtccatttcctcctttgtggtttagccacatacatcagatgcccaagttcgtggttcctttcccagctttgcatcagaagcacccatggggctttgtgagaatgcatatgccaggcctgcccccagctctcctgtatcggaattccattggtggggtggagggggaggcgtgagagtatgtttcagagttccacaaggatttctaagttgttaaattgtgaaccactcttcttgtgtagcccactgacaacaaggcacacacagacctctttttaaacttggtggtataattcagtagcatcaaggaatcatagtttctcagtgtgcaatacccttgttaatattaaaaggccatttaataaactgcattggttctcttggctgcagggataccatggtccctgcttgacagattggttttgcccatatcttatcatccctgcctgtttcgcagcagagtgggagtttggtgccagtctagaaaatgggcacaggtccttttgtacccttcttattctggaaaatccagctcaaagggttagcattgggtgcgaaggccagcctctgaaatcagcaggttggatacagaaactagggagtggctcactgctatcctagttacctacttctacgtactggttttctttgtaccagttagaaacctccagtgcacaaagaattaacggttgccattgactgctttcttgaagacttttcttgatccagtactgagctgtgtttatggcactcctctgagagcataatctctgaaggatatgtctgtataaaatatacagcagaggatcataaattctccatcgtgtctccccatggcgggccaacaacaacaaaaaattcacaattgctccaccagtattttttttctacttttcaatcaataggatgctttttaaagcttatgtttctcgtcggacactttaagtgacgaatgagacaaaagaaaaaaaaaagccaagataaaatgacagtatagacactcctcaaatcctataatgaactccacagggcatccaattttgatgtattaggattttttttttataatgagtacattgttggaaatcacattttctatccgcaggagctggagatgaaaccgagctgacatcttacctctttgtagttaattagcaagagaaaagtagtgttttgaatctcgtgtgggaaaaggggaggtattattcacccaccctcgcccctttctcccttcaaacacctggatcattctgtgtgctctttgatttggtttaacggtttggataagtctggctggcagggaaaggatgagggaggttgaagaatggttattatttaatgaaaaaaaattactgtgtctccctctcccctccatcttgcttataggataaataaactaagtcaagtctttttattttaaagatcagtttcttacctggactcggactctaggcagttcccgtggcacaagggttgtttgttgtcaccatcgttacattagtcaccgtggaatcctcagtgctcagcaccgtgcatggagcttagcaggcatttgatcagtatttattaatgaataaataaaatggtgctggcccatacagtaaagtattctagtcgcattagctgtgtctaatacctttctctgcatagtagccacatccactttaggatttgtagtgaggtttccgtagaattcagtggttagggacagagggttggagtccagtgtgcatgtgggattccatctagggactggtcattggcaggtgaatggagctggggtccatacagatgccccgtccggatgaaggataagtgagtggtgggcagatgcagcacgagggctcctccggcccgtacgtctttattaacatcacatcacatgcccagtcctggggcctacagaggagagccactgtcactaagcacatacttgtaagcactgagcactcacaggttgcaccgcatgggactgatcccaagtagaataagatggggcggcagggccgggtgtggaaggaaacaccactttttgcatctcctctccctgcccttgctgaactctgcctgctccctccaccgtcggtcctcttcacagccacccgctgggggaccccaggggaggtgactcagtggaggagccctgctctgacaaagtcagtcccacagaatcgcagtggccgggctctctccctgcacagcgcctcttcctggggtccccagctcagagaagcctcctggaggaagcaagactcgaggggaccctgaaagcaggcagggcttggactgtgggtagcctgggacactgtggactggggacagcaggacctggggtgaccctgagggcagagagggcttggtgggcgagccctacaggctggggacagcaggagccggtggtgggtgtgaggggttagcctggcctggggagggtgggggaaaccaggttgctgtcataccagtgatggagggccctagtggccagccaagggctcctgtaggccccagggaaggggacagagatgacaggtgtggagaagcagcaaggaggagggcttgttggcctctggctaggcttggggttgtctccgtccctcgtgagctctgagccttggctttcctctcagtaaaatggacataggagcatttaccccaatggccaagggtggctgcaatgctgacatgagtctatggatctagaggctttgcagggcacaggacactgtctgaaggcagagtctgaggttcctgtccctataggattgcatcaggggtgcgccatccctatgatgggccagctaagcagctcccatggtggccaggtgcgtgggtaagctcatgagccactttgtggctttgcaacaacaaagatgagctactgcttccatttggattcctgctcttgctttggatgccctccccgccccacaagtcatctgccgtgaccgcttcctccgtgtgcgtctgacgtcccggtatgcgtgtgactgctcaggcgtgactgcttagcgcccaccaatgctctcctccagacatctgcatctctgagcatcttagcctgggcctcagtccagcctcccccacttgatatttgaatgattttggacgagcactgtgttttggatagcactgtggtgactgttactagggaatcatctggacagcgaagaaaggtccgacgtgtctctggttccccaacctcttcctcagctgtactgcaggtctccgtaaagggttcctttcctgtttccttcctcccctcctgcttcctccccttccctctcctccctccctttccttccccttctcttcctccttgccctctggggctcctgtgagtctcctgatgactggggcagcaggtgctgggacacaggagagcacaggctgagagctggctactcagggatctgtggcgctctagaccagtggttcacaacctttccttaacactaagaatcatcttgggccaggcatggtggctcatgcctgtaatctcaacacttcgaaaggccgaggtgggaggatcacctgaggttaggagtttgagaccagcctggccaacatggcgaaaccccatctctactaaaaatacaaaaaccacccaggcatggtggcatgcacctataatctcagctacttaggaggctgaggcagaattgcttgaacctgggaggtggaggttccagtgaaccgagattgcaccactgcactccagcctgggcaagagagtgagactcctctatctctaaataaataaataaataatttttaaaaagaatcattttgggaaacttttagacatagattccctgaccaaggacattgggaaccaagtcacagtagcagtcaaatgatactagcaacgctgccatgaagaaaggtgataccggctgagttattctgcctgtgctgggccagactgctcaaatgcctcccgtggagttttgagctaatcatcaggacagtcccctgaggtgggtgctatcagtgtccccattttgcagttaaggaagttaaagcccatagaggaagaagctttgccaaagtcacacagctgctaagtgaccagggtggcaactcgggcactctggctcccaaaccgagttcttgagctctcctctccatgctcctttggtctgggtggtgcccagccatctgtctagataggtatcctgctgactgcaatgtggcagtctatggctggtagggacgtgggggaacagtgtgaccgacctccttgcacagggctgtcattgcactgcgggctacagcagagcccagttcacactggagggccacccactcagctgggctgttttctgaggaaccagttgtttgtcctcccctaaccttctccacagcagcacagagtccaggaaccctgagcaccgggaccagggccggcttgggaggggtgggggcgggggctttgtgcacaggtcttgcctgtgggcctcatttctgtgtctctggtatgagaaaaacctggattgaatagaaagaccttccctgaaactgggaggttgctgagagaccaaagaatgacttggacaagtccagcttggcgatagatgagtttattaggacttacatagcaggcactcctgggcggcaggacagatctagagatccctgctgctcccgtctctaaactgcctttaagctaatttcctggctctttgcctactgtgtttgggcaatgagactgcttgtcttgctacgttctcagataagttccggggcattgggttctcagggacgcctgctcctcagctgggcaccatggcctcagctccacctgacttcaaggctcaagcagtggacacacacctttaaggaacctgctgggggaccgtcgcactgcgctgcctctctcatttcccatttcttgtccccacgaagcctctccggaaggcacaggctctgctctcgttcttactccttccttctcacacagggacctggggatctacacagaccacgtgggcctagactgctggcccagtgacccttggaggcccccttggtccttctagatgagccccacctgggaccccacgcaggccgagctgctcttggttctgacggctctgctcggcctccctcccaaatctcgtctacataagacctgcttccctgctggcgaagcaccaccatttctatggagaacttggggtgtcattctcaactccagtctgagttgccatcatgttccatgatgctggcagcgtgtcccagcctgtggtcacttggcaccccctggagaggtggacttgtactctggatctgcagcccaggcagcagtgggagcctctcctccagctcagccccggtgcctctgccctctcccaggtctcatggactctggtggacaaaggttcttgtcagaggaagtcgttgacagggtgccatgggaaacggcctctccagggaggcaagattccagcctcagctcttgctcctgtagcccctctttcggaggtgtctttctgcctggattaaacacttgctcattaaacctggcttaataagaaactagaaaagaaaaagaattagaaaaattctgattctagactgggtaatcgctttgagaaatgcgatttttcccttttgccacttcatcaaaagagtgagaatctgggcctttctagggtgtggatgaaggctgagctgcagtctccagcagaggaagctcagtgcccagaccagtagtacacacaactgagacttctagaatgaatgaagaatgaatgaatggataaattggagtgaggcacttacagagataaaattcagtttgataagaaggaggcgtccttaaatcttgtgttttctcctagagttgagtcctaatgggggcggcatccttgtacggaaacacgaaaggttaatagcaataacaatagaaacctcgtgtttgtgtatggagagccttacgcttcccaaatactttcccacagatgacctcatttaatctttgttttgtcacagagatattttattcccatctaaaaaagtaggacacccgggatcacagtcaaaaaggtattaaactctgtgttggaatgatggtttaagctacttcttgtgacttctattccaattttccccatgtcatcacggctgattagagaataattatgataatacaactgagaataatataagatgtagagacttaagtcccatgtgccaggcactaatcacccagtttgcaggtgaagaaactgtgcatagagtggttgggtagataaaggcccccccagcatgggtgtgggtcccgaggaaaggcatggctcatttgccagggagctgtggtgtggacctgctttgcctcctctcccagaccccgccaaggtcatgcacctgcccagcagcagagccaggaggccaaccctgacaatctgactcctcaccactacctgctggcatctcaccacagctcaccggctctctcttctgttcttatgtactgcgtgggccagttccctgctctcttgttcttgtcccagcagcccaacagtagcaaaatctaattatcctaacctggaagaatcaaaggtgacattttctccacggataggaagctgtgctggaggactgtaaacattggttgacttatctcggggttctctttaaaggcacctagttccatggatgacttagcttccatgtagctagatgaccccagaatgcctgattttcctggccccaggtcatgcttgtatgtctcttcttggattggatgcttcgtctaatccaaggaatggctgcctttaatcaacccctctccatttgttcatcttcctctggggctgtggggtaaggcagtggagggagatgcttagagaggacatcatccttttcattttttctttcaagatatttttgaacagcaacgttaaagcccccgtaatgctgctgtgaattgttaacaagcatgtttgcacgtcacatctatcatgctatgtgcgcgatgttatgtgaagacacggcttgaagtatttttaagatctggcctttcatctctggaagcacaagaaagtatttgcagattggtctctggaatgaaattagcctagcacgttggctggttcctgtaaagtgtgggcatttctgtaagtggttctgagtcccttaatccttttgatcatttgcactgtgtatttttacacaggttcttttactttggagaaataaagtaaagaaacttaaaggtgagtttggcaagggcatcactgtgctgtttgtcaaggcaaatgaatcttgaatttgaatggtagtagtttcttttaaacaaccaagcttctttaaacctctccacaaataacgtcagtggcagattatgtctgaaagtgtttgctggcgagtggaaatctttcctgaccccatattgctgtcatgaaagaagagcctaatcccataaaatattcttgacagcctcgtgtcagttaccacacagctgtgatttcttatctgggctacagcctgtgtgacatttgttgtcacttcatggcttcaggtttctccattcagaagctcaggtcatagtaggaggttgagcttcatccccggttgaaacctggttcgcgtatgactgaatcctcttacgtcctcactgttgtgtgaaaaaactcatagggagaccttgatttcctcatctgtttaatggggaccatatgtctctggcaaaatcgttgtgagcaatgtttgtatgtctgtgttcacagtagcattgtttgcagtggtaaaaaggtagaggcaacccacatgttcgttgatggatgaatggataaacaaacaaaatacacccaatggaatattattcagccctaaaaaggaagaaaattcagacacatgcaacaacatgggtgaaccttgaggacattacgccgagttaagtaagacagtcacaaaaagacaaatagtggattccacttataggaagtccctagagaagtaaaatccacagagacaagaaagtggaaagggggttgccagggcccagtgggagcgggcaaggggagttgatatttaatgggtacggaatatcagttttgcgagatgaaaagagttctggagccggatgattagtgatgattgcaaaacattgtgaatgtacttaatctgatggtaaattttatgttatgttcattttatcaaaataggaaaaaaatccatgagcattaaatggcatcaagtagataagtggctaccatatcattgttgttcactaaatcataaagtaacagctttgaccatgtgtgggatagtaaaatatgtggtattttaatggttctatgaaacttcatcttatgagtataccatgtttgtttccctttgtttggcttgtgtatttcttataagtattctaccattgtaataatgacagagtgaattttttgtgcatgtatatatcttttctattagttgaagttatacctttgagatggatttcctggatcacttaatcaaggtaaatgagcgtctttgtggctcttgctacatacacccgtggggtttcagaaaagatttagtgattttaccctgtcactagccaagtaagggcaccatttcattgtatcctcaacagcactaagatgcttctaagcaattttattaaatgtgataagagataatatgttagtgtttgaatatgcatttatttgctttcattttgatcactaaaaatgttggcattttgcatgtctcaatttacatgtatttcttcacataggaagaaatacatgtaaattgagaagaaatagcctgtttacgtcttttgcttatattttagtgtggtttcaatgtttttcatgccaaatatgtctgtcatgttgataacatattaccatttttaatattcagagatttttaatgcttatgtagttgaatcacttatttaaacatttcaaattacaaaataatatgttctactagagcaaaagtggttttacaatcacattattatacctactgtatctttttcccaaactctccactgtcattcttttcatatcttttagcataaaatctgtttagatgctaacttgaatgactatagtatttgaattaaaattatatggactagccaattaataataaaatattaatataataataacccagtataaaaggacatgccaattagagcaaagaagaaattaaaattgctaataaccatgaaatttgtgttttacttcactaataatataaattcatcctaaataaaacaatagaatcctatcttccagctatgaattgctaaggattaaaaatgttgtaatggtgactgagactggccctcaaaaacgctgccaatggaaagagaaaactgggtcaactttactgaaaagcagtttggagctaggcatcaagaaatttaaaaatgtttagaaacattgatttagaaattccatttatataactaaggcttgaggcagcttcagaagcatggaaaaatatttacatttatggataaaaatatatttcagtctaattgcccaatgacaaggaatgattgaataagtagttggacaaccatctgatggggagttatgtattcattataaatggtgttttctaaaagttttagtgacatggggaagtattcccaatatagtggtaagagagaaaagcatgctgtaatgaatgcagtggaagaaatttgtgtgtgtgtgtgtgtgtgtgtgtgtgtgcacgcgtgcatgcacacatctggtaggcacccaggaagagattgataaaatttattgatagtgcttatgtggcagtagtataggtgatttgtattttcttttttctttcttttttttttctttgagatggagtctcaccctgttgccaaggctggagtgcagtggtgcgatctcggcttactgcaacctccacctctcaggttcaagtgattctcctgcctcagcgtcccgagtagctgggattacagacacccaccaccacgcctggctaatttttgtctttttagtggagacggggttacaccatgttggccaggctggtcttgaactcctgacctcaagtgatccgcctgccttggcctcccaaagtgctgggattacaggcatccaccaccacacccagctaatttttttgttcagtagagatggggtttcaccagattggccaggctactcgaactcctgacctcaggtgatgcaccctcctcggcctctcaaagttctaggattacagtgaactgccgtgcccagcttgccaaattctttactacacataaggtgactgaaaacagatagataaaaaatttatatagcctagtgatcttagtatggagggatctcttatttgccatgctctaagactataaaagaaagaaggacatgaatttcacaggtacaagcagtactgcaaatacccacccctgatccaccaaacctccaggaccaccactgagaacaggcctacttacagaggatcctgcaagtagacatatgtcaccatcattgtttaccacagagaagaattaggctgggaaaacacttaccaccctgctgggtatttaaatctgacccttgtcccagtgttaacagcacagcacgtatgtccctccttaactcactgatctcatgtgaacgagtgatcagcctgttttttacaggtttctctccctggcaccatctcactgtggtgcagctgagctcactacatatagcatggagtgatgataaaaataaattggctctttccctttgcagagtttcagttcttgagcgctatgtcagggtggatccataaggtttcctgagtgagcttagaaacctgaaaacccacgtttgttttttcatgaacttaaaacaatttattagagcacaatgtagaagtcatcgcagcaagctccctggaagagaactgtatgcttttatggaaaaagaaccagtaacagagccttgagagagactcttagctaaagtctaatcctccttccattcttccttcacagggtagagtttcagcttttgtctgttgttttttttgtgaacaaaaaacttgcaataaatggatgttgtcagtaaatttcggttgtacgttttgttttttccaagaaaaaactggccatgcagaagtcgtccgagtggtgtaccagccagaacacatgagttttgaggaactgctcaaggtcttctgggagaatcacgacccgacccaaggtagagtgatgagtgagccagtatttaattatcttactaattacagctgggataattagtgtttgagctgcatggaagagatgaaccttgaaatcacacaggagctcaagaatatgattgcagacatttattgacggaggagaggaggggctggggagaaaaagggtgagagaataaaggcacagccacattcggcgcccctgccccccttacagctgtcaggggtgggaaaattcccacagaggaagacgccagacaatagcgatccgttcacctttgattattgcattattcctccttaatgcagtcttttgtctacaaaattaaagtgtctttccagcagctccaaagattcctgatttatggtttctttatttctctgagtttagcctttctcgtcttttgacgttatcaggttggatttttttaaaaaaatgtatgtggtgataaagaagaacataaaggtaaaatgcagtattcactaggtccacaaagcttgctcatttaaatatttcatttgttctctttggaatttgttatgtggagatattaatatatttgggctataaacaatggtggttggaaattttatttgaatgcatacacaagtgaaatattccatgttggcaaatatcattgtaatattcaataatgaagcaatttcaagattgcatcccagcagccttgcaggccctgctttgccagtgtgatgatctgatattatgcagcttatgaactgaaaagtcctatgcaatagatgtggtttttcacaaaccctcttcatttggcagtcagtctatttcaccaaagtattttctctttggtgtcagatttttgtgtagtggatatgcagtgttatttcttgatgagtgaagtttttctccaaatgtaaattgtgcttcatggtggaatcttcatatgcctgtagcagcacaggttggtgggtcctgagtgctggttctaagaaccatcccattctagggctttttgccagagggcaaaggtcagagatgaggcaagagcagcaaagtgacaaactcgagcagggtgaggcaggttcaggatccacgcagatctatcagggcagatgggggcctagaggtctgggcctaggaaggaggccgggggcacgatttccatgaccacaaagtctggtttgacatgggggaatgggtacctggtggaagagggatgaggtatggggcagggtagggaaagaaccggtaggacaagaacactctaatcagaaggttcacgtgtcaccctagcttgggatatgggacatcacttcatgtgggaaggcaggtctgtgggcctagattgctttggttctgcaggaagctctgcagtgaggatcataaatcagggtggtgacagccagtcgctccttctggtaagtcatcaatccagatggagcagacgttcagccatttgactgtcaaagtcaagggtcagaggaagatgataagagctccaaaattatcagtgaagacatgtatcagaggcccaggcaaggcctgaaggcatgtaggtgacaggtcgggtctgtgtcctttaatgtggccaactgcaatgccacgtcctgatagaatctccttaggcttaggcctggcagaattgtaaagaaggccaagtctgtcgtcaacttctctctccataccgctcttaaatgctttcatttgatcacatcttcattgattaattgggttgctaataccggcccctgaacctcggggggaatactactatgatgagggtttgggctgggagaactcacctctctgttcatcatttggccttctatgggctctgtgtttgtaatggtggcgtctctggggttaaaaaagattttccagatcttcacatcataggtggtaatatggagaccaaaacaaggcaagggcatggctaaggttgtagcgtgatccagtctccccagctgaattcagagaaccactcatcaacaccagggcaaccctgactgccccaggacccctccaatctgtggtccccacccttctgcctctcttatggaccatctctttccataggtcagtggcctccccacaggtgaggaagaggtaaggaagggcaggggatgatggttagttaagggtagggcgagagatcctccgtcaggaacctctactcagctggctttgtttttcttaagctagttttttagtttctattacatgtaacagtaacaaaaatccttactaatccacccattcaatccaaacaatcttatgcccattatatttgccaggtgcccttttattttttgtttttgttttttattttattatttttttgagactgagtcttaatcctttgctcaagctggagtgcagtggcgtgatcgcgtctcactgaaccctccacctcccaggtgcaagcagttcccctgcctcagcctcctgagtagctgggattacaggtgcatgccaccatacctggctaatttttcatgtttataatagagttggggtttcaccatgttggccaggctggtcttgaacttatgacctcaagtgatccaccctccttggcctcccaaagtgctgggattgcaggcgtgagccactgcgcctagccaccaggtgtactaaatcactaaggcatctgggatacgcacgagtatccggcctcttggttaatgcacatggaaaatatattcctacaggaagaaaataattaattccaatatgctgagatcaagtgagcatacagataaatgcgcataagaccacaggctaaatgttaacatgaaatcattaaaacaagtatgtgttagcacttgaacattaaaggcaaaaaacaaacaataaccaacccttaagttcagaataactctggtatcaatggagttgatattcctggggaaccctgaaggtccaaaaacagtgacacatgtcaagtgtcatttttccaaggtcagaatttgaagcctgctcctcgaaggatggaccagaggcaggggagagccaggctacaaatgaacttggctatcactcactcaccacatctgaccacagctgcctaaatctctacttgaggtcacatggcaacctgtcacgtttcacagtaaaagttggtcttgaaaagaaagccgccactagagaagatgagggtggtgaagatatgtaagactgactgttcttactcagaaaatggacattttgaaagagagcagcaggttggatttggtggtgattctgatctgtgaggccgtagtccactccaggttcttttcagaaacaaaagtgattactaaaactactcgagcaatgctcttgcctgtgccagaattgcttatcaacaaaaagacaaaacttgtgtagaagttgaaaagtcattgacatttgatgtgaagatgcgcccaggaaacatgatttccacagaaatgtgactcaagagaaatgtattttaattagcatgttgaaagattttagtacctttttgtaaagtcattaaggacttgaaggggccttaaatttttttggttataattcactgcattttataggagaagcagtatctacagtgatatttgcaaatgtggagattcttgctgatgtcaatggtcttactgtagtagaaacagcaagaatgtaagcttagagtcccctttcagttaaatcagatcttcatggcataggctaaacagagaacattcagcatgttctttcctgcttcaaggtgctgaagcagctctcatagtatctgccctaatggacatctagatgaagtccccatgtgttttcttcctttttttttttttttttttttccggatggagtcttgctctgttgcctaggctggagtaccgtggtgcgatcttggctcactgcatcctctgcttcacaggttcaagtgattctcctgcctcagcctcctgagtagcttggattacaggcatccgccaccacacccagctaatttttgtatttttcatagagatggggtttcaccatgttggtcagcctggtctcaaactcctgacctcatgattcgcccacctcggcctccccaagtgctgggattacaggccacaaggcatgaaccactgtgcctagccttctgccattttggagggagcaaagctggtaagtgagagattggaaggtgtaggctttttaaggtataggtgaggcccgagacctgttattccacagccactagacagtgagtctgaagaggatgccactccacggattagcctaaggaggaatgacagacatgctagcatcattactcatgtggtcagtaagtggaatagtcttttcttttaatttaccaattaccacagaacctctacttttgctgaaacatttgaatcccactgtttaagccaataggttctattctggccttctttcttactcatgggatgaagatagttcctttaggcttctgaggatagactggcaggtgtacattcctggccatggggtacccagactcccactgtctccaggcaacgtggtgggtgcctgagatttaggagttttgagttctggtccctggttggccccttcccaaccacatgattttggccaggacacttacccaacctgaacctccatttttctcatctacagaaaaagggataataatgtctatactgccgacttaatggtctgatgtaggaattaaataaaatagtgtgaaaataacatgaaaatggtataggtgccatgccagtgccaggtattgttgttacgtctttttcaacacaacaatacaattccatcagattttaattttacatttattcttacatctgtgttgcccttgattctttgtctgggtaagtatttaccctccatctactaaagtgtgggttttctacccaccgagattcttgtgtctcttgcattggttggaaagagttcagcattgtttatgttgtcttctgggaccttgctggtgctgacagtggtgatgaggctggtggatccttgctcaaaagcctccttaaggcttcttctcacagagtaatctaaagaactggatcaggttcccagcatttcatggctggtctgtatcctcctaactagaatgacctgtgcatgaataacacaattcagacctcctagtcctgcgtaggactcggggcacagactgagtgcctcgagccaagccacaggtacaccaggcagagggtcttcagttttgtgtgacttcacccactaaatctgatttctcagttgcaacccatcttgctgtcctcagtcctggagcaagggagagcaatatttactaagcacctcttaggggccagtcttagcgatagatgtttcataatcctaattgcatttaaatctgaccataaccctgtgaagtaaggatcattgtctttgcttagcagaagaggagcaatgaggttccaaaagactcataatcttgcttaatgttagtggcggtatttggatgcagctctgtctaaagctcaggtctattttcttttccatacactagaggaatccaagcttcctgactaggaagacctcttctaaggatgcacattttttttttttttttgagacatggtcttgctctgtcacctaggctggagtgcagtggcacaattggcttactgcaacttctgcctcccaagctcaagacatcctcccacctcagcctcctgagtagctaggatgacaggtgcacgccaccatgcccaacttattttttgtatttttggtagagatggatttcgccatgttgctcaggctggtctggaactcctgggctcaagcaatccacctgcctcagccttccaaagttctgggatgacagaggtggccactgcgcccagctggggtgcacatttttatggatcctccagtgataacaattgggcttttagtacatttaaaaaagcaaatatattaaaatgctaccatggatttaattatactttaaattgcatgcctatcatattcaccacttccacatcatgtacttctggaaaagggaactattgtacacataatgcattctccaggctctagatcttgcctgctgcacagttggatgcgtggagcttttgtggcaactccaagccttcccagaggactgtggtctggaaactgctccggtatactccttggggagcagtggcctttgcagaggcctctggctgagagtgctggttgaccccaatattagggttcccccacctgtgtagtttaagaattttagctggtgtgcagccacccataaagacaaaatccctgagacaccttagagctaagtatggccacatgtctaaattctgactatgggggccttagtagaagtgacagcgtgcagcttctgggtttgtggccttagaggaaggggcattctcttccacttcctcccttcccacaagttagtgtggggctgaagtggtggaccatcacgaagcccagggatggagcctgacccttgtgctgctagagctgtgagactaaggagccagagtcaccatcccaggctggatctttaggcaagaactcttgtttaaagtactgctattgtggttcattgaagccttcttattctcattttctacagcagctgaacctatgtcttgactaacacagccttcaactataagctggtgatgaactcccagttacccttctgaaagccttaattgcagtgttcccttaattaaaacgtctttaatcaaacctgttgttaagagtgtggaccctggggtcagagatgtcatggctgtgaaccagatcggcccggcactcgctgtgcggacaggcctcatttctctctatccacttgaccacgtaggtcctccagtagtctactaactggcctgtctcaccctttctcattccctgctccataatgccctgttaaaaacacaaaaccagctgtggccccctctggcttaaagcactttgccggttgcccgatttctttgggatgagatccggactctttacagtggccagtgtggcctgggattacctgattggcacttgcctttccaactttggctcataccacagttctccccagactatgccccatccatgctcactgtgcttcagttactgtcgccttcatctgttccattcctggaagacttgagctctttcttgcctcgcacactgttcctactgcttagcctgtccatagctcttggtctgccaccaacatcaggcaagactgcaagtctttggaacctcattgcttctcttctgctaagcaaagtcagtgatgcctacttcatagggttatagtcaggattaaatggaattaggattataaaacatctgccactaagactggcccctaaggggtgcttagtaaatgttgctcttccttgctccaggatcgaggagagcaagaactatgtgactggctccttctcctttaagtctcagctgaagatatcgtcctcagaaaggtcttccctgcccaccctaattaaagtagcagtcccagccctcacccccatgaacttctgtactatcattctctccttgcttcctaactcatcatgaggtaaaatcacatgtttaattgtttattgcttattctctgactcctctagaaggtgggctttgtattaaatgttttctcattgaactagtgagtgaacctctgtttctgcatctgtaatagtttgtgccttctcagtgtcggggcgcacacgggcgcggagcctgccgtgcagagcgtggcgcctggtgcggaataagcgctggctctaatagctgtcgtgctcatgccgcctgtggaagggccgtttccatcaccagctgctgtttgtttgtcttgttctttcgtgaatcccagtatttgtctgcttgttctctatcatttttcctcagctcatgttctgattacccctgatggcttcctattcttggttcacaccctttatcctcaatcagctcctcttcacccctttccacctgcagcacagctcccagttgtcctcagaaggcttggtctggtttgccccccgtgggctgcaccgtctatgctgttgggtttcctggggccccagggccacacatcctggccttaccgtgagctggggattctgtggggctcctcagcctgtgcttggaactagagagcctgcaaggactcttctctacttggtgtccttgggctgcatgggcttccctgccagacgtgtgcagtcaccacaaagccctgctccaggcgagttttttccaggtggtcccagggaatcgggtgggataggtccactccgtgttcaggaggttggctcccgagcctctttccaggtgcactgtggagaagcaggtcccctgtgctgtctactgggaaacattcattgaagggagacaaatcctattttccttctgttccccatcaacttggcaataaaatactgtcgttcgtatatttgaacttgccagattaatatctgaacttccttgtgctgaccccttgaagttagttttttaaaataagtcaccagttttgaaggactatccttttttagaccatatacaaggaatctatcatctgcaaataattagacagtgggaatgatattgtattgctaatgagcagatgtgcagactcggattggaagaacagctgcacacatataaaatgcaaaagctacccaaacccagcattatgaattctgaaagggatttcattcttttaagaatttcagaaacagagaaaaatgaaacaaaagaatttaactgatatttttattaattgttctttcagtcacactttcccttctatcacattatcatacgtgttcatagtatctttgctgtttgcaaaagtgttatttgcacttttaaatccttctgtcatataatactataaagcttctatttaacatttttcctttgcctttctagtgttacaagggtttggtgtctgcactctgagtgacagactcttactgaaggtctttcctgagctgtgcacaatgctaagtgctcatgtgtacgtgatcccatttgctccttaaagcaacctatgaaccttagacccattttgtagaggaacagaaaggcccagtgaggtgaagtgatttggcacaagccacttactacattgcttgacggaggtggaattcggacttcagggctaaaatcgaagcctgatgttctttctgttgggtagcacatggccccacagtgctacacaattctatcagaaagcagaaaacatgacccactggaaacagcagcacattatccgatgattttaaactctttgtgatgtccattacaattttataatcctattaaggatttgcaagatgaagaagtccaaataatcaggcttttgaaaacttttagccaggaagagtttcacatatcttagatagtaatggttaggtcatttagaatttgaataaattgctgaaatggtatgaaatcactaaaaagaaatgaagtcagaagaattactagacttcacataaaagagtactgaattaggtcacagaaaaatcagagctggtaacactggcaggaactaggatttctaggttccaggaatggcaggctgagttattcagaccaaattgcccactgaaagcagctccaaatgttgaataaaatacaactatatatataaagcatcacatcaaagggctgacagaactatgaggaattaaccaggttaaaatggaaggcaacacaggaacccagacaggtaagcagaggattagatatatctttattctgagcaaacttgttaatcccagaaaatgcgagctttgagagccttattaaggacgtagagggagtgaccaacacaattccagcacttgacccagtggacataagatgctgtaccccacacctgggggggcgccttcttctcaatcacacaaggaacatattccaggccataaaaggctcagtatgtttcaaagggattaaaatcatgtagctttttttttctcttaccataatgcaagtattcagaaaatcgtcttatgttagaaaatttaaaaatttctggccaggcattatggctcacgtctgtaataccagcgttttgggaggccaaggagggaggatcacttgaatccaggagttcaggaccagtctgggtgacatagtgaggtctccatctctacaagaaatttcaaaaaaactagctgggcatggtggcacatccctgtagtcccagctactcaggagtttgaggtgggaggggtgcttgtgcccaggaggttgaggctgcagtgagccatgattgtgccactgcacaccagcctgggcaacagagcaagagcttgcctgaaaaaaacaaatctgaatatcctagttatcaaagataaatcatgatggaaattgtaaaatactttgaatcaaatgataattaaaatactgtatgttaaaatcgatagggcataggtaaagcagttctcagagggacatatagagccttaaattcatatattagaagagaaaagaagctgagctaagcgtccatctcaagaacttagaaaatcagcaacaaattcaacccaaacagtataaaataaataatgaagggcagaaagaaatgaaatgggaagcaaacaaacagaagatcaaaaaagccaagagtcgatatttcacaatggctacaaaattgataaagctctgggaagttgttcaaggaaaaagtgagaagacacaaatatacaacattaggaataaaaagtgggatatcactacagatgtgggagattttacagaaaccaggaagatatgataagcaactttgtgtcaataaatttgaaaagttagatacattctttaaaaatatagtttaataaaactgaataaagacaccactggcttcatcagtgagttctcccaacatttaaggaagaaataattgcagtttttcataatgttttcaagagattagagagagatgcagtccatcttatgatccttgcatagtcttgataccaaaacttaactatgtaagaaaagaaaattgtaggacaatcttacttatgactatatttgcagaaatcctacgcaaactattagcaaactgaatttaatagtatataagaaaataatacatcatgaccaattttagtttcctccaacgaacacaagcttagtttagcactttagtattagcccatgtaattaaccaccttagcaggtattttaaaaacatgtatgattattgaaatagatgcttaaaaagtattgaatacaattcagtattcataaatgatttaaaaacacatataaaagatgactttcttattctgataaggagtacatgcaaaagcctatagcaagcattgtatttaataatgatgcattgagaaactacagagaatgccattgcaatttctaatcagcattggagtgggggtcctagctcatgcagtaagtcaaggaaagaatacgtgtatgctgattgaaaaatccactagatacctatttatctttccccagccggacaccattcctcttctcccttgaagtggtcatgtgactgagttctggccagtggaatgaggaagaagtgacatatgctgcttccagacctggctcagaaaaacctgctgcatgatctgtgaacttctctctctgtattcagtctgcctgctgaatgctaatgccgagggaaacctttgaagcaacatattgaaggtggtgaagcttctgtcagcctaggcccctgaagagttcatgaagtagaactgttaccatctcctttttattaactgctttgcatgattatgaaagaaacttctattatgtccacccactggaatttcagggtttacttatttaccaggaactggtaccttgaagtggagtgctaccaaaaaatctaaaaaaaaaaaaacaaaaaacaaacaaacaaaaaaaaacatggcattggcttagtagttaggcagctggaagatctaatattgggtcttgtttatggttggtaaacacaccaattctctccaaattgttttatgaattcagtgcaaatccaaatgagatcccaacagttttgttgttgttgtcgtcagtgttgttgtttttgtggatcttaaaagctaatctcgacatttatagggaaatgcaaaagtccaagaaaagcaaagatacttgcataagaacaagaggatgagaggacttattcttccagatatcgagtcattataaagctacagctgttaagacatggtgtatctgatgtagggacaaatgaatagagagttcagaaacagacccactcatgtcaaagtatgacaaatgacacagttggcatttcatagtactggggaaataatggcttcttaatcaatagtgataagataattttcttataggaagaaagttaattggatttctgcctcacaccatacacaaaaatcaattccaagtagattgaatacataaatgtcaaaggcaaacgtacgaaatttcaagtagataattttcatgaccttgggtttcggaagcatttcctaaacaagacacaaaagcactaaccgtaaaggaaaaatatttgacaaatttaactatatcaaaatctgacaactttggttcatcaaaaagcatcataaagaaaatgccaagaacagaaaaaaagaaaaataaaaaataacaaattgccaagaacagagagattatatttgataaaggattagtattcagaatatataaaaaatagacttaaatgtatgtgcagtatttttttttagaaaagacagactgctgagagaaaaaatgggcaaaggacttgaattgtggcaaagaaacataaaatgataattaacgttattaatcaggaaaatgcaaattaagatcaagtgagattccattacacaccaagcagactgacaaaaagtgaaaatctgacattagcagactttaatgaattggcaagcatttagagctccaggaattcttgtgcagtcatgtggttttgtaaattggtacgactactctggaaaaatagttcagcatgtagttaagttgaagacatgcaaacactctacagcaacaattctatttctaggtatgtactcaagagaaactcatgcatatgtataagagaatacatgtcaagaatgttctttacagccccaggctggtaatgttcattaagggtagaatgtataaatccattgtggtgcattcatacaatgggatattatgaagccatgaaaatgaagaaaatggaaggacctcatgatcataattgtaagtgaaagattcaaactgtagtataattgcatttatattaattttaaaaataggctgtattagtctattcccatgctgctaataaagacataccggagactgggtaatatataaagaaaaagaggtgtaatggaccccaagttccacatggctggggagccttcacaattatgaccaaaggcgaaggaggagcaaaggcacatcttattacatggcagcaggcaagagagtgtgtgtaggggaactgacctttataaaaccatcagatctcatgagacttattcactgtcatgagaacagcatgggaaagacctgccccccgtgattcagttacctcccaccaggtttttcccatgacacgtggggattattggagctacagctcaagatgagatttgggaggggacacagtcaaaccatatcacaggccaaactaaactaggtttattctgaatgtgtccgtgtgctaaagaaattattgcaaaaaccaggtgtggtacaaccagagagagggaaggcattgtcatcaatagagacacatggaagactctcaagggtacttggctgtactctctttcttgacattagtggtggtgatgtgagtattcactttataatcactaattataaatagagtaatagtagacacttaactgtgcgtatctattttatgtacctttgtacatttatgtcttatgtacttttctgtaattaaatctggaaactacaaaggtataatatgtcgattgctacttctgctaatatgaacactatccatgatggactagctttgtaaatgtgtgtgcacatgtgtgcttggtactgatttcaatgtaagcatgttgtaaatctcatatagtggggcactttggctgtaaaactttaagatttggacttgcaatgatgacctaaaaattttactattttgaacgttttctaatattttcattatttggccaaacttgggattttagaacataaacagacatggagtcccaaaagacattctaggacgcataataagtaaaaagattttctttggccaccataaatagaatttcccttttacacaaacaaaattcacactatgataacttttgacctttcatgaagaaatcaccacatcttgtcaaaataatttatgactatagaagtaatgtgtactccttactgaaaatcaggatctttcatttttctttttgcttttagatatggaataaatatgtggcacctctgttaaaaagcaacactatttcatctcccttgagatgcactgcgtgaaaaaatgcaaagaacattgtgcaggtgatagatagtgaccgtattgtgtggctgtcttccttttagaagagagccacataatatctttcatacatccctatattccaccttttttttttttacttaaattatatatatttacaaatcggaataatagtggttaagatcatggactttggagttagatggttccagatgcagcactggccttcaacaggcaaccagcctctctctgagtgtcagtttccctttgagggaatgtcagtttcaccgtggcactgggagagggcatggatatgggtttactaatatcctccaagtatttgcagaattgggtgaataacgtagtaaagcacagtgcctggacatagtgagaactataggattgttagctactttgatgatccctctctctctctctctctctctctctctctctctctctctctccttcctcctcctcttctccccctccctctctcccttcctccctttagatgaaaggagggctgtccattcatttattcagtgttttaaattaaaaatgagctgtcagttaaaatggacaggattaagttctcagataaagtgagatggttatattcatagggcttgtctcaaacacctaaggtaaaggcaaggtgcaccaggaggtgtcacctggataataagaagtgccatctttcactgtgaaggatagaggctcatccacctaggggaggacttcgggacaccatggcatgttttttcacagagaccctactttccagcagaaggtaggaggccaccccgaagcagcacctgggtgagctctcccagcaatgccagcatccctggtggtcttcctgtgccactgcagcatgcaggtagcctttggtgcagcagactgtaaggcaggatccgttttctcttagcagcagtctatagaagagaagaatgtggaggtcatgctagtaggagtcactctgttttcaaccaacatggacagtcctgctaatgagattgctcccgcaaagctccctaagatagagatagcgatttcagaccctgaggcgttgttcctgacttgtcctgatgttcactgtcagccggtaactcctgggacctcgtaaagtgatcacctagcaacaactcttagcataaacttccctttaaagttctcatgttcagacacatttatcacgtctgcaatcaggatggataaaacagagttggtacccaaagatgagctgaggcttaggaggccctctgagcagaggagaagtcatcatcttatgcttcattatagatgaagcgtttctgttttcctctgcttcctctggctctgccgagagggagagaaacctcagagcagtcttagggttgtttgtccctttaaaatcttctttggagaaagtggatggagaaatctcaagcagttggtagatgtcaggaggtcagttctcatcaagaatgccccaaagcccagtcctcattaatcagtttatagagtactatggaagcattttaagcacaaggtgttgtttctgagccagtaattctctttccactcaacactgaaagtccactgcttgctttcctggtacatcaagacagccaaatagtgtcaataatttttcctcatagtttttcaaaagccaagtggagggcacagtgaactttgcaacacttgttgcatctgtgggaaagggggctctgggtcattgcttggtgattatgctcactcagggttccagaaaatactgtagctcatgggagtctgatctttccacgcatctctggtccccaccgtgacttgtcaagatacctatgtggttacacgcccaacccaccagcttcaggacccaccaggccccttgtcagaccttgtcctgcctcttcacagtcctcagaacgttccaagcttgttcttatttctgggccttgggctgggatgccccctccccagcaggtaccctacatccagaagcactttgttccattgtcctcgattattttgctgtaacttctcatgcatccattttggaaggagaaagggctttggtgtcggggccatcaaagtttaaatcgcaggatggccatttacctgctatgtgacctcaggtgggtcactgaatgtctctgatccataatttcctttttgtcaaagagggttaagaatatcttctccacagggctcatgtgaggatgaaacaagaaatgatggcaaagacctcgcacagggaagtacagtgtcaggctcgtgactactcttacccctccctccctcgtcctggttattccttgagacaagggattatgacctaattcttctgtagcctctagagtgtggaggctacagttgacacacacgaattctttctgctggagagaacatatttatttgcagaaagaggaaagacatataggagttattctatcatcaataacatttttctgtcctatctcaaaatataattttggttaattttgccctctggagaacagcattataaagcctgtttagatcaatttatgacagtcaaatatttcgtttgttttgtgattcaatgggtagacaagcagggccacttcttgtattcccagccgctcctggatgttggttctttcttctaggttttcagtctgttgagtttccagtcatctttcccagtgaagcatctttctcatctgggcttcacgcttgagggtaccatgctcatcctcttgagaagcgggcatcagggctttgacacagatgcttcctgggttacagctgcttttgcaagcagtagcagttccttccaagtccctgaaggcaccgcactgctccgcagtcctcacctttgttctaccttcacccttggcgcccacctgctgccaagacaagtcacttccttgatccagcctttgagacataggccccttccccactgatcacgtgaacttacccactccctttctgaaaccttgcattttttttaacctgcacagattttcccttaacacctctaattcttgcttatgcctgctggtctctgtttcccctgattatattaggaatgtgactagctgaaacatgctactgggtccaattcctgaatcccagtgcctggttcattttcaccacaacatggtggcctacaggggatctgtggcaaccctgcggctgtttcactctggggcactgtcacactcagatagaaactgactatcatccacccttcagctgctgagactggcagaaaatgctctttgctgactttaagttgcaggctagatgggtaggtgactttagtcataggtgcaggactcctgctatgtgccaagcaccgtgccaggaatttacacagacattgtctcatttcctcatccaccaagggagggatgatgaaaccttccatacaggtatctccttaggacccaaggaaataatatgtatcatagtgcattacatgtgacaattggagtagatcgttgtttaagtatttcatgtaaaagtatgtattcatagaacatctagtatgatccaagacctgtgataaatctacctgagttcaaagatacttgttgtaattaaaacaggcaaatcaaaacagatacatttcatgcttgtttaaagaaaatgctgtaaacagaaaattaaaacaagcacttagcaacacatcaggcacagggaccatatgaaaagtgtcaaaatgtctcagcattgtgcccagtttgagactggcactgtcgcctagtgaccgggtaaccctccctgttttctgctttcctaggtatgcgccaggggaacgaccatggcactcagtaccgctcggccatctacccgacctctgccaagcaaatggaggcagccctgagctccaaagagaactaccaaaaggtagggattgctgggctcctagcccctggcttaggccaccatgactagggccaggttctgattttagagggcagtctgctgcttttcaactggaattgtgttttatttgcacatctcttagaaatttctgtcagcctctaggagtggagccattgtgtctaatacgtgtgctaaatgaggttttaagagtaggcctgggccagggccagtggctcatgcctgtaatcccagtactttggggggccgaagcagaaggatacttgaggccaggagttcgagaccagcctgggcaacatgaagaaaccccatctctacaaaaaatacaaaaataagccaggcatggtggcctgcacctacagtcccagctacctgggagggtgaggtgggagtatcgtttgaacctgggaggtcaaggctgcagtgacctgtgattgcaccactgcacttcagcctgggtgacagagcaagaccctgtctcaatgtaaaaaaataaagagtaggcccttatgtgtttgcctttgaatcactcatctagatgaagacacagcctgttaaaataagtctttttccttctctctttatttctgtctctgtctgaaactctctctttttttcttccctctgtattagttttacagggctattgtaacaaacagtcacagcctggttagtttaaacagcagatatttattttctcacaattctggaggctggaagtccaagatcaaggtgtcggcagggctggttccttctgagtgctgtgagggaagggaaggatctgttccaggcctctctccttggcttctagatggctgtcttctccatgtttatattcacatcagcctagttttatgtgcgtgtgtttctttgtccaagcttcttgtttttaaacagtctctagtcatattggcttagtgctaaccctcatgacctcgtttaacttaattacctctgtaaagacccgttctccaaggaaggtcacattccgaggttttaggactccaacatatcatttggagggagacacgattcaacccgtaacactttctcataacagtaaattgaattatgataaaagtagttctcggaaatatatacatgatatcacaaaataattattttcagagttgtgtacccttttttaaaatcctccaatagagatttagttgttttaaaaacaagttgacttgctttagtttttagaactttgtgatagtacttgtattttatttatcattatattttctgatgtggatttgcatttgacagtagagctagaagctactataaagctaatctatgttagaattatgtaaaaagtcaggtatgcaacagcccccaggaatgagtgcagagacgaggaggctgtaactagagtgtccactggtgagcaagtagaaggacgggtgactcaaggtcagttcgactatgatgagcggagaggcctgagggaggcgctgacagagcccattccttccttggcccctcccacctccctcccagggtgatgtctgcttggctggtcatggtaggcagcctgtgggatggcccccagtgctctctgcccatatgtaattcatctccttgaatatgggctgcatttagcaactcacttctaatgaatgacagcagtgatgggagcactctgagactaggtcattaaaagattgtggctcgtattgtgaaaactctctgttaccgcgtgagagatggtaggggaagccagttgccacgtcatgaagcagccctgtgcagaggcttacatgacaaggacaaaagcctgccaagaactatgtgagtgagcttcgaatcccctcaaccccagtcaagccttcagatgagactgcagccctgcctgacagtttgattacagcgtcatgaaggacttcaagccagaggcacacagccaagctgtgccacagaagctgtgagataataaatgtatatactttgaagctgctaagttttagagtaatttaagtatacttgtatttccattcta

SEQ ID NO: 12706 - DNA, 275110 bp, Human
gaaatgacatggcgaggttgcccaacgtatcagtggctgggctgatgctgggaaccacgtcacacccacacactcacttcaacaatctccctggtaatttctctggcagagatgttgtgtgcagattaataccataatgactgtaattgttctgctccagtatctgaacaccagtggttgcaggacccatttgactaagcactgggattgttggtatttatcctgactccatcttcactttccttgcgaccttggacacaagctttaatggctcagcgccttaagcgtgtaaacctgtgaaacagaacaacattgcacaatatcattaactaatttacaccttgactctttctaaagggaagtgaggtgggagcaatgatattaatggtgaagaactggactgggataagttacaaacatgcttgactttccccataaggattacagaaggatgtttcattcattcattcatgctgtgagacagcctggggatactcatcttaaagcacagtccttccccaacagtcttaggaataaatcctagagtgggcatctagcccagtggttacggggagcttgggtggggtgagtggagtagcatctttgggaagggttccttcccctggaaggtgtgactttgtgagctgagttttaaaggttgagtagcagttggcaaattccctggagagagcatctcaaatcttttgtgctgaagaaccagccatttttgttcccagtcggccaggtaccaatacactgcggcgccaggtgtgactcaccacgtgagtctgacaacacccaaactggtttatactcggttcaaagagtccactgatcatgtgcttggatgtcgtggcattattaaattgctacaaacgtttactcttaatttctctacttgttacaagctttcgttcagcacaggaccaggtagcacctgaggggcacctggaaagcagattgttccagcctgcgttctaacaaggttcccaggtgaccctcgcacagcataaagttaaaagaactgccctaggggaaacgggactcagtgccaggtgggtttgatcattcgtccatctcagtgccatctgccatctctgcttccttgaggtctagaaaagggttacatttttaaaggtgatattggccacgtccccttccagtttcaaaactacatttccccgctgttacgcaaacgtcttaagcaaacccgactgcaggacagaaagtcaacacgggaatgcagcttccagaaattctgattagcctccgtcttccgctttgatctggccccgcagccccggcagctccgctgaccgcgcttccttcccgagattgctagtctaccgggctgcattaatgagatccgtgttgagccggttcccgggtctgctaaacatgaaaggcacagaagcccccagtcccttctcctcccctctaagtgattgtttagtctctctctgcagagggaagagttaaatcccctccccacgcctacgtgggaagacctggggaaacacgcggccccctcccgggtccgctaacgagcctgcggctgcttcgggcttagagtgggcggggcctggtcgggaagggggcggggcgctccgcccgggcggggccagacggtgtggttggcggagggccaagctcctgggggcggggccgcgagcgggagggcggggccggctgcgggagggcggggccggctgcgggagggcggggcgaggtcgctgggctgtagtcccgcgggcgagagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgaggtaagtgcgctcccagtccgacctggcctccggagcccagggagagaggcgtctgcccaccacgccgcgcgccctgggtactttttcctaagccctggaaggcgcaactttctgggagtctcctgaaatcaccccccatccccccgcggagtctctgatgagtaagcccgggcaggttttgtttcgtcctgtcccgcgctcgcattttgctccgggaggtagcgaaggtgcgtttccgtttgcgtgggtggctggctctcggggcgccctgggacacccgcgccaggtgaggcggcgcgcgccggggcgcgggcggggcgatccgcccgctcgactgcccgggtgcaggaagcccaataaaatgttcagcggggacctgcctttctccaagaaaggtcttgtctggtatttcctttgcaaaacgtgcgggcttcctgtgcaggggttcaaacacttccagaggagacggcttaatgaagtgtgagaaggagaggcaagggtttaatcggttactttgctcgccgagaagtgctcttttaaggcttgggataactccagaccctgggatcaaatgatcatgtatttgtgtagagtgtccatgcagattttgaattcgaatgtaaagaaaattcgtttagggcaaacagtggctattttaatagatgaaacggatgccctctttagggtcgttgagggtgggacactgaaacttaacttgagaaccctttttccccctttgggatcgagacttactgtggtttcttggctccctttcctttcttggttgtgtttatttaataaattctgtttaagtttgaggtttgaagtggctcaaagtaaacttagttgacttgagagagtctgatgtgattttcgttgaaagccagggaatgttttctgagtgcagaaccgctttggagtcttccagcaaatcagattgatgagggcttgcctctgtgttagccgacttggtttatctgatttaattggatataatatttcaagtcattctgctttctgcatgctcactgactgtattctcagacagctattcatactggccaaagtgataaatgcattcttgtttagtagtcatatctagtttttaaaagtggtgtttcagatgtgatacccacattcattgtggaaggaagactagaaaggaattatccatcaatacatatttttccttttcttaaaaaaagtgaaatatatataattgtgagacgctcgcattttctagtccatagacttttgttttcatgcttgtcgaaaggcaccagaactttctgcaagagttgcacgttgtccagtggtaaaggaccctcgggctacagtgagttccggtgtttaattgcttgcatctgtaagaaaacggaggccctgcccctagggcaatgattcttaactttgttgtttttgtgttctgggtcccttagaaaatctgatgaaaatatagaaatttgtattcagtttgcacggatctcactcctcctgtagcctgtctgagcaccacaggggtccgtggctcccccttggggagaactctgccccctagtgcaagtggggggaacatcaggataacgcgctacagcgtcctgatctcctgttacccggtgagactttgacttttcaaagtactcttttcatcttgcactggataccttagttcagtgtaaggggcctggttgttggattttatttctgtgatcaatattattttgcagttggccattagtgatcttctactttctcctcttcattttgtagacagaatcttaacccaaagatatgagtaagtcccttgcccagctttgaagagcttgttcacgaatccagagcctttttcctttgctgctggtgactttggtatttctgggaacttttcgcttattttaaggttatacttttaatcttgtgatgtatgtgtattacaatattaacttctaatcagccgtgaaagttccacccttaaatctaatcactttgagtgggaaggaagcagggccagtcagagaggttaaatagtgaggtattaattgtagacatactcttaacatagatcccagctcccctttctctctctcatgtcttgtaatggagcatccttttgttaaattgtccagtgaagaaaatgctgtaattaatgtcctgttagaatagaaacagcgagtgtggaagtgatatattccccaaggacagctaaattgtttggcctccttatcactaagtagaattctgtctttgctaacttttcccgttgtggcttaggggtaaatgacttgttgcttgttggacaacagtttaaagccagtgctaacaattggggaaaaattactgaatgagatgttgcctgtttagctttgtgtatgaatagccaaataataaggaaatgggagctgcttgtgattcgcaactgttatttctagctagaccagggtttctcaaacctggtaccattgctgagtaattctttgttgttggaggccgtcctgtgtgttgtaggaggttaaacgcatccctggactctactcagtaattgttaaccctatcccccaagttgtgacaacccgaaaggtctgcagacattgctgaatgacaggggagcaaaatcactcccagttgagatccactgagctagacctgtgaagcagttgtctggcggtattaattcctatttgtgttgcaggcacagccttgtctgcgcttccctgttttaaataggatttggccgggtgcggtggctcaagcctgtaatcccagcactttgggaggctgaggtgggaggactgcttgagcccaggagttcaagaccagccggggcaacatggtgaaacctcatctctacaaaacttagctgagtgtggtggtatgcacctgtagttccagccattctggaggctgaggtgagcccaggaggtccaggctgcagtgaaccatgattgcaccgctgcgctccagagcaacagaccctgtgtcacaaaatagatagactcttactgcctgctagattgattgattaattagatagatagtgtcttactgcgcgccagggggaagcttgcaaagcttgtgccagtcagctgacagctgctgacttcaaaatgttctccaggattagagaaactgagcatgccacattcctcagtttcagtttcttcatggccttcattagaattttatggctcccctcgagttaattgtgtgtatgctttggggaagcttgttttttcagcatttctaagtaagttgttaagtttacttcagccagaaactaagtttagatgtgtctgtaaccagaagcaataataataaaaaaagcaaacagaaaaggctcaaccaggaaaggggcaaggctactgtgcaaacttgtgttgatgtgctgaagtggacactgttttcatgtcttcagggccaagtacagtgcctggaatatagtaggggccagtaagtaccaaatgaaattgacctttctgtttccctgttaggcagaggtgtgatgtgtctgttcaaatacaagatctcggaggattattagtgagactaatcaaacaccttgattttcagaataaatatgtaaaatgtacacaagtaagatactcacaaatacaaatacagaaagcaggtattaatgtttaagggataaattgttagtggaaaatattccagacatacctgtttcttccagtctggttcactctggattagagcagacttcattctaaagacgttaagtggaaacaccaacttcttctacttaacttgacaagggactgtggttgtggttggttatctggagttgttcaaatagctttttaagtgagtagagttcccaagccaattttctccccatttggttgtatattttttttgtttgtgatctattgacatcttttcttgttagagaaaaatgtggacattgttatttttggcagctttctctcctcaccctcgatatgtctccatgtgtaaaggggaactgctgaggacttcttgtatcaccaattcctgaaggcaacccctttgatgactataaaatcatatcaggagattagctgggtccctttcccttttctcacaatggagatatagcgtgttgcctcttctctgtagtttgaaaacatttctattgtcaagtactcatttttttttccccctgctatgttggggacagcaaagccagggggagcagctgcagtgggacagttgttgcagcaggagcaataagctgtctggctggggcgggcagggtaggactgcttcctcactccatatcatgtggccggctgttcctgcaaaatcaagcacaaaccaggaacaagctggcatgggcaggtccctcactgtttaaccagagtggtggagggagagagcagagtgtttgcttttccagttcagctggctttaagtgggctcacatttgaggatgtaaaccttgaatgtgctctcctgctgttgtgattggtaggacatggagtatcttattattattactattattattattattgttttgaggtggaattttgctcttgttgcccaggctggagagcaatggtgcgatctcggctcaccacaacctccgcctcccgggttcaagcgattctcctgcctcagcctcccgagtagctgggattacaaacatgcaccaccacacccagctaattttgtatttttaggagagatggggtttctccatgttggtcaggctggtctcgaactcccgacctcaggtgatccgcctgccttggcttcccaaagtgctgggattacaggcatgagccaccacgcccagccgggagtaccttattattcatgagtttcaacagtttggacttagagtaactgctacgtaacattttcatgtcactagctagtaggggacgttcaagaatgagcctccggtgaagtctggattaagcttttccccttgcctaactgcccccaggctgagtgcagagcatcctatcttagcagtagcgcttggctccctccgatgggatctcagccagatgctctaaatcctgaacttgagctctctggtctgtaaatgggcgtaatagttcctagtttgcatggttatcagccgaatttgagagaggacttacagagcccttggcacatagtaggtgagtaataacaaaggcttggtcacagtaaccgtactttgaaattaagaaccagtggcccttggtgaatggaatgtcagtactcctggtgcagggaaatctcgaccttagagctttttgttctgaggtagcttcctgtggtgcgttgcatttatttgttttctctttttcagcctgtacatttctggcagattttgtatttccagaactctgtctaaagcatgttcttattgcttataaaattaagtccacattcctcagtctggttttcaaggttttctgatcttgtaactctctctttattcttttctcgcacgtgatcctacaccagaggatctgttacccagttccactccatcctttgtgcaggcaggcctctctgtctatcgaatgtcccacctgtctggctcctttttgaaaccgtctctaacaggtctagttcacggtgacctctattctcttacctctaaacctggctctctttctgtcttggtcttgttaggagggatttactgctgttagctagaggctttacatgctttacaaaccctctccccttttcaaatgagtaaacagccttgcgaggttaaatatcttatttgtaagtaagtttcatcacttccttggcattgaaatgtcctcatggttgagattcaatccttgcataatggttattttcagattattttatggcgggaaggggagatgcttctaactttttcccttgattatgaagtatcttacagttctttgaagacaataataaatatggctagtgtttcttgagtacagtcagccctgtactcagtatctgtgggttctgcatctctggattcaaccaacctctgattgaaaatattcaagaaaaaaattgcatctgtactgaacatgtagacttttccccatggattttggtatctggggaaggtcttggaaccagttccctatagatacatagggacaactgtacttaccatgtgccaggcatgttgctggcacttcacatttagtgactcatttaatcccttgaacaaccctatgggaaaggctctataattatacccaatccatagatgaagaaagtgaggcacagagaggttaagtaactgactcagtgtcacacagctggaaaacgatagccaggatttgaacccagacaggctgtgtccagagccacagagagttcttcactgccatgcttttctgtcctgttgatgtcctttgccttaaacttgcgtcatcttctctaggctctctgatgaaatgccctaaaagtgggcagttattaaatgattttcaagtggaaaactgcatgggagtttaggaaaacaagtagtccacaccctagaaatgttgaaaactccgcaggaaaatgttcatcagcttttgaacatgccactgatttggccgggtgcagtggctcatgcctgtaatcccagcactttgggaggccgaggtgggcggatcacgaggtcaggagatggagaccatcctggctaacacggtgaaacccccgtctctactaaaaatacaaaaaatgagccgggcatggtggcgggcacctgtagtcccagctactcgggaggctgaggcaggagaagggcgtgaacccaggaggcggagcttgcagtgagctgagatcgcgccactgcactctagcctgggtgacagagcaagactccgtctcaaaaaaaaaccaaaaaaaaaacatgccactaatttttatttgatttgctttttttgggaaagccaagcgccttctgtttccttctaaaaatgtgtgtgtgtgtttttgttgttgttgttgttttttgagatggagtcttgctctgtcgcccaggctggagtgcaatggtgtgatctcggctcactgcaacctccacctcccaggttcaagcgattctcctgccttagcctcccaagtagctgggactacaggcgcctgccaccacacccggctaatttttgatatttttagtagagatggggtttcaccttgttggccagaatggtctcgatttccagaccttgtgatccacccgtcacagcctcccaaagtgctgggattacaggtgtgagccgtcatgcccggcccataaagtgtggtttctaaagctggttgtcccaacttcatgaggatagtaggaaggtttacatactaaagcacttagggccatgtgctcatgcctgtaatcccagcactttgggaggccgaggcaggtggatacctgaggtcaggagttcgagaccagcctgggcaacatagtgaaaccctgtctctaataaaatccaaaaattagctgggcgtggtgacatgggcctgtaatcgcaactacttggaaggctgaggcaggagaatcggttgaatccgggaggtgaagattacggtgagccactgcactccagcctgggtgacagagggagactgtctccaaaattgtaatagtaataataaaaatattaaaacaaaataaagcacttagaaaacaagatgatttgagaagtgtttattaaaagaaaatgtgggactcatttgtttccctaattccagctgtcaattaattagtgaagtgttacttgaggttttttgatagaatcttctttttcagttaaagattctgagtgctttgttggagtttcttcatatcacctatcatttgcttgttagcttatcgatacccatggaacagttattgacaggacattgggtcgttttcccaagagcattccttgaataaaacattttgctgccttgctaagaggtgttcagaaaatatttccaccaggcctaaagtaaatctagcacctcatgtcacatgacatcatgtcatctaatgctgccagttacaggaaaagacattagagttttggggacaaagccacaacacatctgttgaaatacagctagaacaagggagaaacatatgggaattgtccaactaatagctctaccttcacccagtccgactccctgcctgctcttaaggattaaaattgcctccgtataaaagcattttaaattacggcagttaaaggccgggcgcggtggctcaagcctgtaatctcagcactttgggaggccgaggcaggaggatcacgaggtcaggagatccagaccatcctggctaacatggtgaaaccccgtctctactaaaaatacaaaaaactagctgggcgtggtggctggcacctgtagtcccagctactcgggaggatgaggcaggagaatggcatgaacctgggaggcggagcttccagtgagccgagattgtgccactgcactccagcctgggcaacagagcaagactccatctcaataaataaataaataaacaaacaaacaaaagaaaataccataagcagaagacacaaagaagctcccatggtgtggctcttcatgttttgtggtagatgcattgagactttttttttatgccttcatatatatgtttctgataaaacacacctgtaatgtttttcactgaagagttgattgagaaaagctttaaatatcatttgtggggccagaggcaagagtacaaattcagttcccatatcacatacctaaacatttaaaagttataaaccatgcttacaaattggtaaataaaatggcttctactctgcctggacaaatacatctgtcattagggcagaatcaacaaacatgtttaaagctatgggttttattgctgaaagtcagcaaaatatcaaacatgagtgaatttaattacagttgcctatgtctgggtgttctgttgatgtttcatgagtaataaatacgtatactccatagtatatttttcataaatctatttttttgtccatattttagcaaactcacttgttatgtggttagagtcaagattgtcacaatagtttgttttacggacagtaataccaaggtggagaacctttctttgtggttcttagattgttcttttttttttttttgctgggacagagtcttcctctttcgcccaggctggagtgtagtggcgcaattttggctcactgcaacctccacctcccgagttcaagcaatccttctgcctcagcctcccacgtagctgggattacaagtgtgtgccaccatgcctggctaatttttgtatttacagtagagacggggtttcatcatgttgaccaggctgatctgaagcttgtgacctcaattgatccactagccttggcctccggaagttctgggattacaggcgtgagccaccccacctggccagattgttcttttcttaatctaagtctagagatggcctgctttgctgaggcaggacagtagttactgacattgtcagcgaaattcatacagcaatatttacattaaaaaaagaatgagattgcatatgatagattattgattttaagaagtactacaaagtattttagtttcattatccaggttgaatatccgtaatctgaaaatccaaaatttgaaattctcccaaattggaaactttgaaaaaaatatttattgttaatttttcatattagatttacgttttccaggtacatgtgatcatttgatgctttcatataatcacatcagggtcattggcatatccattaccttaaattgttatctttatgctagggatattcaaattatcctcttttaggtattttgaaatgtacaatcagttaatgttaaccatagccactctactgagtgccgaaatgacactcaaagaaaatgctgtttggagcattttggagtttggattttttattagggatgctgaactggtgtcttgcaaatattccaaattctgaaacacttttggcagcaagacttctggataagagataaccaggcagtctatgtgagtcattattgctgatattgtgatttatcaccatttcttaaatcaggtatttctgaggttctttataacttttcaatgctgtgtatgttataaagaaaactgaggccggacacggtggctcatgcctgttacctcagcactttgggatgccgaggcgggtggatcacctgaggtcaggagttcgagaccagcctggccaacaaggtgaaacctcatctctactaaaaatacaaaagttagccagatgtggtagcaggcgcctgtaatcccagctacttgggaaggctgaggcaggagaattgcttgaacccaggaggcagaggttgcagtgagccgagattgcaccacctactcttacttactctgttgcctgggcaacccaggagtataccgtaatgcgtgtaccataatgcatattggccagaaaatggtctatgtgaaatgtttggggattaggtctatgtgaatcttttccttctcagtcatgcagatgttttatttcattctgatttttaaatattttcttcaattattacttttgttgcatgtttcacatccaggtcctttctgattgaggaaaagttttctctaaaattattcaaaacatttgttaagtgtaatggccaaattatttctgtttgggttttgggaaacttttgctaatattattaatagtaagtgataggccgggtgcagtggctcatgcctgtaatcccagcactttgggaggccgaggcaggcggatcacgaggtcaggagatcgagaccatcctgactaacacggtgaaaacctgtctctactaaaaaatacaaaaaattagtcaggtgtggtggtgggcacctgtagtcccagctatttgggaggctgaggcaggagaatggcgtgaacctgggaggcggagcttgcagtgagcagagatcgtgccactgcactccagcctgggtgacaaagtgagactctgtctcaaaaaaaaaaaaaaaaaaagtgataaagtgatagttgataccaaataactcctgccaatagaaattcaaagttaatatcactttccacccacgaccatgatttgtactttatttgaggagtttctgcatatttacttatttttttgccattttgatgtgcaggggtgtgagggtccaagagtagtctgcccattcttcctgtggctgtatcatcaattatatgacaattttaggttgtttctagaaaacagcgcatgaacgcttttgtacctaagtcattgcgtgcctatttgattatttcctgaggagtaaaatttcccgggagtggaaatgttggatcacaaagtttgcagattcttatttggattatttggcagtggaagtttcatgagaggtgtcagtgcagctggcagctgcgcagctgagataccctgtcatgatgtatttatgaccccggggattttgtaactccttactagaagcttaaggaaatacattgattagcggaggaagttagctcatgatactagattttcatttccatttttaggtcttctgtgaaccaggagaaggccatcttttctgttaattgcaaacaaggctcttgattcacatgctccattcatcccaccccccagcgtggttgttgatgttcgtttaaggccaaagcacactcaagggactaggctgtacattgcctggggagccagtggacattcatttggagaattatttgtatggagttttactttagttttttgagacagcgtctcactccgtcatttaggctggagtgcagtggtgctatcatggctcactgcagccttgatctctttggctcaggcgatcctcccacctcagcctcctgagtagctgggaccacaggcctgtgccaccttgcctggctaatttttacattttttgtagagatgaggtctccttgttttgcccaggctggtctcgaactcctgagctcaagggattcttcccctttggcctcctaaagtgctgggattataagtgcaagccatcgcacttggccaattttttgatttttatttctttgcattttagtatccttgtgagttaaccctaggcaacaacagttactatgtcgtggtggttcacatgttaggtggccaggatgttagggtgtgtgtgtgtgtgtgtgtgtgtgtgtgtgtgtgtatgggcgtgtttaaggcttattatttattaacctaggaaatctttctggactttgaaataagagtttagtgccaggtggccgggtgtggtggctcatgcctgtgatcccagcactttgggaggccgagacgggtggatcacgaggtcaggagatcgagaccatcctggctaacacagtgaaaccccatctctactaaaaatacaaaaaaattagccgggcgtggtggtgggcacctgtagtcccagctacttgggaggctgaggcaggagaatggcatgaacccaggaggcggagcttgcagtgagctgagatcgtgccactgcactccacctgggcgacggagcgagattccgcctcaaaaaaaaaaaagaagagtttagtgccaggtgaaaatacactacatctctgacaatgtatataccattgtcatttaaattgtcatttaatacaggtttacttctgtttatttctacccatgttttgttcttctcatgatgtgacccagggggatttagcagttgaaggctgaagaaactagaactctcgttgaaactggacaacttactattgcaggaaaaagcactagttcaccctcccctcccctcttctctttttccttttctttcttttttgagatagagtcttgctctgtctctgaagctggagtgcagtggcactatcacagctcactgcagcctccacctcccaggctcaagggatcctcttgcctcagcctccccagtagctaggaccacaggcatgtgccacctcgcccggctaattttcaaattttttatagagataaggtctcactatgttgcccaggctggtcttgaactcctgggcccaagctatcctccctcctcagcgtcccagagtgctggaattacaggtgtaagccatcacacatggctgagcacaagtttgtaaaacccacctgtccagatggctgagctaaccattctcagaaacgaaactacaaccctagagtagatacatgaacactttgccttggcccaggatcctgaagacggtgaccatggacctgctggctagccttgcctcctctgctgcctgctgcagctcacactctcctctcctgaccctagaggttgctgaatgggtcacacactccttttagaccagtaacatactgagctgtttcagccttcccttacacttcattttctagagagccagtcatctatttggatcttacttatatctccccaaatttgttactgttgttgttttatctctctgaaactttgctatcacaagctggattctcttaacatctgattatctgatcattgcaggcggcttggagctaagggccaaggtgtgcagccctctggaagttttccccctcggattctcagatgtgggcacatgtgcccttttttcagatcttctgaaccctggcacccttgatttttttttttttttgagacggagtcttgctctgtcacccaggctggagtgcagtggtgggatcttggctcactgcagcctctgcctcccgggttccagtgatttgcctgcctcagcctcccgagtagctgggattacaggcacgcaccaccacgcctggctaatttttgtatttttagtagagatggggtttaccatgttggccagggtggtctcgaactcctgacctcaggtgatccacctgcctcagcctcccaaaatgctaggattacaggtgggagctgctgtgcccggccccctttacgtttttggctagatcagtctttgttgcagtggtgggtgagggcggtggtggccgtcctgcatatggtaggattctgagcagcctccctggccttgaatcactagatgccaggatcataccctcacctcctggttgtgacaaccaactgtcttcagacatcactaggaggcaaaattgctcccagttgagaacaactgtatcatgtctatactcttaaggccacagatgaaacttgatagtattttttcgatcttcctcatctccactgttttcgttttttttttttttctttttccttttcttttttccagaccctgaattccaccagatctactgtttcctaatggcctttcacagtagtaaatgtgtgggagaccacacatttatcagtgtggaaattttattctttgggatccaaactctccccataaggtttgggcatttacaatcattatttactgtctgagtcatgtgttcagttgttcagcctagttagaatattcctggccagctggaaccactgcgctaaggctttcattggtccccgttctcagacccctcaccccctaagtgcttttttagttcctttccctagagtgttagagaaatatttattatactgagtaattaaactgacagttgttctccactaggaaaaagaaggtcgtattctctcgcaaagctttgagggcatgtcaagttatgtcaaggtaaattacatctgctgccttctcccacatatatcttggatggtgttattctggtatacgtttattttattttattttattttattttatcttatgttattttttgagatggagtatcgctctgtcacctaggctggagtgcagtggtgcgatcttggctcactgcaacttccacctctcaggttcaagcaattctcctgcctcagcctgccgagtagctgggattacaggcgcccaccaccacgccccaactaatttttgtattttagtagagatgggctttcaccatgttggtcaggctggtctggaactcctgacttcaagtgattcgcccacctcagcctcccaaagtgctgggattacaggcgtgagccaccgcacccggcctattctggtatccattttaaaaagaagtctagattcagaagtcacccaaatagtacagagaggccctttctgtgtacctgccattccctggtggtggcatcttacataacaaaatacagtgtcaaaatcaggaaattgacattcctgcagtctacaggccttattcatgtttcaccagttttgcatacatgcattttttatgtgtgtgtgattctgaacagtgttatcacatgtgtagacttgtacaaccaccagcagtcacaatatagaactgttccatgacagtcccttgggctcacctttggtggcaccccagcctccctccctctaacccccagcacctacttcttttttctccttctctatagttttgttatttgagagtattgtataaatggaatcgatcagtacatattcttttgagacggactttcttcactcagtgcctttgccgcccatccatgttggtacacgtgccggttttgttccttttttattattaagtaatattgcattgttcaggaacacttttatttattttgtttatcttatttgcttttttgagatggagtcatgctctgtcactcaggctggagtgcagtggcgcaatgtcggttcactgcagtctctgcctcccgggttcaagtgattctcctgcctcagactcccaagcagctgggtttacaggcatgtgccaccaagcccagctaattttttttcttttttgagactgaatgtcgctctgttgccaggctggagtgcagtggcacaatctcagcttaccgcagtctccgcctcctgggttcaagtgattctcctgcctcagcctcccgagtagctgggactacaggcatgtgtcaccatgtccagataatttttgtatttttagtagagacggggtttcaccatgttggccaggatggtcttgatctcttgacctcgtgatccacccaccttagccacccaaagtgctgggattacaggtgtgagccaccacacccggcctaatttttgtgtttttagtagagatagggtttctccatgttggccaggctggtctcaaactcctgacctcaggtgatccacctgccttggcctcccaaagtgctgagattacaggcgtgaaccactgcgcccggcctgtgtgtttatttattccattatttaacttgtgaaggtttattggacacttaccatgggctaggactgtgctgagctttttacatgtattaattcatttaatctgcttggtagtcctaagtgattgtattgtttacatctttattttatgtatgagaacacagagtcttagagaagggaggtagtctgctcaagttcacacagctgggaaatgatagagccaggataggaggccagagacctctaactccatgaactcatttggaggggaaggcagttgttctggtagatttttgtttgtttgtttgttttgtttttgagatggagtcttgttccgttgcccaggctggagtgcagtggcatgatctctgctcactgcaacctccgtctcctgggttcaagagattctcatgcctcagcctcctgaatagctcgaattacaggcgcctgccaccacgaccagctaatttttgtgtttttagtagagacagggtttcaccatgttggccagtctggtcttgaactcctgacctcaagtgatcccgcctgccttggcctctcaaagtgctgggattacaggtgtgagctatcactcctggccgttctggtaggcttttgaagtcggaagaatagagactgtgtggaaatcttcaggaatgcatatttgcttctccatacagagcagaacagtcaggtaatacaagtccaaaaggaattagctgatttctgccagtgactggaacaaggaatagaaattttcctatagccaagcaaaagcagaaacatagaccttctgcttctttttgtgatgacagcaactgcacactcatcccgagtgattggcgtaagtaagtgatccctgttccgagtgagggctcgaaaaatactttcagtgggccaggcgcggtggctcacgcatgtaatcccagtactttgggaggctgaggcaggcggatcacctgaggtcgggagtttgagaccagcctgaccaacatggagaaaccctgtctctacttaaaatacaaaaattagccaggcgtgatggtgcatgcctgtgatcccatattcgggaggctgaggcaggagaatcgcttgaacccaggaggcggagtttgcagtgagctgagattgtgccattacattccagtctgggcaacaagagcgaaactctgtctcaaaaaaaaaaaaaaaaaaaagaaaagaaaaatagtttcagtgaaattttgtgtttccagggagcatccgtgtggaatgccaaggccacactgaatttcatcagttatttttttggagtttcgtctatttctggtaaactctagcttccatgaagcaatattgagggaaagtgtatttgctttggaatccatatgcagtttgtaaatcttgcttgtaatctgctgagctgctgagctgatgcttctatctgccttgtagatggaagtgacacgcagctgtctagtcacagctttgggcttttggactcttcacatcttccttacccattaaacttgaaactgtttctttcaagtttaatgataacaattttaagaaactattttggaaattgactctcctagtagtgtgagactttaaaaggtaatggatggtttacatttaaaccagcttttgaaggctgtgatttagttaaggtggtgctacttggcagctgctaatattttttattcctatggaatacgtattctgtagtttaaaaagaaagtggctagcatggttagatcagcagaaatattctttgttgtaaagtatgtagcctggaagttatcaagggatggatacataggttagaattactttttttttggacccagggtcttgcttttttgcctaggccggagtgcagtgatgcaatcacagctcactataccccggacctcctgggctcgagagattctcccccgttcggccttttgagtagctgggactacagatgtgtgccaccatgcccatctgattttttcttttttttttcctttttttttttgtagagatgggtctccctgtgttgccctggctggtcttgaacttctgggttccagtgatcctctcctcccctctcagcctcccaaagtgctgggaatacaggcatgacccaccatgtcctgctagagttactggtttgcatagaatggtagttctcaactggaggcacttttgcctcaccggggatatttagaagtatcaggagacatttctggttgttaacactgatgggaggtgactactggtgtctagtgggtagaagctgaggatgctgctaaacatcctcaattgcagagggcagcccccacaatgaagattgatccagtctaataggtcaatagtgttaagggtaagaaaacctgatataaaagattgacttacaagaatcttccctcttgtattttattttaatatgctgcattttctaaataaaatcattattcctaaagtaatttccatagtgtactcttcggggtgtgtgtgaatgatgcattaatctgatttttattaattttaataccggcattatatttagtacaacttggttatattaaatatctagatctatagttatatgtttgttttatttattccaacattgatttctgcagcattggttaatagttgggatattaagccatttttatttctaggccttctcaactttgagtttccactgatcctaagaagcgaaggaacagacaatacggacctgatttgtatatttctgagatgaaagaaagattgaaggggctgacgttagcaatctacactatattctttggacctcttcgtgtcatctaattattttagttaattaccaacatttttgttaccaaccctgataatgcaagaggcagcctctttgaatggggtacgtgaacctttaccagtgaattcatatcttttttcttttccgtttctcccaattttgatgagtaagtgtgtggtttttcttcttaattttcatcaagcctattgttttcttgccagccacagtgatgaatcactctaaaagcttggtgagggcagttgaatcagcaggcaaaacttttttatttgctgaaaataaatggaaggctgcttataggttcacacccttgctgctctcatcaaatcttcaggcaggagggaaatgaaattggatcatcttaaacttcctggatttaatctgtgatttaggagtgagttctttccatgcttctcctctcctcttttcccttcctagcaagaggagaaaaaaagcaagtaatttaatgtaatctgatttttttttttttttttttttttacttcatggctttttgacattggaagagaaatgagccatctttctagaggagctttagtgtcatgtgtgcttttcttattgattgggaataacttaaaaagactcctcagaactccgaatgggatatttaatttgttagaacacgagtctgcaccactatctgttgacggtgaaatgaatttactaagtggataatttgctgagcattagctgaccctgacgtggcggaacgaaggtctctggagatggttcatggtggaaatctgggcttgatgggtcggtaatgagacttcagcgatgacatctttaccaaggctgaggcttaacactcgggaccaagcgattcaactggtaagcgacatgctttgaatatttactcaccagctctgttaattcagattcaggataagaaatgtatggtgagtgattttttttttttttttctttttgacgtagagtctcgctctgtcgcccaggctggagtgcagtggcgcaatttcagctcactgcaacctctgcctcctgggttcaagcaattctcgtgcctcagcctcctgagtagctgggactacaggtgcatgccaccacacccggctaattttttatatttttattggagactgggttttgccatgttggccaggctggtctcgaactcctgaccttaggtgatccgcccgccttggcctaccaaagtgctgggattgtaggcgtgagccactgcgcccagccaatggtgagtgatttctttgcatcagagatgactgcttgttgaagaccactgttgatggaattcagcgtgccttcacctctgccacttgacctctgattggcctgccattgctgtggttgtactggtagctaggagggttcccatcccctgccattactgagaccatgatgctgtggagggggatgcggaggacaccaaggaagtacgactgattgactgatgcaccttggagggtccctcagatttatctataaacccttaaaaataacgataatcatagaggacatctgtgaggaacttatttggtgccatttgctgtgctgagccatttatatacagatatcctggatctcattgaatcctctgcatcttaggaactgttgttaatctcatgtagagatgaactacctatggcttggaacccagttgtgttccctggtgggactctgacttcagaaagtactctttttgtcttgcactatataccttagttcagtgtaaagggcctggttgttggattttatttgtgtgatcaatattattttgcagttggccattagcgatcatctattctcacctcttcattttgtagacagaatcttcaccccaagatgtaagtcccttgcccagctttgaagagcttgttcatgaatccagagcctttttctttgctgctggtgactttggcatttctgggaaatttccgtttatttaaggttatacttttaatcttgtgatgtatgtatattacaatattaatttctaatcagctgcgaaagttccacccttgcaaagtcccacagccagatgggatcccaagtttcttggctcccccagagcttgtgtgttcatttcttctcttacaagttgatgtctcaagagcttatcactgctctcacggccaggtggcttgccggttccaaggactggcagtgaccttataaaatatttggactttttctagtgcgatacgatcccatactaggcagtgattaaatctcaaggttattttcatgtctggggtacccagtggaaggcatgttttgtctaggactcccttaaatgtaggaaagacatatctggggctagaaaaattagtatttacaaataggcaaaacaaaagtagtagactcagcagaaagaacaggtctgcagaattaacagtggcataggtgggccacgtaggttctgtcagatatcactgatcccagtgaggtcatggggcatattgatctgttctgctgaccgctatctgatactgataacgcatgttaggttcttataagaatgggcttgcaggcttcttagtgtattccagcagaagctcctgaaggtccttgggaagtttgtcacaggcaggaatcatgtggaatggcagcgaaggaaggcggcatggccagctgttgggatcggcagagctggctctggcagtgggcactcagccaagccgcccgcacttcctataaaacaccctggtctctacccagcttcccgtaggtactgtaggaagaaatgccaccttgaacccttggcccagcttgcagtaccatgctggaacattaaggtctttatcatttggtcaggatcggacagacttgctcatgttcctttgcttttcctgccccaccactgaagttggtatcttcaggtgtgtttccagggaggagcccaggttagctgtgttgtattgtttcttgtcttaactgaaatcccataaaaggggctgagtgtagtatcccacgtgatccaggtcattcctcctcctggtgcctcttggctccctctccttcttgtctttttgtctcgagcaactgtatcctaacctcctccctctcttgccacatggtggtctagtctttgcctggcctgttgttcttggagctcagaattttgctggccttatttctgaacttcagctcatacttacgtatcctggttctcacttgtctctcttgttctgactcaagatgttgcaggctcctagccacacccaaaccccacattgcacacctacgcttgctttgtccactgcctggggttggctgtgtttctgtaagcaggcaggtcagtagcctgtcttccactgccagccttccctggcactctgggcactggccacctccacagtggcagatgcagttttgcaaaagtgacttcattcacaaacttgagaagaaggaaattctgcgataccagggtgaaagccaaaattaatcattcagtcttgagctttagacagccatacacgtatatacaaggagaagcagaagattgtagtttgaaatgttcatatgcaattcataccctaaaggcttggattccttctagcattaccaactatgcatctctgtgctttattgctagaggagacttgactattactcaagatttgattttttaaaatgacctgacaggagtgttaagagaattttggcagtggcttgtatctttgtctttgagtttttagcacctttaaatgccaagcatgattttttttttcctctataacctaatcttggaagtgagaaaagagtttgttttataactggggagaaagaaatggtttatttttgtgtttgatgtcagtcacaaaagaagggaggcactgagagaaatgtaagctccttttttggtgaactttactaaaaccaaagggaagatagaattggctttttttttttttttgggaataaacaatatccttgcgttctggtgttcaattggcaggtggccagaaagcatgcctgtagcttaggaatcatcccaaactaagagaaaaagcctgacttgctggaggctgaaattcaatcttggaggtaccatggtgtgtgtgtgtgtgtgtgtgtgtgtgtgtgtgtgtgtgtgtgtgtgcagggtggtaggtgaaggaagtctggaagttgtacccttggcagctataaacagaatactcaacccacttgggtggctgaaatacagactgtttaaaagggttttagtctgccatttggtcagaattaaggtatgattcaatatattatatccaacgctggcctaaaaacatactcatttttcttttgattagagccaggtttaattaaaatcactgcttgacaagcccattaaataactgaaacttcccttccaaagcttaccctgaatggaggcattatgtaccaaataatgcatttttcaaaaccagtattgagacccagactatgtaaggcacggtgtacaaaggctacaaatatggggcctcaggtaaggaaagtgcgtgcactgagttaggtcgtgtgccatagggagtggtggggactgtggctcaccggagctcactgacctggaagaattagggctcagtgttgccaggccttctagttgttaaagagagatcagaaacctagatttctgtgaaatgttgcaatttgcaaaatgttgacaagtaacataaaatgttttggtttttacctagtgggccgaacaaaacttggctgtggcttaaagtctttagatcagggtgtccaatcttttggcttccctgggccacattggaagaagagttgtcttgagccacacataaaatatactaacactaacaataagacgactgatgagcttaaaaacaaacaaacaaacaaacaacctaatttttttttttggagacggaatttcgttcttgttgcccaggctgaagtgcaatggcatgatcttggctcactgcaacctccgcctcccaggttaaagcaattctgcctcagcctcccaagtagctgggattacaggtgcccaccaccacacccggctaatttttgtatttttagtagagatggggtttcaccatgttggccaggctggtctcgaactcctgacctcaggtgatccacccacctcggcctcctaaactgctgggattacaggcatgagccaccgcggctggccaatttttgttgttgttgttggtctaagacaggatctcactcagttacccaggatggagtgcagtggtgcgatctcggcatactgcaaccttgatttcccaggttcaagcgatcctcctgcctcagttacccaagtagctgggactacaggcgtgcaccacaatacccagctaatttttgtattttttgtagagacgaggtttcagcatgttggccagcctagtcttgaactcctgagctcaagggatccccccgcctcagcctcccgaggtgctgggattagaggtgtgagcccagtgcccagcagaaatctcataatgttttaagaaaatgtacaaatttgtgttgggctgcattcaaagccgtccttggctgcaggttggacaagtttgttttagatggtgaagaagtgctgctgtgtaactttggagcaaaggaagggaatggaatggcttatgttttcctttgggttggtttaggttagttttagcttgcttccaaaaaatatttattgtgaagtagttttgagagggtggtatctaggttagatttatgtattttctgaatggatcctcatagatctctgttagtctttttaaattaagttaaattttgttttagagatggagtattgccatgttgcccaggctggtctcacactcctggcctcaagtgatcctcttggcctggcccattctttatggatcatgcaggggtagaaattggataatcttgtctcttgaaggggagaaaagcttttatttttctattttaaacgtttacttaatgtctttttttttatttaagagctgtgaggtttggaggactagatgtcatactaagatacttgttcataaaacctggcatttgtttaatgactgagtccctttccccatagactacctcagacagagtgtagcataaatgggaaggttctagaaacacagtatctgggtttgaacactgctctgatgcttgctggggatatgaccttggggaagccacacccccatgctgtgcctcaggctcccttttgtaatatgggtttaatcttaactgtacccatcccgcagggtcgctagggaatgaaatggtgaatgcattaaaaatgcttagaggagtgatggatgcctagtgagcactgaaaaagcattaggtagtttagtttctattactagtttttactaattataataaaatatctgagagcccctttagtgtaggacattgttataggtattttcacatcattttcacgtggtccttccaactctatgaagaacaaattatgattcccattttatagatgtcacactatggaataaagggcagaagacctgggtggatctctgacctggtcatttgtcagctgtgcaaacttgggcaagtcagtctttctggactcaactcaaatttcctggatgtaaacagggaaaaaagaaacaaaaacaaagacaaactggattgtttcaggattttcagctctgatttttaaaaattttattttttaaggtgagattcatataacaaaattaaccttttctaaatgtacaattcagtagcagccagtgcatctacattgttgtgaaactatcacctctagtttcagaacaatttcaatacccctaaataaaacccatacctgttatcttagtccatttttgttgctataaaggaatacctgaggctgagtaatttataagaaaaagaagtttatttggctcatggttctgcggctgtataagaagcatggcaccagtatctgcttctggtgaggcctcaggaagcttccactcagagcaaaagccaaagaggagtctccgtatgcagatcacacggtgagagaggaagcaatagagaggggagagtgccaggctcttttcaacaaccagttctcataggaactaagagtgagaattcactcttccctgtaagaatgagttcctgcaagctattcatgagggatctgcccccacgatcatgaacacttcccaccaggcccgcctccatcactggggatcagatgtcaacatgcgacttggtagggctaaacaaatcatgtctgatgtggtttggctgtgtcccaactcaaatctcatcttgaattgtagctcccataatccccatgtgtcgttggagggacccagtggaaggtaattgaatcacgggggcagggtttttctgtgctgttctcgcaatagtgatggtaaataagtctcacaaggtctgatggtttttttttttttttttgagttggagtttcgctctgttggctgggctggagtgcagtggtgtgatctcagctcactgcaacttccgtctcctgggttcaagcgattctgctgcctcagcctcctgatttctgggattacaggcgtgcaccaccacagctggctaattttttgtatttttagtagaggcaaggtttcaccatgtggtcaggctggtctcgaactcctgacctcgtgatccgcccacctcggcctcccaaagttctgggattacgggcgtgagccaccgcacctggccaatttgatggttttataaagggcagttcccctggacatgccctcttacctgccaccatgtaagacatgccctttgcacctccttcaccttctgccgtgattgtgaggcctctccacccatgtggaactgtgagtccattaaacctctttttctttataaattacccagtctcaggtatttcttcatagcagtatgaaaatggactaatacaatgtccaagacatagcacctgttcagcagtcactccttattctcccttcttcccagcccctgacaacctccaagttgctttctgtctctatggaattatctgttctggatatttcatgtaaatgtagtcacacaataggtgaccttttgtgtttggctgctttcactgggcataatgtcttcaagattcatctatgttgtagcatgcatcagtacattccgatattccagtgttggctctgttttatatgagtaaatgtgtgtaaaatgcattgtaacaaatatggttatatacttatcatatctatatctatctatatataatgtgtatgtttcaatatttatgttgatttctattggcaagaaggcccatatttaaagagattggattggatctgtttttattagtgtcatggcatatttcccaaaggctccactttgtacctctgtttttaattggtttacctaacaaatttattttattttatttcattttttcgagacagagtcttgctggctggagtgcagtggcatgatctcagcccactgtaaccttcacctcctgggttcaagcgattctcctgcctcagcctcctgagtagctgggattacaggtgtgtgccatcacacccagctaatttttgtatttttagtagagaccaggtttcaccatattggccaggctgctctcgaactcctgacctcaagtgatccatccacctcggcctcccaaagtgctgggattacaggtgtgagccactgtgcccagcctattatattttgagcaagagtctcactctgtcacccaggctggatggagtgcagtggcacaatcttggctcactgcaacctttgtctctgggttcaagggattctctgcctcagcctcccgagtagctggaattagaggcatatgccaccacacccagctgatgtttgtatttttagtagagacagggttttgccatgttggccaggctggtcccaaactccttacctcaagtgatccacctgccttggcctcccaaagtgttgggattacaggcgtgagccaccgagcctggccatgtttgccttagttttaagtgatcatcaaatgttttgcttttttaataaaagagaggtaaagataaatttttatattacattttccagtaaagttgaaagctcagaaaaaggaaaccatgtgaatgtatcctttacccaccctcattgccttctcagcagctgctctctggaaatgccaaagcatagatttcttatgttttctatgatagttacatttaaaaaccaaaccataaatacactttgcttgcccttttcccacagtgagttgtgtattctgtgggtagtttcttaaagaggaagcatatgtctccttatgtaaatcctgtaatgaaaaatattttttaatattgtctgcataatcctttcggacattgttagtgcccgggctcatttcaggatggatgaaattgtccttttgtgtaaccttttttttctttttttcaataaatcactctaaagggaaatgcaatctcccgtgacctgttgatcagcagacttggtgatcagtggggacttttattcttttccatagtgttggatgccttctccttgggtcttctgagtctgttgtgctgaaaccattatttttggtttcctttgttggctcattctctgcctcccatttgagaggcagtgtagtataattacaagagcgtgtgccctggaattacttcagttttgaatcctggctccaacatttaataaataaaagttaacaaagaggcaagtaaagaaacaggatataaaatgtttcaagtggctaccagaaatggcgatgttcttgtgggttcctgaatatagatgcttttctttctttctttcttttcttttttttgagatggagtctcattctgtcgcccaggctggagtgcagtggcatgttcttggctcactgcaacctccaccttccgggttcaagtgattctcctgcctcagcttcccgagtagctgggactataggcgtgtgccatcatgcctggctaatttttttgtatttttagtagagacggggtttcatcgtgttagccaggatggtctcgatctcctgacctcaggtgatccacccgcctcggcctcccaaagtgctcggattacaggcgtgagccaccgtgcctggccagatacttttctttcttctccacattagccaaggggcttgagaggcaaggggatgggtcaggagacattactgcagaagggtaacttctggcacttcttggatgtgggggatgaaagtgttgagactgtcctttttggccaacctagtgattgcagtgaccttcgagataggcatagagaaggaggaagttggagagatgatgatgctaaagtggttttggccatgctggcttctgacatccagcccttggtagttaatgatttaaagttgtttccaggtgggatgttcctgggcctgaagaagcagtagctctcttctctctagagtggtggtttctcaacagtgcgattttgcctccaggggacatttggcaatatttagagctatttttgcttgtgacacctaggggcagggttatctagggagtagaagccaggaatggtgctaaacttcctaccgtcctcaggatatggttatgcagccccaagtgtcagtggtgttgctgctgagaaaagtgctttagaccctcgagctgaaggactcaaattcttttcatcctaggagcgccccattggctcctcattccagggtgtggtgttgaggaatgggggggtccattctggaccctacccctggcacctaccaggtgcaccctaaagtctgccagtggcatggggactgggatagcagccgtcctgccaggcaggagttgccttcaaggcctgttaagggatatggggtatgtgtgacactgttgtcactttttttgtggaaatgccaagtgtaagaaatctctgttgcatttgacaggtgttgcagttgaggatgtatccattctaatctatgagtgcttttctttctctttttctttttttcaacttgccatggaagatagggaacaggaaattggacttagcaattactgagtggttgtccctactcagatgtcaccttgttaacaagctgctctaactccttaagttctcacccttgacacacacattgttcatgtgtgaagacgctacccacccactcctgatctttgcaatcaggagttaaatttcttacttttactggtggcagggaatttatttgttaaagcaaacaaaagaagatcgcttggtgtcactgggtcgttgagagccacaacatgtatttggaagtgagttgcatccaaggtacccatctttttctttggcagactctggaatggaactttcttgttttgcagcactcatcggtcagtggaggtctgagatggactcattgccctggctggctggctggctggtggctgttcctgcaggacgggagggtgagtgtcagggaggtggctctgattgcagggagacctactagccttagggttgggagaatattccttttgttgctccttccctccagctgtccccctgccctctcttctgttgagagcagtggactctgggtgtaagggcacactcagacacagtaagggctcaaggtcggtgagggagattgttgtcctccgaagatattagtaacagtgagctttgctgaatgagcccagacaaggatgggaggttgagtctttgtggaataccgagtccattcttggaggtgctttccttcagaagcttgggaagccacctgtgtgctgggtagcttacagttcgccataccatctctagaacaagggatgcagcgtgccctccgcatcaagcgagatttgctgcctgatgttcggtgtgttacatatgcaagactcactgagtagaggcactgggttgttctgatatagtttgtgctttgggtgatttagtcccagtattaaactcagcaatctgagctctgaggaggtagaggaataagtaaactgagtttcttctactaaactttcacaacacacttctttttttttgagatggagtcttgctctgtcgcccagcctggagtgcagtggtgtgatctcggctcactgcaagctccgcctcctgggttcacgccattctcttgcctcaggctcccgagtagctgggactgcaggtgcccgctaccacgcccggctaattttttgaatttttagtagagacggggtttcaccgtgttagccaggatggtctcgatctcctgacttcttgatctgcccgcctcggcctcccaaagtgctgggattacaggcgtgagccaccgcgcccagcctcacaacacactgctgacaccagatgttgtggggtgaggggttccccagacaccaggcaagcaatcagttctgcagcagacaccagctgggcgtcccctcattcagttcagttctgacactgtctacccggcgtcagaccccacaggttgagggctcagtcctgtaagtctgctccccatttttgatgatagtcacaagcctcaggttgctgcacctgtgcttctgatcagcagcctgtacatcagggttcccttgatcttctcctgggtttcagttaatttgctggagcagctcacagaactcaagggaacactggcttacgtttactggctagtggtaaaggatatcacaaaggttacccagactactagatgaagaggcgcatagggctaggtgtgtgggaagggtctgggagcttctgtgctctccctaggtgtgccaccctccagaaacccccatgtgtccagctgtccggaagctctgtccttttgggtttttatagaagctttatgacgcaaccatgactgatttctttcactggttactggtcaaccttcagcccctttcctttccctgccttggtctttcctgtgagcagcccccatcctgaaaccacctaggggctaccagccaccagtcaactcatggcatacaagacacttacactttgaagattgcaaggatcttagagttggatgtcagaggacaatgacgctgaccaaatctgtatttcacaataccccacaacccagcctgtcattttcaaatacttcagctcatggaacgcaggtcctcactcccatctaagcccataatctccctttgtattttatgtgcacttcttatgtcattcctctctgcactttattatggccactttctgttatttacaaggtttttctctgattaaactgtttgagagcaggctggcttctattcctttttcaggctgttgagcagttctctatgccaggtgctaggctggactattttctaatatttgttcccttatttaacctcttagctgctttgtggactgatgcttattatctgcatttgtaaaatattaataggaaagtggcttatgaaagccaatcagtaaagctatttcaaaaagaggagaaaaactgaacccgtttaccacctgttagctctgggaccgtgggcaagttctttatctgctccatgcctcgtttcccatgtctgtaagatgggagcattattattattattatttttgaaatggagtcttgctctgtcgccaggctggagtgcaatggcacgatctcagctcgctgcatgcaacctccgcctcccaggttcaagtgattctcctgcctcagcctcccgagttgctaggattacaggcatgcgctaccacgcccagctaatttatgtatttttagtagagacagggtttcaccatgttggtcaggctggtcttcaactcctgacctcatgatccgcccgccttggcctcccaagtgctgggattacaggcgtgagccatcgcgcctggtagggagtgttattagttactcactcacagggtgttttaagaattaagcaagttagtgcgtgtgaagcgtttaggacagaggcctgcacatggtcaatgtgtcagctgttaggattattctccaaggttacgaggcattgggagatcagagcctggtctggattcagaagcccatgtccttgccattgaattccatgtccttctgggcctggcactgtgccttgtcagccacgagggctaaataaatatttgtagcatgaataaatgcatttgaaatttttgatggtggttgttctccaggtgaaatgaatttacttaaaagatggcccctgggcacggtggcttacgcctgtaatcccggcactttgggacgccaaggcgggtggatcacctgaggtcaggagtttgagacaagcttgactgaaaccccatctccactaaaaatacaaaaaattagccgggcctctctccggtccatgcttccaagatgacaaagaaaagaaggaacaatggtcgtgccaaaaagggccgcggccacgtgcagcctattcgctgcactaactgtgcccgatgcgtgcccaaggacaaggccatcaagaaattcgtcattcgaaacatagtggaggccgcagcagtcagggacatgtctgaagcgagcgtcttcgatgcctatgtgcttcccaagctgtatgtgaagttacattactgtctgagttgtgcagttcacagcaaagtagtcaggaatcgatctcgtgaagcccgcaaggaccgaacacccccaccctgatttagaactgcgggtgctgccccatgtcccctaccaaagcccatgtaaggagctgagttcttaaagactgaagacagactattctctggagaaaaataaaatggaaattgtactttaaaaaaaaaaaaattagccgggcctggtggtgggcacctgtaatcccaactacttgggaggctgaggcaggagaatcacttgaatctgagaggtggaggttgcagtgagcccatattgcgcctctgcattccaccctggaaaatctgtctcaaaacaaatttaaaaaaataaaaaataaagaaaataaaaggtaagaacataacttggggtgcatgaaagaagcagaacgctgtgttagacttctggaaaatacttttgtgtaccttagcctgggctgaaaaagcaaacagcttctcaaaatcagacattttaaatgaactcatttctgtgtggaaaatatggcttcatgatggtctggctctagaacgtgccagggaaccaagcagttaggggtgggaatgggaattcctattgccctctctgcatctagaaaacgacaggccgctctgcactggggtagcacagagggcaaggctgtgagtgaatcaggtgcctggtactcattgtagggaagtctaaaagatggcgggtgtcagtaggtaatttaggattttgatgtatttttagggtgtgggtatcacttttattattggtttctataaatgggaactgtagaatctgtaaaaggagtcttctcacctatttaaatgccgtagaggtaagcttggggaagtgagttggacgcgaaaggtgaaggtcattgttaatagggcagggctggtaagagacaaatacgctcttctggcaaagtttccagatgggtggagtttatactgaagttcaccaggttcttgggttgttggaaatcctccttcctgccttctttgctgggcaccaccttgtgtgctgggatggagagtagaaccagcacgggtggtctggcagggagggctggcacctggggacaaaggtacatgcagcaagctgactgacggaggaggggcgcccagcaggccagcgagggcctctgagaggaggtaatgtatgtgaatgccgaagccagaggatgcattggtgttgctggcaaagcaacaggctggggtgagaatgagctcagcctgggtgagagctgagaagagtctcgggagaggggggctgagacaacgctggaggggcaggcaggagccagatcatgcacagtctacaggctgctccggaggaattttgttagaataaaaaagattttaagcaaggggccaggcgtggtggctcatgccaacactttgggaggccgaggtgggtggatcacctcaggtcaggagtttgagaccagcctggccaacatggtgaaacttcgtctctactaaaaatataaaaattagctaggtgtgatggtgggtgcctgtaatcccagctactcgggaggctgaggcaggagaattgtttgaacccacgaggagaaggttgcaatgagccgaggtggcaccattgcactccagcctgggcgacagagcaagactctgtctcaaaaaaaaaaaaacaagatttagggaggtgtgtacttttgggaggatcatgctggttgctagttggcatagaatgaagagggatggggtgggtttgggggactagggagaggaattggacctgggaggtggtgagaacagatggcctggctgctctatccaattgtcaccggatggatcggtcccccgtcttttgaaaagctaatttgcctcttgaaagctgctcacctccctgctgggaggtggtgggaatttacacgtttttctgcagtcagtcttcagacctgtcacattctaggttccagggtagtttttttctctgttcaggcacactacagtgtctaacctgtagcccctgcaaactctaattaaaaacacatttgccttagaccgctgtttctacatctgcaaaactcctctctttccatgatcatgttgaaattatctgagcatggttgggaggcagagagggcagtttttaggtgaaagcacatatttttctgctatttggcatataattaattgtctagttttatttgtcttaactctgaacgaccaataacttaaataaggaaccgacctgtgcaattcagtgttcaagaatttagaaaacattgctgttgaaattgctgtgagttttgtactttaggaaacagatgtgtttttcctccttctcttgatgaaagatatcacagggcaatttttatactaagtttcccagagctgtttaaatctttttttttttttttttttgagacagcatcttgctgtgttgcccaggctggagcgcagtgctgcgatctctgctcactgcaacctctgcctcctgggttcaagcaattctcctgcctcagcctcccaagtagctgggattacaggcacccaccacctctcttggctaatttttgtatttttagtagagttggggtttcaccatgttggccaggttggccctgaactcttgacatcaggtgatccacctgcctcgacctcccagagtgctgggattacaggcgagagccactgcacctggcttaaattattttatacactggacctgtacaatttacattcttgtagcaattctgatttatcacattgttttttgttttttttttttttgaaactgagttttgctcttgttgcccaggcctgctgtggcatgatctcggcttaagctctgcctcccaggttcacgcgattctcctgccttagcctcctgagtagctgggattacaggcacacgccacaacgctctgctaattttttgtatgtttagtagagacgggggtttcaccatgttgggcaagctggtctcgaacttctgacctcaggtgatctgcccgcctccacctcccgaagtgccgggattacaggcgtgagtcatcgcgcccagccacattcttttattatttcagaagtagggaaaaatatttttctgcttgtctcctcaggtgaatgttgaagtaaagtagattaggatgaggcaggttggttgtcactggggaattttgtacattgtttcctaaaatgaggaaaagcaaacataatgaaaacattgcatttgtgtctgttatctttgctcacacgctagcactttttttttttttttttttgagacagagtctggttctgtcacccaggctggagtgcagcggcatgatctcggctcactgcaacctctgcctcccgggcgcaagtgattctcctgcctcagcctcccaagtagctgggattacaggcacccaccgccatgcccagctaatttttgtatttttagtagagacggggtttcaccatgttggccaggtggccaggctcaggtgatctgcccgcctcagcctcccaaagtgctgggattacagacgtgagccaccatgtacttttgcctactgaattacatctctagattttagcatctagaactggtctgtccagtgctttagccactatgactttgtgatatttgggcacttgaaatatggctgttccaagttgagatgtgcagggaacatgcaacacacatcagaatttgacaatggggccaggcatggtggctcacacctgtaatcccagcactttgagaggctgaggtgggtggatcacctgaggtcaggagttcgagaccagcctggccaacatggtgaaaccccgtttctactaaagatacaaaattaaccgggtgtggcgggcccctgtaatcccatctattcgggatgctgaggcaggagaatcgcttgaaccctggaggcggaggttgcagtgaactgagatcacgccactgcactccagcctgggcaataagagtgaaactctgtctcaaaaaaaaaaaaaaaagagaaagaaatttgagaatgggtatggaaaaaagaatgccagttagctcattgatgtgtttttttatgatgacattttgaaacggtaatactttggatctctgggttaaaaaacagaatattaaaagtaatcttacctgtttctttgtagttttttttaatgtgattattagaaaatttaaaattacatatgtggcttgccttatttctgcccagcaactctggttgaaagacgctgacctgggggctcccgaaagctttatccctggggccctgtgagctgcttgtggtcattctcgctgcttttccccaagtagaactgtccatacttggtccagctgctgggaccctcctacctgccagcagtgcttatctcccagcctggggttgatgacagcaagagggcacgcaggcctgcagaccagctctttcttagaacaaaagagttcaaggggttcttgagatgattagggtccgcagagtttgagtaacactcttgaaatgctcaaaagcagttggttggcgagaatggttctgaattctgctagccacttaggcattgtttgctgttgctactttttctaggatactcttgcattttaaacaaacctcttggaggggtttcaacccttttggctctgcccccctacaatcacgctagatcttgtagcccatgacggcacacccgcagggagagctgtcagggtagcctgtaaatggaggccgtggagataagtggatgttgcactagattttcattgtctgttgacaaacctctgtggcatttgcacagagaacaaagagtttagaccgtgggactcaggaggccttccagtttgctggtgttggtgagagagagcagcacatctgcattctgtagaagtctgcaaggaagatttattgccctttgaaaagccaaggtatgcacttcaacacagatttttacgtgggttcatctagggatgcttgtttcaaacaccagtagggcgtacgtctttgcataggtcttggatgtcttggactaggatgctgtggtattttattggagtatctgtggtggcgttgcagagtttctgaatcatgctgataaaggactttttttttttttttttacgaagtgtaaatttcaggcgatatttacttagcaagccagttttgttatgtatacttctgtgggaacttctaaaataatttttaaatggtatcttttaaaatgactggtctttcaactaaacagtttcaaaacaaatacttgaattgcagtgagcattaattattggaataaatcatagccacagaggtgtatataccagcattttgtagtagattactcaggagcaatgcgttgtttccttgacagaaaatttatatgatttccttctttccttccttcctgcctgcctgccttcttccttctgccttcccgtcctccctctctcctttcttttccttctctctctctcccttctcccttccttccttcctttgttcggagctaatgcaagattgttttggaggcagaccaggtttgagaatcaccgaattgatgaatccacagacaagaggtggggaaggcacccttgtgtttttggtaaccacccagaaggccctgacctcaccctctggagcactggctcagtgcaggagtgccctgccaccccactgcaccccagaatcctgggggggctgctaagatccagctcctgtcattccacttctgcacagctggattggtgcctgggtactgtctgattctgctgtaaagacaggggtgagagcctcctttctagaccatttctttcctttttcttttcttttttttgagatggagccttgctttgttgcccaggctggagcgcagtggcacgatctcggctcactgcagcctctgcctcctgggttcaagcagttctgcctcagcctcctgtgtaggtgtgattacaggcatgtgctaccatgcccagctaatttttgtatttttagtagagacagggtttcaccgtgttggccaggctggtctccaactcctgacctccgttgatccacccacctaggcctcccaaagtgctgggattacaggcatgagccaccgtgcctggccaagaccatttctttaaatatagagataaggtctcacagtattgtccaggctggtcttgaattcctgggtttaagcaatcctcccacccctgcctcccaaactgctgggattacaggcttgagccatatcacctaaacacctgagagcttattgggagcttgcctggctactgctgattgtgccttctgagtcctgagattactctgcttgtagtttccttccttccatgaggcttaagaaggagagaaggactccatttttcagagagcagaagcgaggccaggagtgttgaggcggagagggcaggagctggggctgtcgtctgcagtccggttgaggagcagcatgctggcttcccaggggagctcctgccctgctcctccctgcccccgccctgctgtgcggcagggccccccttgcattaaggctttaccactgggggttttgcaagtttattgcacgcatgtccttgcttctagccaggagtttggctttttaccaggtggcagagtgtgtgtgtgtgtgtgtgtgtgtgtgtgtgtgtgtgtgtgtgtgtgtgttgtggtgttggggagggggcggcttacatcatggccagagtatttgggaaggatggatggggtgggagggagatggatggatggggatgctggaatccacccctaggaaattcctttgggtgtctcagtgtcctgctggggaaggagctcttgttgggttgagcctgttgggtgttcttaccattggtcctcaggaggtgagaggcttcctgggaacgagataggggaagcagagggcctttgttctggtctagatggggcgtgtcatccaggggtagtggagaagctgatgaggagccagtaggaactaggaggaactttccttccttggcttcgggcctcagagcctccggtgagctgcctcaccaggacatggctgtatttgatggacagacctcagacgtcagcctcctgggctcggcccattctccattcactgcagcagggtcttcactgcagcccccctgccactgctttgtcccaccccttgattcccctgagggagatcttgggaatttccaaattttgagtgactgaaggcctttcaaactgagaaagaattaaaaatggatccttcaaaatgacttgtctactgtgtggttcttttaaaacataatttgaaaagagtatactgcattgtaaaacagtaattttgcccacattttattggtaagggtggaggtgattttagtccttagtggtttgtagagcttggcgggttagtctgagactgttttttcttgtgctggacaaaggtgaatgtcttcattgtttcattgtgtagagctgttaatagtttatggagggtgattaagtagcgctgcataagccaatttacagtgtgtcttagtctacactggcacttggctaatttgcagaaaattggacctttcaacatggggcttcctccctctactccgtgggggcttctcctattcatccctcagcagtctggcttcccctccaacaccgcaggctccagtcctctgtgtatccccacattagtcctcctggtgtcaagtttcaatgatctgtttgcacttcatccccattggactgcaggcatctgggaatgaggcgtgtcccttactaatctttgcgctggatctctggcacagtatctgtgttgttaaatgcgtcagtggccacctctgctttccatgaagcatttctgattatccactcaccttctttctcagagttagcctctttaatccccacagttcctgggaggtagattgtatttgcttttcctctacattcgatgaggaaatgaaggcccgtggaggttcatttgtccaaggccacatggctaagatgtggtaaagccagggttcctgtccaggcggtttggccccctggatagagccattatcaaaaaccactatccttcggtctagccaggaaaaaaaacttcagacagcccacagaggagggatgtttcacagaatacctgaccagcatttctcaaaaccgtcaaggctatcaaagaaggagcatgacgattacatccaatgtcccagaaggggtcctgggacggaaaaaggacattaggtggaaactggagaactctgaatgaagtgtggcattgagttcatggtaaggtgccagtgtcggttccttagtgtgataaatgtccacattatgtaagatataagaacaggaaccagagtgagaggtgtacagggactccctgtattatctttgcaacttgtctggaaaatctaaaactattctaaaatgaaaagtttacttaacaacttaatgacaatgccaccactaagcccactgcactccactgcctggctggcttgtcacacactctgggtaccctcactcctcgctgcctggtgcccacccactgctggggagaggctgtgtcctcggagaagagtcccctccaatttcagcacgtaacagtgacggagggatataactagggctagtcacagggccatcagaagtgctgcccccacttatttatttatttatttatgtttttagcagtgtagtctgttccaaagtctctgttgaacccaacaggaggtgtaatatggagagaaatgaaaatgaattttgctgtaggagggaaataattttctttttttttttttttttttgagacagagtctcactccctcacccaggctggagtgtggtggcacgatctcagctcaccgcaacctctgcctcccgagttcaagcgattctcccacctcagcctgctgagtagctgggactacaggcatgcaccaccacacctggctaatttttgtattcttagtagagatggagtcttgccatgttggccaggctggtctcaaactcctgatctcaggtgatctgcctgctcagcctctcaaaagtgctgggattacaggcgtgagccatggtgcccagcaggagagaaataattttctatagacaaaatcttagtgtcaagaggaccaaagaggcatttatgtcatttaaatgtttctcatcctcttcagcctccttatcgcttttctgttgggggtagcttgtaattgtaagttcttttttttttttttttttttgagacagagtctcactgtgtcacccaggctggagtgcagtggcgcaatctcggctcactgcaaactccgcctcccaggttcaagccattctcctgcctcagcctcccgagtagctgggactacaggcgcccgccaccacgcccggctaattttttttgtatttttagtagagatggggcttcaccgtgttagccaggatggtcttgatctcctgacctcgtgatctgcccgcctcggcctcccaaagtggtgggattacaggtgtgagccaccgtgcctggcctgtaagttctttttcaatgttttgtgtctggaaagtagctgggctggtaatgttgttggtttggagaaactgtggtgcgttggttgaacgaggcctgtgcattctttggttctgtagcaaggccttgagaggagagttaaattaaagcaatatgagggctgaaagccatctggatgtgacccagtaaggtgccagcagcaagaccccaaatacaggtactgctttgttgggttgaagacctatggcatcttttgtttgtttgtttgtgtttgagataggctctcgctctgtcacccaggctggagtgcagtggcgcagtcttggctcactgtaacttccgcctccttggttcaggagactctctcacctcaaccttccaagtagcttggactataggcgcatgccaccatgcccagctaatttttgaatttttttgtagtgacgggggtctcaccatgttgcccaggctgatcctgaactcctgagttcaagtgacctgccttccttagcctcccacaatgctgggattacagtcgtgagccaccgtgcccggcaaccccatggcttgaagcattttggttagccgtctcatgtgatctttttgtgttatgtatcagataagctaggtgtcaactcattttgtgcagagagatctcaagtaatgaataactgtgctgagctatgggtagaagagctggagcttgagtccctgtcttctaggggagcacccagtgccatttctgtaacctcatactgaaaccttccagcagccctgcctctctctcttggtagcatggtttctgtagatgcatttaccattcaacggagcaataagtctggccctgttctaggtgctgaggattccacagcaagtaaaatccatttctgcctcccataatacaaatgatataaatatgatgtaaatactagtcaaagcactgaaataacttgttttggtgttctagagaaagtatataaaaattagagacatttgtacaggtctcgcttgtgaactgctttctagatgttttctgaaacctgtaacatttgtgtgtgatgaaaatgagagctgatattcctttacttgcaaataatggaaactccacaaaaactagtgcaaactgaaaagaggaccttcttgcatatgtaataaggagggtcaagaatgaagatggtggttgggataacggattccagggagtgaatgaggtcaggtgtgagtctacctatttgtctgcatagttgtctctccctccctgtctcttttaatttgtgatataattcacacatcatgacattcacccatttaaagtatataattcagtggtttttagtatcttcacaagattgtacaaccatcatcactatctaattttatcacattttcctactccagaaaaccccccacaaaactccgtacctgttagcagccactctccattctcccctcctcccagccccgggcaaccaccagtgagctttcttttctcctctcccctccgcctgcccctccttcctccttcctctctctctccttccttccttccttccttccttccttccttccttccttccttccttccttccttccttttctcttctccttttctctctctttcaagacggagtctcactctgtcatccaggctggagtgcaatggcacaatcttgacttcctgcaacctctgcctcctgagttcaagagttcaagcaattctcctgcctcagcctcaagtagctgggattacaggcacctgctaccgcgcctggctaattttctaatgttatgttttagtggagactgggtttcaccacgttagtcaggccggtctctaacacctgacctcatgtgatccgcctgtatcggcctcccaaagtactgggattacagatgtgagccaccgtgcctgaccaactttctgtctctatggatttaacttcttcatataaatggagtcatacaacatgtggtcctttgtgactgccttcttctacttagcatagtgttttctaggctcatccatgttatagcatgtatcagttctctgttcatttttattttattttattttttgagacagagtcttgctctgccgcccaggctggaatgcagtggcatgatcttggctccctgcaacctctgcttctcgggttcaagtgattctcctgtctcagcctccagagtagctggggttacaggcatgtgccaccacacctggctaatttttgtatttttagtggagatagggtttctccgtgttggccaggctggtctcgaactcctgacctcaggtgatctgcctgccccggcctcccaaagttctgggattacaagcgtgagccaccacgtcaaccttatagttgaataatattccattgtatgaatagaccacattaaaaaaaaatccattcactagttgatgaacatgagggttgtttctgctttcaggctattgcacataatgctgctatgaacatttgtgtacaagttttcgtgtggacatatgttttcacgtctctggggtatttacctagcagtggaatttctgggtcatatggttaactctatattttactttttgaggaactgccaaactgttttccacagcagctgcatcatttcacattcttagcagcagtgcacgagggttctagtttctccacattcttgccaacacattatgtgtcattttgattggactaggttatcttttatgtaccttttaatccaggaagtatgattttgtgaaaaaaaatttgttttcgatatgtgatagaaatctgcaaaggaattaattaatatgtatgaaacagaaatgacaaatggctgttttaagtttattttcttcccactgtgttcttgggtcgttcatttttatgaagtaacaacaaactcctgttctgagcatacttgtgtattttttctgaaaacagatggtagccagaacacaactgggattccattaagaaaatcttatcagtttgtttatttgtaggcatttctctccccctctccccacaaaaatgattcttatcaagaggaggaaaggacaataaactgggaaatgggaggtaaggatgtctggtatcagatttcacgcagagtgcaaacatcttgtgctggtcttttattgccctttctgtcctgtacctcctactgcttccaccaagaggagtggaatgcagttcttaaaccagctgttttgttttgtgtgctttaaaaacaggatttcccactagtttttgagagttcttagtgggacagttttatacattttataaaatctgtgtctcctagctccatttacttacttgtctttcttggcttgttctgctgttttctttctttctttccttcctttccttcctttcgtccgcccttccttccttccttccttccttccttccttccttcctgccttccttccttccttctttcttttcttcccttccccttccttctttcctttcctttccttccttctttctgtcagtctttctgtctttcttgatggagtcttgctgtgttgcccaggctggagtatagtggcgtgatctcggctcaccgcaacctccgcctcctgggttcaagcaattctcctgcctcagcctcccgactgcctgggattacaggcacccaccaccatgcttagctaatttttgtatttttaatagagatggggtttcaccatgttggccaggctggttttttttttttttttttaaatttttttaaattttgaggcagggtcttgccctgtcacccaggctggagtgcagaggcacaatcacacctcactgcaacctccgcctcttgggcttaagccatcctcccacctcagcctgctgagtagttgggactacaggcatgtgccaccatgcccagctaatttttatgttttttgcagaaacagggttttgccatattgcccaggctagtctcaaacttctgagctcaaacgatcctcccacctcagcctctcaaaagtgctgggattccaggcatgagtcaccattgcctggcctggcctattgtttatattatgtaattattccctatggaacagagagaacagataggaagggcattagagtgggcatagtttacctctgtgctttttagagccagaactattttatttaattcaaattttactttttttttttaagagatgggggtcttggcttatcttgttcaggctggagtgcagtagcacgatcagagctcactgtatcctcgaacatctgggctcaagggatcctcctgccttagcctcccaactatgggagtatctctggctattttttttttccttttgagacggagtctcgctcttgttgttcaggctggagtgcagtggcgcaatttcggctcaccacaacctctccctcctgggttcaagtagttctcctgcctcagcctcctgagtagctgggattacaggcatgcaccaccacacccagctaattttgtatttttagtagagatggggtttctccatgtttgtcaggctggtcttgagtaattttttaattaaaaaaaatgttgtagagatgaagtctcaccatcttgcctagggtggtcttgaactctgaggctcaagtaatcctcccaccttggactcccaaagtgttgagattacaggtgtgagtcactatgcccagcctagagctagaattattttacatgccgtccactctttcctagtgcctggtatatgattggggagggggtgttaggagatatttggtggaaggatggacttgtggaagtatgagggatggaagaatgggtgagtgggtggaacgatttacagatggatgaattattttaggcatgttggctgattctttaggtccactttctaataaacatatatgtgttggctacataatgatggttaactaatagatggaaaaatttgacttttatttgttgtatcgtcacattcctacaatgtttgaggtactctcagcaatttggagatgtctcatttcttttagtgttaaaaattgtttctgggactatttctggtcactgtagtttaaaagattaactgaaaaggtgttttaaggaattgtgaggaaggtgggggaaatcagattataaaactcaggactgaggccagacatggtggctcacgtctgtaatcccagcactttgggaggctgaggtgggtggatcacctgaggtcaggcgtttgataccagcctggccaacatggtgaaacccagtctctactaaaaatacaaaaattagcccagtgtggtggtgcgcacctgtagccccagctacttgggaggctgaggtaggagaatcacttgaacccagaaggcagagattgcagtaagccgagatcatgccactgcattccagcctgggcggcggagctagactccatctaaaaataataataataataaaactcaggactcaatcagttggcaagttggaacccataactatgggaataaactctttacagaatcacacatttataattgaggcatcctgccatttagcatagttcattttggttttgattttgattggaagtgtgggatggcggtgaatctttgtatcttttcctttggaacattgaccaaagattagtgtattgttggtgataccttttaccgctttcttttcctctccacctcttactatcgtaaacttttcatgttatcctctggatgaaagctgctattcctagtggtgacagagtttgacactgtgggcaggataaggggaaggaatgtgggtgctattcgatccttcccatccggtgcactagagagctgggaaggaccaaaaacatgggacaaattggtctgtgaactttatggtaatgagcacaggcaggcctcagtttacaaccctactgtgttttttttaggtgtgtttattagtatttggaacactgtggtcttcagtggcaatagtgtttttttgtttttgctttgtttttttttttttttttggagatggagtctcgctctggcacccatgctggagtgcagtggcacgatcttggctcactggaacctctgcctccctggttcaagcgattctcatgcttcagactcccaagtagctgagattacaagcccgtgccaccacatccagctaattttggtatttttagtagaggcggggtttcaccatgttgaccaggatggtgtcaaactcctgatctcaagtgatccgccttcctcagcctcccagagtgctgggattacagtcaggagccactgtgcccagccgcagtagtgttacaaatgatcttttagcccataggcaagcttgagaaatgatgatgacgatgatgatgtagctgaaagctataaatagctgaaatatattccttcaaaaaatgtagagcatttcagcaataggccagtctggggagttacccaacacttctggcagcgcctttgagaagaaattatgtcggaattctgaagcacaatgtcaggaacacattttcccctgggattagctctctgatgggcacgggacagttgttcttgcggttgcctatatagagaacaaacgtctataattgttctccagcccaaagaaaaatattacaaactcgggactctcaaaccacacatttccaactttatcaactatgtgctcaccaagtttctctcttgagactcactttattacttttccttcctctgtagttggtcagggtggagctttgacttgccatctccttcagctccgcatcctttgacctgagcctaaaaaccgcctgtgttcctttcagggcctacatggccgtggctgaactgaagctttcctctgtagaattggatgcagttcttcagaaatgattgccagcttcgggtttaaaaccctgtagtctcaagacaaggaattgagtcagagggactcatttagctgtcgtgggtgccctactctgtttgagtactctatggcaaggacctatgaaggccaccgactgctatgggggatgcctgggtgtccagggatgcttggggactggctgctaccacttcaggtcccctgctgagggtggctgtctctgcaggggagaagtcttagatttcaccttccccttcatttctgaatcttagggttgtgccccagctcacagtgctccctcatccttgtggctcgcgttagcgctgcatttgtcatactcattttatacctgtgatgatgccaccaccccccaacccccgccgtttttttttgttgtttttgttgagacagagtcttgccctgttgcctgggctggagtgcagtggtatgatcttggctcactgcaacctctgtcctccgggttcaagtgattctcctgcccagcctcccaagtagctgggattacaggcacccaccactgcgcccagctaattttttgcatttttagtagagacggagtttcatcatgttggccaggctggtcttgaactcctgacctcaggtgatccgcctgccttggcctcccaaagtgcagggattacaggcatgagccactgtgcccggccgatgagcaccttgctttgctcttctctccattcttatctgcacatggctaagttttctgacaagctttgcactggggtttgcaagcatttgggagttgagacagcatctgaggttaaagagcacagtggacaggctgtgtctgcatggttccaataatctgcattaaaagtcggctctcccttaaaaaaaaaaaaaagcagagtggacagagaggaggaagagtgttcttctagcaccactgcccacctgtcggcctctgctcctcttttccttatgtttgtcaaaggatttgaattagactgcagaggctgctttctctattctctgtgtacccggttttaatgataccagaaattaggtctgccccagcgatactttatctgttgggatttttgaagttcatgggatttagacaacagagtctgctttcaattaactaggtcactgacagtgaatggttttgtaaacaccttcagtttggccatggctctagaacactgtattactctagaatagtgattctcaactagaatgatcctgcagtccccaacaaagaatcatctagtccacaatgtcaatagcaccgaggtggagaaacttgtattacaacttcatgttataaaagccacgtgtgctttgatgtgtctttgagtaataagaatcagaaaaaaaaagcatctggtaagttggaaagataactcctacttccaacagaaggaaaaaaaaaaaaagacgaaaacaggagaaaaagtgctgcttaagtccttggtgctcacaacccgtttctgcagttcatcaagaaccaatatccccactccctaggccctacattagagatctcctaaaccaggtgacttcttcactgagtcattgcaggcaaaaagaggaaaactttcttttggctgttgaatttactgcagatttaaatagccatattaatttatcttatgcattacaaagttatttgacctctgtgtctttttattttttatttttattttttggagacagagtctcccaggctggagtgaggtggtgcaatcatggctcacagtaccctttacttcccagcctcaggtgatcctcccacctcagcctcccaagtagctgagaccacaggcatgcaccaccacgcctggcttattttttgcatttttaaaataagagacagggtctctccaggatgcccaggctggtctcaaacttttgggctcgggtaatccgcctgcctcggtctcccagagtgctgggattacaggcatgaggcactgtgccagccctctgcatctttaaaaaggaaaaagcagatcacatttcaagagcaaattttgagtttgtcatgtaggtggccagagaatcctgaactgaggtacttaacataggcgagagaaacagctgtgggagatgagcaggcacagtgccctgttccggggctgagactaagttgtatgtttggctaaagaatgttctctttttcgtgaacctgtaattagaacatgctgtacagaatggtatttaaagtccactgtcatctctttttagggttgtttctctaacttatttttaaacttattttttcaatcagagttcaggaaagaaaatcatttttgaaatcagaagagaaatgtaatagtttttaaaagggcaacaggaggttaaaatttgtgatggtgatactatcctctttatcttaaagcagaggtcagcaactttgtgtgtcaatattttaggccttgtgcagcagcttcactttgccattggagtgggaaggagtcatagataataggtgatgaatgggccagatggggaggtatcaccaagcaggaggccgttggccagggttttatgattttcttccagggaaggggataattgtccacaatgacaccatggtacaatccatcacaacctcatccttagattagcttgggcaagtctcctgcgtggtctgttagcccctctagtctatgttactggagagcagagacttaatgaattcaacatggcccttgaatttcatcattatggggttgtggtggttttgatatgtttctcaacacctctgttgctcagttacagaaatgtgattgggctttcctactctggaatggttaagaatgttcatgtgcatttgagaaatacgtaggctgggaaaacaattttttaaaaatgatggccgggcgcggtggctcacacctgtaatcccagcactttgggaggccgaggcgggtggatcacaaggtcaggagatcaagaccatcctggctaacacggtgaaacctcgtctctactaaaaatacaaaaaattagccaggcgtggtggtgggcacctgtagtcccagctactcaggaggctgaggcaggagaatggcgtgaacctgggaggcagagcttgcagtgagccgagattgcactactgcattccagcctgggtgacagagtgagactccgtctcaaaaaaaaaataaataaataaaaatgatttgatattattgagttataattccatagagagaaattcacccattataggtgcccagtagaatgattttcagcacatgtatataattgtgcagccatcaccacagggcagtgttaggacagatttccacctttttcactcagtcactgtccctcccgcacccagctctgggtagccattcatctattgtctgtgtctatggatttgccttttccagaaacttcatataaacggaaccacacaatatgtagccttttgtatctggcttctttcacttaccatgatgtgtatggtccatctttgttggtgaatgtatcagtgatttttttttttaatttaaataactgaggagtctcattgtatggatttattctgagtatctctataccagttactagacctttgaattgtttccagtatttttgctggtaagaatattgctgctatgaatatttgcacacaagacttaaaaaaatttttttttgagtaaacaactaggagttaaattgttgggacatatatgataagattatgtttagctttttaagaaattgccaaaccattttccaaagcagatgtaccattttacattctcagtttctctacatcctcaccaacatttgataaagtcagccccttttattatatccaggaaatcattgttggcagtagaaaatggaacctctgtgaaccttacgtttgaagaaagggacggtattgcctctctgtcttataggattgctttaaagttcaaagggggataggaatttatgcataagtgctttatattgcagaaacatttctggtgattatgtacagaaaaatttttagccattatattaacactcacatatttgtctcagaaattaagatgcaaacttgtccacgttttaataaaatgtgtatgttatgatcaaacttgttccacctgcttataaaggcaattttttaatcaaattgtgagccttttccatatgctaggttgcctatataatgtattaaattatcagccttatttaacaatgactgaatgtaatagtttgcatacggtgggcaaatttttctttcccactccaacttagatggtctggtaaatgtctgcctgtgactttgttttcaaatgcttgtgggtggcctctttcggacctgggcacatgtgttctaatagagtggaagtagaaagattggggtctcagagaaagcaccaggaacaatctatgtaaaaaatacctatttcagcagtttaactttgcaattccgattctatgaaaattgccagttaatactttttcaaagaacaaagggggtgttttgaatgcatttcccttcccacctgtggaagacagctgtttgtgatagacctaggaaaactggccaatgggctgtggatttgaaatctgggctggattttgtaaaagttgcttatcagcagttcttcacacctgttggagaagacctttggactgcaggagctgaactgtgtatttgatcataaagcactgtgtcaacaaagggcttttgtagtactttcaaacgaaagggtaaagagacccacagtgagatgctaagtcaaagaaactgcacgctggagtgaaaaaatatgttctggatggcctgtggaagccaaaagggtacatattaatcctgctgacagtttatattaatttgataatgttgcataatctcaatttcattcttactaaatagacaattttgattgggaaacaggtgtgtgaaatcctttttaatgaaaacaatgctagtgatggtcacaatacacagaaagctttggactaggggttctgggttggagttacactgggagttattgtttcctgattttaacctaatgagtaaaagttcttgccttatatcactttgaacattttcattgctgcgagcatgggcgtgtatgtgtgttgggaggtgtatatttaaaagctttcaaatattgcagtccctgacatgtgaattaaagagaggccgaaaaaagtcatcaggcacttgaaatctttttctagaatgttacaaataatgtggcttgggtatggagtgatatttgagagaccagcgtcgtagcagatgcctgaagtcagtgttctttttggaagcagctgtttgctaataaagaaatcaggactgacaggcagttgttaagtctcattcttcatgtgtgttatcagtgtctcaggctgaagcaagagtagggggtgagggacttgtgtgcaaataggtactggcccctgttggtgctgtgtgttctttacataggcaggcctcaggatttatataggagcacttaatattcatttttgatgctattttccatctttatagcagaggatttaaactcctgtttggagcatctttgaagatctatgaatggagtaaacaacttagaatctccatagcatgtaccagggaaatgagtgcctatggggagggcctcttatagataaggtcacaataggggatactaggagagtcgtataactctccggggaactctgtgagttggtcagtggggaaaggagtctgttccacctcaatattgggatctccagccactgtgattttagaaatgtttgtagaacctccttctggggattcctgttggcccgccccagattcattcatcaaacaaagagtgacaactatggatcccgagtaacagttaacatttgaggtcctggcttgtggattttatttacttatttatttattttttgagatagagtttactctgtcacccaggctggagcgtagtggcacgatctcaattcagtgtaacctctgcctcctggtttcaagcaattctcctgcctcagcctcctgagaagctgggattacaggcatgcgccaccatgtctggctaagttttgtacttttttggtagacacgcggttttaccacgttggccaggctggtctcaaactcctgacctcaagtgatctacccatctcggccttcgaaagtgctgggattataggcgtgagccaccacgtccggcctctggctcgtggattttaaacagtgttatcatgggcactgagggaatggagtaacctttacgtcagattttgtgtcgtcttaaatgttccttcctaggaagatgagagagaacaaatagttacgtgtgataacaggccatttaaggtgactctgtgttgttagattttaattgctggctgatttatgagtgcctttgatttatttatgaattattttcaggagacaagtggagtcagtgtgatgtgtgggaagagcatggggttaggaatttggagagacctgcctaggtcactagctgtgtggcactgggcaaagtcttaagctccaagctgcaatttcctcttggaattgagaggattcctagtttacagaaggttagtattcaatataatgtcattgagacttcttagcacatgaccctgatatatctggggcactcctttactggaggtgactatgtttgctattgattggcaccatttaaagtagcgtaaaatgaggagtttactggtgtgtcatttatcccctgccaactctgtgtttaaagagcagtactacctccttgaactagaagtggaacataccataaccagcatatttcaaatatttaacaaaacagaaataaatgaaatgaggtagaaaattctagaaaaggagttgttcagttaaagtgctattttaggaagggagggagggagaaaaaaatcaagtgctatgtcaagtgataattttgttctatttccacttgaatacattgattcataaggatgtgcttggtgtcatttttgttggaattgaaattgttgagcagagtagaaaaagtttaatgagatactgaagctcagtgttgcattccatcatatgggtaaacgtcataaaagtaattctttttttttcttttttttttttaaatttcattagtttttggggggacaggtggtgtttagttacatggatatgttattcagtggtgatttctgagattctggcgcacccatcacccgaacagtgtccactgtacctgttgtgtagtcttttatccttcgccaccctcccacccttctccctgagtccccaaagtccatcatgtcattcttatgcctttgcatcctcatagcttagctcccacttataagcgagaacgtatgttgtttggttttccattcttgagtgacttcactagaatcatggtctccagctccatccacgttgttgtgaatgccattatttcattcctttttatggctgagtagtattcatgaaggtaattctttgaccagtgaacacccagtaattcctccaaactttatcacttgtgtttgaaaaagtttcatgtgattaaatcaaaggaagatgaaattgagccttgaaaaagctcaatatgatatttcatttgtccagtggggaaataaataagtggaaatgagatcaatgccaaaaaatgtgcccaagatttaaaacgtgggatctggaagttgccatcttttaagatacaatcctgaactttgaagttcattaggtgtctcatgtaatcctaacaaaatttgtgctggtggactgagttctgataaatattagaaacttcagttcctcttttggagagtccagtttacacatggattttggtataagtaggagtcaagggagtggtctaatgtcctccaagtgggcaagtgtaccggactttgacctaagagaatgggagccattagtttctgaagagttctcaaagagggtgaaggcttgttgagacctagttaaacttccggtttctggagcccaactgcctgtcatgcactcgctcagtctttgtgatgctgggcaagttagtttacctctaggcctctggttctccatctgtaaaatgggaatggtcatagtgcctgcttcatcatctcaaatgacgtaatccacctaaatcagttgcatggtgagaacacaggggctagctactattttcttagtccctctttgccttctatgtctgatgggactctcagtcacacttgtggatagtaaagcctgtggatgatgctttgcgaagatttgttctttgcttgagaaagacatttacttttcaagaagattttttttaaaggaatataggagttagggtaatttcgacagtacagtttcgccacaaaatgcaatccaaactcagttcagtcttgtttgttttgtttacagggaacacgggtctggctgagagaaaatggccagcattttccaagtactgtaaattcctgtgcagaaggcatcgtcgtcttccggacagactatggtcaggtgagaacaagtccctgcagcttcccaacatccatggtctgctttgtagctattcgtgcccagggcatgtgtgcttggcccccctacacatacacacgctttacatttttttcctaagtgataattcaaaatcccagtgggaatgtagaatgtaaaccatgtgtgtgtaatagatacaatacagttctctcaaatggaacacagcaaatattccaactagtgtggggacagaagggcatggcactggcctggtttccctcctgggtatcttttctgccttctttcatctttttcagctatcagaagtagaggatgcaagtaatttgagcaaaagttcaagtatatgatatttgctgactgattaacttgttactttctcttaaaattcttaaactttcgtagtgtcttagtcagtttgggctgccatgacagaataccatagactgagtgatttatgaagagcaaatatcgatgtcacagttctggagcctggagagtccaaggccatcaagatgctggcagttgtgtgtcttgtgaggcctctgctcactggttcatagccagccagcttcttgctgggcctcacattgtagaagggggagttctcttgggcctcttttataagggcactaatcccattcatgaaggctgcaccttcatgaccaagtcacctgccaaagaccctaacagcactgcatgggagattaggaattcaacatattaatttggggggagaatacaaacattcagttcaggctgggcacagtggctcacgcctgtaatcccagcactttgggaggccgagtcggacagatcacttgaggtccttagttcaagaccagcctggccaacatggtgaaaccccgtctctactaaaaatacaaaaattaaccagctgtggtggcaggcacctgtaatcccagctaattggggggctgaggcagaagaattgcttcaacctgcgaggcggaggttgcagtgagccgagattgcaccactgcactcaggtctgggtgacagagcaagactccttctcagaaaacaaaccagttaatcacaaatagagtgttgaaaatactaggatcccactgagaatttagggtaatgttgtcctgatcactgtaagaagaagactgactaaatcactgaagctgagcctatttatctaccttgttaagcaactgaagaagtttctcctgtttataggagcaccactgttcctgattttgtttctttagtgtaaaatgaatgaaaagtcctatcactaaaattaaatatgtaaatccaaaaactggtttgcttgattatattctgatgattataagagaaacctggcacgtccattttactaaggaaactaatttaatgttataaattggcctctacctcagaggtacatattaaaatttaagacttaaggaaataaaagatagtcaaatgcaaggatctaaaacacatagtttatgtttttatttttatttatttttttattttctgagatggattcttgctctgttgcccagcctggagtgcagtggtaccatcttggttcactgtaaccttcgcctcctgggttcaagtgagtctcctgcctcagcctcctgagtagctgacattacaggtgcctgccaccacacccaactaatttttgtatttttagtagagatggggtttcatttcaccatgttggccaggctggtcttgaactcctgacctcgagtgatctgcccaccttggcctcccaaagtgagccaccatccctggccaaaaccacatagtttatgaattgagtttgtaagttgttgtgttgagaataaaagcttcagggccagtttccataatttgaggcagacgggctacttggttatcaaaacttcttagcaggggcggtctacttggtggaaccattcttagttcttgatttgataagctgtagttaatactgtgtttgtaactccttcatttctttttcttctgagagtcttgaatggattttcagtatatagatataactgtgctttgtggatgtagatttcagggtatggggagagagggggaacaaagagacagcatgtctaatggtcactgacagtgtggacacttcaccaacacccagtctagttccttctccatcagagtctcgggtagtatagtatgatctgtagtctagggagtaaataagtgaattttgctcaactttagtatcaggcactgcttaaatgtttaagtttccctgtaggataggactggccacatttttctgtcactccgcctgtcttctgtctcagtttccccagatgagaatttggtttctttcaggacctgtacatacttctcaagatgatgtgaaaagggaaaacaatatctaaacagtgtcattcgtttaacaaaactgtgttcctgaaagcgttgtaaaataggtttttcatggcacttgatatggtttggctgtgtccccacccaaatatcaacttgaattgtatctctcagaattcccatgtgttgtgggagggacccagggggaggtaattgaatcacgggggctagtctttcccatgctattcttgtgatagcaaataagtctcatgagatctgatgggtttatcaggggtttccgcttttgcttcttcctcatttgccgcctccacgtaagaagttccttttgcctcccgccatgattctgaggcctcccaagccatgtggaactgtaagtccaattaaacctcattttcttcccagttgtgaaaatggactaatacagtaaattggtaccaggcatggatacttgctggaaagatacccgaaaatgtggaagcaactttggaactgggtaacaggcagaggttggaacagtttggaggtctcagaagaagacaggaaaatgtggggaagttttgaacttcctcaagacctgttgaatagcattgacagaaatactgataaaaatatggatgatgaaatccaggctgagatagtctcagatggagatgaggagcttgttgggaactggagcagaggtgactcttgttatattttagcaaagagactgttggcattttgcacctgccttagagatttctggaacttcaaacttgagagagatgatttagggcatctggtggaagaaatttctaagcagcaaagcattcaagaggtgatgtgggggctgttaaaggcattcagttttataagggaagcgagcataacggtttggaaattttgcagcctgactatgtgatagaaaagaaaccccccccccccccgcttttttttttagatggagtcttgctctgtcgcccaggctggagtgcagtggcgcgatctcggctcactgcaagctctacgtcccgggttcacaccattctcctgcctcagcctcctgagtagctgggactacaggcgcctgccaccatgcccagctaattttttgtgtttttagtagagatggggtttcaccgtgttagccaggatggtctcgatctgctgaccttgtgatccacccacgttggcctcccaaagtgttgggattacaggcgtgagccaccatgcccagtcgaaaatcccattttctggggagaaattcaagctggctgcagaaatttgcataagtagcaaggagcctaatgttaatccctaagaccatggggaaaatgtctccaggccatatcagagaccttcacggcagcccctcccatcacagtcccagaggcccaggaggaaaaatggtttagtgggccgggcccaggtccctgtgctgtgtgcagcctagggacttggtgccctgtctcccagccactccacactccagccgtggctgaaagaggccaatgtacagctcaggctgtggcttcagagggtagaatccccaagccttggcagcttccacgtgttgttgagtctgcaggtgcacagaagaattgaggtttgggaacctctgcctagatttcagaagatgtgtggaaatgcctgaatgcccaggcagaagtttgctgcaggggtggggccctcatggagaacctttgctagggcagtgtggaagggaaatgttggttggaacccccacacagagtcgctactggggtaccgcctagtggagctgtgagaagagggccactgtcctccagtccgcagaatggtagatccactgacagcttgcactgtgcacctggaaaagctgcagacactcaacgccagcccatgaaagcagctgggagagaggcagtaccctgcaaagccacaggggtggagctacccaagaccatgggaacccacttcttacagcagtgtgacctggatgtgagacctggagtcaaaggagataattgtggagctttaaaatttgccccactggatttcagacttgtctgtgccctgtaacctctttgttttggccaatttctcctatttggaatggctttatttacccaatacctgtaccctcattatatctaggaagtaattagcttgcttttgaatttacaggctcataggtggaagggacttgccttgtctcagatgagactttggactgtggacttctgggttaatgctgaaatgagttaagactttgggggaccattgggaaggcatgattggttttgaaatgtgaggacatgagatttggaggggtcagggatgaaatgatatggtttgcctgtgtccctacccaaatctcaacttggattgtatctcccagaattcccatatgctgtggaagggacccagaggggaggtaattgaatcatgggggccagtctttcctgtactattcttgtgatagtgaaaaagtctcacaagatctgatgagtttatcaggggtttctgcttttgcttcctcattttctcttgccaccaccatgtaagaagtgcctttcgcttcctgccatgattctgaggagccatgtggaactgtaagtccaattaaacctctttttcttcccagtcttgggtatgtctttatcagcagcatgaaaacagactaatatagcattctttccctttcttattgaattatattttaatcccaaagatgttttccttttagtcttttaacttttttcttttttaaaaaaattatggtaagaatcacataacattaactttaccatcttaactatttttaagggtactagggttaagtttattcacattgttgtgtggcagatctcaagaatgttttcatcttgcagcactgaaactctatgcccactaatcactaattcctctagcccttggtaactgctcttctttctgttcctatgactttgattactttaaatacttcagtgagtggactcatacagtatatgtgcttttgtggctggtttatttcacttagcatgatgtccctaaggctctcaagatactttttattcctattctaactaagctttctgacaaaggctcctagctcaacagctctaccagtctctgggtgccactgcccttgacttgtggtcggcagtctgggccatgtgaagcccttgccagctgttgtccatgggcagctcttagtgaggtgggagtggaatggattggttgggtcagtagttctgatcattttcaacagtatttatgggttgtgggtttggaaggaactgaactatgataatgtgtacttaaatgtgaaaacaacgctgagccttgacctctaatcttcatttggtcatcgaatgcttagttttatgttgtccactctgtcattcccaaatataacaagtataattagcttggtgactcatgtaggaattgcggggttatgagaaaagtgaggcaagatttttaaaattggattcaggcttggatcaagaactgtcagtggcccaaagactctagtttgtttttctactgacctacatagtcttcccctctttacgttacaagttcactgtggaacatgcaggaatcgtcgccaagcattaggagaagttctttaactggttctggtgcctaggacaggaacactgcacttaactggccagggatagattttttttttttcgagacaggattttgctcagttacccagtcttgaatgcagtggcatgaccatggctcactgtagcctccacttcctgggctcaagtgatcctcccacctcagcttccctagtagctgggaccacgggcacatgccaccactcctgactcattttttgtagagatggggttttgccatgttgttcagactggtctccagctcctgagctcaagcgatctgcctgccttggcctcccaaagtgctgggattacaggcatgagccactgtgctgggccaggcatagattcttgaaggagtcagagtcaaaagtttagagcatggtcttgtccttgatcaagcctgtccttggttactttaaaggaaattggttaattttgacccagcttggtatgttaagatattggtatttctgagaggaggggagatttggacattactgtttaatggggatattgtttcagttttggaagatgaaacgtttggaagatggatgatggtgatggttgcacaacactgtaattgtacttcatgccactagactgtgcactaaaacatgcttaagctgaaacattttatgttagcatatatgtaaacacacacacaacagaggaaataccatgtttgaggtcagatggtgggtaaatggtagaaattgtcaaatgacaatttgtctatatctttaaaaacaatttcagagaattttttttgtgtgtgtgtgactgagttttgctcttgttgtccaggctggagtgcaatggcgcgatctcggcttactgcagcctccgcctcctgggttcaagtgattctcctgcctcagcctcctgagtagctgggattacaggcgcatgccaccatgcccggctaattttgtatttttagtagagatgggctttctccatgttggtcgggctggtctccaactcccaacctcagatgattcacccgccttggccacccaaagtgctgggattacaggtgtgagtcaccgtgcctgctgcgaaatttttattttacccaaaggtgacctcttagaatccacaaagagtttacaaaactattagtgtaattttcctttgatttagagtggtgcatacgaatcacctgtggatcttgttaaaatgcagattctgacaggcaggttggggtggggctggagagcgggctgaatttttcacaagctccttggtgatattatgttgctggaccaaccacattggagtagtaaggattttgaagacgttcctgaaaaatgccttagggtcataattacttaaaatgaagagcaagaagcactcaagcccttccgtattccaccagtattagtgttttggaggaagcaaagataaagcaaagaaggagggctttgggtaaagttagaaggttttttcttgcacttcgaagcttttcctttcctttttattctctgagccctcccctccagcggccaggagttgggctgactgcggcatcataattctcaggtgaattaaaaagcaattttaaaatcctgtttagtgttggagaaaaagcagagccatgtgtgtctaaaatcctaaaatggaacctcagaaacacggggtgtcaggagatcacagtgtattgtttcgtgtgagatcactaaagggcacacctgcctgcttcctttccttttcttttttcccctccccctccccctcccccttccccttcccttcctttctccttctgtttttattaagttattattattattatagttttttgaaatggagtcttgctcttttgccccagctggagtgcagtggtgtaatctcagctcactgcaacctttgtctcctgcgttcaagcgattcttctgcctcagcctcctacgtagctgggattagaggcatgcgtcagcacgcccggctaatttttgtatttttagtagagatgcgcttttgccatgttggctaggctggccttgaactcctgacctcaggtgatccacctgccttggcttcccaaagtgctgggattacaggcgtgaactaccacgtccggccaccttctgtttttagcgacagggtcttgctctgtcatctaggctggggtgcagtggtccagtcgtagctcattgtaactcctgggcttgagtgatccttctgtctcagtctcctgagtagctaggactacaggggtgcaccatgcctgaaaaattttttctggaggtggcgtcttactgtgttacccaggctggtctggaactcctggcctcaggtgacctgactcagtctttgaaagcaataggcctgggcacggtggtgcacgcctgtaatcccagcactttgggaggccgaggtgggtggatcatgaggtcaggagatcgagaccatcctggctaacatgctgaaaccttgtctctactaaaaatacaaaaaaaaaaaaaaaaaaaaattagccgggtgtggtggtgggtgcctgtagtcccagctactcaggaggctgaggcaggagaatggcgtgaacctgggagacggagcttgcagtgagccgcaatggcgccactgcactccacgctgggcgacagagcgagactctgtctgaaaacaaaaaacaaaaaacaaagcagtaggattacaggtgtgagccactgcccaacccatgctttcttatttcattcagtctttaaggaattttgtttttttgttgtttgtttttgccaaggagatcgttctaatgttaatttaaaatttcattccactctaaaatttaaactactataggttgatactaggaatacagagaaccaaagtattccatttgacttgtaacttatacttgctgtgaagtatttacagatggaaaaagaaatgagcaaatgacactctttcacactttattgaaaaatatgtaactgtggcctctgaaggccccagcacacaggcgggtcagcacatatcctgcaagttagaaatcagttgtcttcttggaccacaggctttggacagagtttcagaaaagcagaatttttttttttttttgagacggagtcttgctctgtcacccaggctgcagtgcagtggcgcgatcttggcttgctgcaaacctccgcctcccgggttcaagcgattctcctgcctcagcctcccgagtggctgggactacaggcaggtgccaccacgcctggctaattttatgtatttttagtagaggcggggtttcaccgtgttagccaggatggtcttgatctcctgaccttgtgatctgcctgccttggcctcccaaagtgctgggattacagacatgagccaccgtgcccagctgaagagcagatttttaaaagcaccatggttctgcaggtgatcaactcatgtaaaagggtaagaaggaagacagcactaaacgtttgtcttttctggaacatccaggaggtgcacgagcagtcactgtagcactctttaggaacattgtaaaattgattaataagttttaaattagatttttcaccttggtgattagaactattttattatctttttctggaaagagtctaatttgattgctctgaaatagtttagagtgatatcagtttatctaattgtattttaaggggtagttattcagtttactgcagcccatttcatcaaggcgattactctgtgcagggattccgtttggtattctgtttgaattgtctctctatagggtcttccaaaatattcactagttgaggatttaatcatccaaatctgcaagtagacaacctcctccatgtccttctctctatttgcaacaaggataactaagcttggttgaaaaaattcttctcattttattaatccactaaaagatcatgggattgcatgggactttcaagtcattcccacctgctaagagagtcagacttcttcaagccacactgggaacacagcactaattatttataatcacagctcccacttaaagcaatcgcagctcccacttaaagccgtctctgactttttggtttgactctctggttttggtttgttggagttaatgccatcggcccaattttgtgaaacttggtaagaggtgagttaatgtagtgacttctcattgcatttttggttgttttcacacactttccaccctgtccagctggttttcttttgctcccccctccccttccctttgcccctattggtgtcgtttttatgtcccttgaatgccttgtggatgtaggcgaccttttgaccttttcacaccctcctgttcagtacaccatctgcacacactcctgtctcccagaaaaatcttccgcaagcctgttgaatgcaggaaaatggtcagtaggggacagcctggcgggtctgtcctttggagctgaccccaggaattattaggaagaattgggcaactagaacccagtgacttcaacttgaggaggaccgatctgagtgctgaagggaagtggcagatctagacatctgagccaagggaaaaatcttatctgagagcccaggaaggcccacacgttccagcagctagggaagctgcattccaggcttctcacgcaaagccagctgctgtgccaaggcagctgcccgggtgcgcaggagcacggtcccactgctcactgtgaactctttccttgtatgtggagcccgagggagactgagtgagtggcagctggcccgctctccaggtcgggcagctggcaggaggggaccacctggggtccgggagggcagctccaggttcccgggaagagcggctgtgggtggagaccagcagggaggcagtaaatgcgtgaggttggaggaaaaggcagttgggggccacatttataatgcaaacatagtgtggttaggatctaatgactctcaaaaccaaactcagggacagatagggttagattcttttcagtcagctggcctggacataattcccttgcttttttgtcttttttttttaaatgtatatttttatcttcatcataaagtggagacatcttacccctttttctctcaagaggaaagaaacaggaggtcatttgcatcatggctgtagcccctgagtcttacatgtctcttgtattgcaactgctgcctccaacccaattaacctctgggttcctgtgaaccatatgaaattgccgtttctagaggccataaagggttagagatcggcaatcacatatggttcagcctaatagcaagttaatggccctccattttaatgtggtatcttttagcttatcattgatctgttgttcatggctcaaagataggatttttctggtgactcttctgtctgatgacagtatggctcaacaaaatacaaatgtttttccgcagtccagttgagaggcaaagcgtatccctaaaatagtctgccagctttaacgctggtgccgttgcgtatgtgcatttgctcacagctgtaacatttgtattccttttggggttttcactttttctgctgggtgtctgaaggatttgctattactagtttcttcggcaaatacccacgtttgaattgaaaggaaaatgaataaatacacaattttttttggactagagcttgggttttcctctattgttttgtgtgtgtgtgtgtgtgtgtgtgtgtgtgtgtgtgtgtgtgtgtttgggtaaataaatatgacataaaacttaccatttaattttaacaattttaaatgtattagtggcagtaatcacatttataatgtcgtgttatcacaccatttccaaaactttttcatcactccaaacaaaaactccgagcctgttaagcaataactccgtttgttatttattttttactattattattattattattattatcgagacggagtctaactctgtcacccaggctagagtgtagtggtgcgatcttggctcactgcaacctccacctcctgggttcaagcaagtctcctgtctaagcctcccgagtagctgggactacagacgcctgccaccacgcccggctaatttttgtatttttaggagagacggggtttcaccatattggtcacgctggtcttgaactcctgacctcaggtgatccacccacctcggcctcccaaagtgctgggattacaggcattgtaatttatttttaaactgctttcctcttggataccttttttgtactgttttacaaaataatagcacattcgaaagtatggtttgtatcttttcttaagaaatagacaacgtcaagaaagatttgttgagactcagccccagattctaggaatggagaatccgatagcccagcttagatctgctgaggatgccagaccgctgagccctggccacgtgctatgaatatcggggtgggtgggctatccctgcatgcgggtgaagggtccttctctggaggaaggtgggttgcacagccaccctaaaagtaaagggaaagaggactgtgctagtgataagtgacagataattttttaaaatccgatgtatagtttttggcttcttttttttttgaaactttaatagtgctccatctgttattcttggaattcacttcaatcaaaacagttgcagctgtatgaaaaagacagcattgagctgggaagctcttcaattctctgtgcttttcccacattttgctgttgctcctggaaatacccacctctgagatggacactaaacaccagcctacagagttccttaaaatcagcggtctatactccagagattgaacaccactgggactttcattcttgctttcaagaccaaggaaaatgcaacttgtccagcttaacttggttttgagtttaagaatcttttctgctctggaagccacgtggttctgactccctagacctcttccaagaatttgctttggcattttgtggctcaaagatggaaagtcagatgtttccattaattttcactctgggattatagaaagaaaaaaaactcgtctgcttgtttattagcgcacttagctccaggctaaacatgtgcatgtttacaaatctgcacagaaagctcatttattgtaatctgggagactctcactcaagcaggccacgctcttgtcctttctcctgggaacctggttcctacagagatgtctgtctcttctgccttccttcagggataaatgcacgaacgcaaatatgcaggctctagctgaatacacaaggctctgaatacaaggtgtgtattcacacacctattcaggccccctttcaaagagccaccacctgtatcatgtgtgtgtgttagatttttttctgtctctcctcaccaaggtctcttagaatggggacttgtcatcagcacctcggagccgagcctggcccagagaggccccttataatgaacactgaatggatgaatgaagctccatttgtaatcagcatgaagccaaataagtcatcagaatggcgcatgcttcattaagactgtgatcatatggcattttcataaggaagttacaagtcttaaaaggaccacaagtgacaaaaaaaaaaaaaaaaaatagccacatagcagaagaatcatggtgggagtttttgtttgtttggttttggagacaggttctcactttgtcacccaggctagagtgcagtggtacaatcttggctcgctgcaacctccgcctcccaggctaaagcaatccccccacctcagtctgccaagtagctgggactgcaggtgtgtgccaccaagcctggctaatttttgtatattttgtagtgatgaagttttgccttgttgcccaggctggtcacgaactcctgagctgcaatgatcctcctgtcttggcctcccaaagtaatgggattacaggcatgagccaccgcacctggcccggagtttcactgttgtttctactctggtagtgtgtaaaccactcaggccctagggccagaatgaaatgaagagggtagaagagaggctttttcaagggaattctttgacttagtaactctagaaacatattctgttttcatctctcggggtgagtgttgagtttggctcagaatcttattttaaagtatggcattgtaaaccctgagattgttgtttgtatatttcaacagtcatattgaaaccatttacagtggcaaacattatgagctacgtttgtgttataggaatgtgggctatgtgaggtgttgtagaccttagcttgccaaaggtacacagcatttctgttctgttacccaccttgttcccagcaccactgaaaaatccatgggtgagaccaggaggtctctggggcctggcccctttaagtgaatccagcttatttctgaccctttttcctagaacatggcttttgccttcccaccccagcccctttggactgaacagctgggcttctccccagtgggtgggtggatgggtggggaggggatcagatctgttaggactatttactggcccagcgaggttctagccgaatgcacatgcattaaatattttgcaagggagagcaaatggcctgtgccctgggtcgtgaccttctttggtttcctgttctcctttgggtccatttgttgattttcttcttagtggatcttcctagactttggcctcctttttcctccctgggtctgtagactacacctcttcttcccaacccttagaatctgtctgtttatctggactcaagcatgcctctgaccggcctatccttccagtctttgtttgacttccagattccagactcagcttctaggtagctcagcccccttagtcctgtgtaagcctgttgtatgtccagatttttcccatgactggcaagcctcctggtcttgcagtgctggtgttgggcacaaagaaaagggctcatgtttggtgctattgacccctgtggttgctttcgattttgtggttagctttgaaaatttaaattgaaggtaagtgggctactgtcttgtatttttggtccctgtgaatactgaaaataatccgctaattaatactggatgctaagctccgaccaggcagtaatttgtgactggaataaaatagaaaacggacggaatcaaacgtaattcttttatttgaatgcttaaataaatactatgcttttgttgtataataaaattatatttattttaacaaagtcatattttgtgaaaaatgcgaaggccttgtttgggaacaaaaaacagttcagaaattatccctgggaatcagacagcatcatttaatgccggtgtgatttcagaagagaaatcagaggcagtttgttcaatacaggcaattgtctgtctgtgaatgagttgcattccgtttcaaaaatgcattttttaggcctgttatttggaacaagtctttccaaatagtaatatacatggtgaattgatcatccagctggtctgcaaagacctatccaggcatccacagtgcactgagggcagggatgatgctgaagccctcttgttgcctcattccaactttaaacgtgtgtttggagttccaacccagggtgccacagttctgacattagggaatcccattcttcccgtggtcccctttctgctgagtggtgggaagaggggcacccagttctaagccatgacctcctcatagttggtgaggatgagggccttatcagggttggcatttcggatgggtaaaggggagagattgagatttgctgggtgacatctctccagcaggcaccatgctggtacatgccaatctgtttgtcctgtttaattcctgtaagtatcccatgaggaaggcaatattaaccagccatattttaatgagatggcaattgagcctaggtgtaataacacgtccaggagtccacacctggctagtggggagtgatagtattggggtttgcatccagagtttatcatctttccactttttcaccttagttctccaagacggagtgagactggtaatgggagttggtgtctttgctgtgttcacttcttttctctgcaggccccagggattaagtgtacctgtcctccgctttcttgcaatgacatttatgctttctcttgaagttactttttaagattggaaggttctcatgccacttctcacttacccctactttgcaatagctttttttctttttttgagatggagtttcactcttgttgcccaggctggagtgccatggcgcgatctcagctcactgcaacctccgcctcctgggttcaagtgattctcctgcctcagcctcccaggtagctgggattacaggtgcctgcccaccatgccttgctaatttttttatttttatttttgtagagacaggatttcactacgttggccaggctggtctcgaacccctgacctcaggtaatccacttgcctcggcctcccaaagtgctgggattacaggcatgagccactgcgcctggctgctttttttcttcactttttttttttttattgctgtagggaaatggaagggccaatttaaagaaaaaaaaaaatgttccctagtcttgtattcacaatctcagcttccacgctgcgcccttgacagggtggttctcaaccctgactgcacgtaataattcactgggaagcttctaccaagggccttggctctgcctcagaataatgaaatcagaatctcaggtgagactcaggccatggtatgttttttaaaagcctcctgggtgctgtttaatgagcaaccaggttcagaactatttcatagatgaaatggccatcgtatcaaaataattgccttaaaaaattgttgtgaaagcacacttttgcaagctgggcttagaaagtgctaacgaggcctttgtttttcctaggtagtaatcagctcctttttggccatcctttcttagctggttctgtagaatgtcttcggtgcttgcgttgatttggaatagctccctctctccatccgtccatccacccctccacccacccatcgttcatcacgggccctcatctgtcagaggccctggagttcatccgttgactctcttaagagcctctgcttactcttgattttcccatctcttccttccttctcccatcctctcaagttgaacactctgttagaggaggacatttgggtttaagtgtcccagatactaacggagtgtctctgcaagtgcgtttctctgaccagctgcttcataaccactggggcctttgttaaaaatgcagggttttttgactcatttcaaaattgcctgaatccatttctcagtaaatatgggcctgggatctgcatttaacgagttgcccgaatgattttattcacactgaaattagagaaccactgactcagtgggtactttgatctgagatcaattggaaagtctttcttcttcctcttctcactgtgtcccctaccccaaactttccacttatttgctatttacttccagtcgagctacttcctgccctgtgggtgtaggggctatgggaggaggggctggcctttctgatggtataaatctccagagacatttgtttctctcatttttctccccctttcttatggccctgccctcttttctttttgtgtctaaaacagaacccagtgattggccgcttcttccacgttgtgagttaatagtgtgcaggtttttctaatttgtagagaaatcccactgataaagcagcttcctgaaatatcttctttcccctccattgagctacatacatggtggccatcaagggtggtctttgggttcagataactcagttaagttatatttatgtttctgaggaaatttcccttacctgtttctatcttgagagagagagaattggggcctgaaggaagggcacggccctgggtgggggtgggccagggatgctcagggagtgaacagctctgggggtgggtgaaggtgacatcttgtggaagggccttgccatggtctgaatgtttgtatttctccaaaattattattattattattttgagttagtgtcaccctgtcacccaggctggagtacagtggcatgatcatggctcactacagcctcagattcctgggtttcagtgatcctcctgtctcagcctcccaagtaactgggattacaggcatgtgccaccatggccaggtaatttttcaacttttttgtagagatgggatctcactgtgttgcccaggctggtctcaaacttttggcctcaaatgatcctcctgcctcagcctcccaaagcactgggattataaggtgcctgcacctggccccaaacttcctatgttgaaatcctagcccccaatgtgatggtattgggaggtaagacctttaggaggtgattaggtcatgagggtgggcccctcatgaatggagttagtgcccatataaaagaggcctaagggagcttgtttgtcccttccaccacatgagggcacagctacaaggtcccatctatgaaccagaaagcaacactcaccagatgcagaatatccttgctcttggacttcccagcctctagaaccaggagaaatagatttctattgttaattagccatccagtctgtggtagtttgttacagcagcccaaatggactaaagccagcttgttccactctactccaggggtacccctgccctccttggcttaaaagaccccactgtgggctggatgagaacacaggataaagagcaggcgggtaaatcccaaacaggagccccatgttggagagagaccagagcttatgccaagtggtgtatgttacttattttttttttcccctgagatggagtcttgctctgttgtccatgctggagtacagtggcatactctcggctcactgccacctccacctcccgggttcaagtgattcttctgtctcagcctcctgagtagctgggattacgggcacatgccaccatacctggctaatttttatatttttagtagagatggggtttcaccgtgttggccaggcaggtctcaaactcctgacctcgttacccgcccacctcggcctcccagagtgttgagattacaggcatgagccactgcacccggccctgtgtgttacgtagaactgcaatggaagcctgaactttcagcttttatttcaaaccatatgattgtgctgccattttaaagataacagacatctaaaaaatcagactaaatggttacctcggaggattgaattttcaaaggtaacagaaatgctcaatatattgttctgcgtgattcatcaaagctgtgtattttattgcatgcaaattaaacctcgatttttttttttttttttacaaaagtagcatctagcttttttgaaagcagctgtgtgtgtatgttgaagtgacagatgttatcaacacagcattcctgtgtaaagcttatgtgacgactccagtgtgcgactgaacaggggcagcaaactgcagcccttgcctacagcctgaattgtatggtctacaagctgagattgtttcttacatttctaaatgtctggaaaaactcacgagaagcatattttgacacgtgaaaatcatgtgaaattcaaatttaataaagttatattggaacacagccatgcccattcatcggcctcttatctgtgactgcgttcacagcaggtagcgtcttgtggaaaggccttgctatggtctttgtccctgcagatgcttttgtggcacagctgaggagttgcaaagcttcacgtatggaccgtcagtcctttagcagaaaaagtttgccaagcctgatctaaaggctcatttaccccaattacttctgatatgatatttagtgcttcaggggatcttccagggttcccagttctggttacacattggaatgacttgaggagctacttaatgagattcctgggccactatgccacaccaaatggtacagcctccctggaggtgagcccaggactctttgcaaccagtgcgaccagccaggatgagtctgttgttaagcccaattgctttgttttcccagtgagaggaggttccttgctcaagaggttaaagtagcccgtggcaaaactcatgtttcttgctacctgtggggcagtggctctcaaaattgagtaggctcaattgatgaggacctcctggaagacctgtgaaaccactgaattctaggtctcaatccagagcttctgattcagcaggtgttttaggagcctgcaaatgtgcatttctaacaagtccccaggtgctgctgatgctgctagtctagaagccatactttgaaaatgggtctgcaggggttggcaggctatgtgtggggatttgttttttgaaatccatgctctaaataaaagcatctcatacaccgtcttcctcccaaagcatgttctttaaaaatacaggtggtcactttcacagcctgagtacctttttcaactgctgctgccgtaaaggaatccttattgagcagtattgtgtcagaaaccatatgtagtcttgagtgcttagttttaaatactaacacctgccagtggcttagtctgtaacccagtgttgttttctgggttggcttaagggagagctgctttcagggacagcaaaatgaggacaagcctgtgtgttgtgtgttcatcagagcccagcacatttccaaggaagctctcctcctcgaagtatttcagaaagcgagttgattgtgcatatactaacctaattgacacatataatgcctatttttaacatggaagatcagttaaatcgttaacttatcatttgccatgataggctgatacatattgcttgttttctaagctcgattcctatttaaatgcttctgttggaactcccaaagtttccatagatttctaatatggtcttttatcccattgtccatgccacctggcatgaaggaaccagaaagatggccagaagaaggctgaggcaaggggaggcccttgggtggaaacttttaagaaccactcactcagggtcatgcatgactgcagcgttggactcatccctaaatcatgcatgctggcacctgcttccttaccctcgtccctgcccccatcagatcccggaagcttgagcaagactctctaagacaagaggccccatctgtagactccacctcccttcttccacttactttgcttgaatgattcattgatacctttaaaatactccaaggaaagaaacggctcgctctttttttttttttgagacacagtctcactctgtcacccaggctggagtgcagtggtgcgatctcggctcactgcaacctccgcctcccaggttcaagcgattctcctgccttggcctcctgagtagctgggattacaggtgtacaccaccacgcccagctagtttttgtatttttagtagagatggggttttgccatgttggccaggctggtcttgaattcctggcctcaaatgatgcagcctcctgaaatgctgggattacaggcgtgagccacagtgcctggtcttgaacaggtctttctttagaatttgcaaatatctgtgttgacacattttcctgaacttgttaaagatgagacggctgcagtacaagctgtgatgtgtcatacgattgattattctaatgaatttttaagggaaaagaaatccccagagggtttcctagatgaagacttgaatgcaggcgtgtgcaatctcacagaaaacaatactgttccatttgtaaattcagctcgtggcctgtgttagaagttccaaatgcagttgcttcgtttcagacgttaaagtccgtcgttcatctggctgctgtttggatgttacagatggttctgggaatcattttgggataattaataatagcgtaggtcttccagtgagggtaacaggtagctaacccttgagaattcagtgagcatttcagtctcctggaatgatctgctgttctaaaatgcatccatctccccgccacgtcagagttcacagtgccttgttccaagcatctgcttttgctcctgcaaacagagctaatgacagatgttaactggctgagctgagagacagtcactcttatgacaatgggttggagcatatgctgtcccgagtttcaggaagcttttgtaacaaaggactcaaaagagatcaggcctccagggaatgttgccaacatgcctttgtaaagggcaaatcctgtccgattaacctaatttccttccccgagcagtgataaaccagggagattaaaatttgcagctatttcaactttagcatttatttttttctgatataagatgtatttataattaacatctgaagatagtttatttaaaacatgtatctcgctttattttttttccctccaccaaaaggtcataacttgccttggaaagtaatacatgggcctcatggatgtttggaggtagcaccagcgagtgtagacttcagcatccactccctgaattttggatgttccctgttcgggacattatctgcaatggttaagatgaagtaaataccatagagaaaaaataattcctgccatttgaggaaagccatactcttgagtattcattattggctcattgctatctttgatggagattttaaaatagtttgcagatgttacttttagctacaagaggaaaagcagctaaagccacattttagcacctaggatttgattcgttaacaacttgcattagcttgagtgatggtctgaaatacaaagcaacagtttttttggtttttttttttgagatggagtctcactgttgtcgtctgggctgagtgcaatggcgcaatctcggctcactgcaacctccgcctcccaggttctggcagttctcctgcctcagcctcccgagtagctgagattacaggtgcccgccacgcacgcccggctaatttttgtatttttagtagagatagagtttcaccatgttagccaggctggtctcgaactcctgacctcagggagtccacctgcctcagccttccaaagtgctgggattacagatgtgagccaccatgcccggccaatagttttgttttgttttgttttgttttaattgaacagtttgattgtgatataattcacccacttaaactgccaattcagtggcttttagtatagtcacagaattgtgaaattatcactacaatagatgttgaaacattttcattatttaaaatagaaacgctgtaaccctgagctgtcattcccaagctctccctccaccctcactcctcccccagccttgggcagctgctttctgtctctatagctctgcctgttatggacatttcttacaaatggaatcaaacaatacgtggtcctttgtgtctggcttctttcacttagcataatgttttcaggggtcacccatggtgcagcatgtaccagcacttcactcttttttattgcagagtaatagtccattatatgaatatgctacattttatttaaaaggaatagtcttttaaacctaagaagaaaagaaaaagataaaacctagaagaaatatagctagccatgtgtgactaattcttacagcattaatattgggccatgcatttcatatttctaaaagtaagagtgatattatatatacttaagatcagaaatatagttaagagcagtgagataattcttacatgctgttagaaaaaatcagtttagattgtctgtcttaggactatgtttcccatccgagtattaaccaggcccaataccctgcttagcttcacgagatcagacgagatcacgaaccttcaggatagtaaggccgtagactcttaggcactatttctagttatagtctcatatctgaaaatgagcacagctttttttttttaatagtcctgagaagattgaaagataaggaaggcttagaaaacgggctctgtgacaggagctcagggaaagggttctgtagccaggaggaggataggaggttgaaagcagaggtttgatgaacacacttacgtagacagtgtggacccgctcttctctcccactgtgaagaatggatgtcatcctggacgggagagatgatagcacacagggcaaagtgacactgaggccccctaagtataggatggcacaacagcagatggggtgacagcctttgacaataaatagctggcctcttggctgtctgggaaaagagtaatgccagagattttacacctgggtattaccagggatcattttcctcatgcctcttctgttgaagtaggtgagaggctgtcatgaatatttccttgcattcaaaaggagagacagtgaccactgcaggtggctttgacattttggcaatgttgtagaagtgtaggaatctttaaagatggaagataaaactttttaagaagagaactgacataacatatgatcatgaatttttttttttttttgagacggagtctcactctgtcgcccaggctggagtgcagtggcgcgatctcagctcactgcaagctccgcctctcgggttcatgccattctcctgcctcagcctcccgagtagctgggactacaggcgcccaccactatgcctggctaattttttttttgtattttcagtagagatggaatttcactgtgttagccaggatggtctcgatctcctgactgtgtgatccgcccacctcagcctcccaaagtgctgggattacaggcgtgagccgccgcgcccggccaacatatgatcatgatttttttttataatggatttcgaggctctctttttaggtagtgactaatattggcttatgtcagctctagggtgagaaccattcccatttcattcctagttctaccctcactagtcctgacgtggacagtttactgttgttattcttcaatttctctgtgccttcttggcaaaggcttttgaggaattcctggaagaaattcccatgaggtttatgtggggcattttaattcaagcatttattgggtgtctgttaaactcagggaatttgggggcaggaaaggactttccagatcatttagttttgctgtgtcatttacgtgtgaccaggcttagtccagagcgctttgatcaaagtcacatgagaaaacagaagaatagggagaaaagagggcttctcatgtatggatcaggcctcattcaatttttgcgggctatcttctgcttgaaggtaatgaggtccagctagtctgggcctggaaaataatacagacgaacccttgagtagtcagccagcaggttagggaatcatgacaggaattcacaaaaccgttaagaaatttgattagtgtctaaaagccagaggcaaaaaaaaggtcagttaatttgtttatatctgctggccaaaaaactcttctgaatgaatgcatttaggataaaaactgaaaataagaccctaactgatgactgagttaatttacatatgcatggggagaagaactttttctatacatctacgattaagcccctttgcacattcagtgacagcaataataaatgtcactggtgacctagaatctatactttttgtttctttgtgcctgttttttttttttagcctgtactctcaattgtatattgtccttttaatgtacctaaagttatacacagtctttttactgggcttgttcagttaaccaaccaaccaccctccctccctccttccctcccttccttccttccttctttccttcccagtgatcagtaagtcttcttttttttttttttttttttttttgagatggagtcttgctttgtcacccaggctggagtgcagtggcacgatcttggctcactgcaacctccaactcccaggttcaagcgattcttccgtctcagcctcctgagtagctgggattacaggcacttgccaccatgcccagctaatttttgtattttcagtacggacagggtttcatcatgttggccaggctggtctctaactcctgacctcgtgatctgcccgccttggcctcccaaagtgctgggattacaggcatgagccaccacgcccggccattaagtctttcttcaattaaattaacaagtgatatcctaatttatatattaattgacatcattttaagtttgcattatttggtttgatcttcgcagaggacttagcatggcaaataaatgtgaaaccatgatgaaggtttcacatccttcatcctcaaaaggacagtgagctcacattatgacctgggcactaaagagatcacctgtgtggaggtgctttctgggccttacatttatacaattctctaacgttcataagatattttcatttgagtgctctgatattgatcctaataacaaacatgtgacccaagtttccgagttttaaagtgtcatttgtaaagatgtgttgattgctacttctctgttgcatatactgaagcaattccaggatcagtcagtactggagaccttactttccagtataaaaccaagctaactagcatagctgggatgtgattactaaggccactgctctgggttgaagtataactttttcttaaaaaaatgtgaaatcatgaagggaacaaataacagagtctccggaacataatgtcttctttttcattctttccctgaaggacttcaagttcagaaatgtataattgagctcatggtagaaataaagtcttacgctgtctattattttggttaaaaggcatttgaagccaggtgtggtggctcacacctgtaatcccagcactttgggagcctgaaagcgggtggatcacctgaggtcaggagttcaagagcagcctggccaacaaggcaaaaccctgtctctactaaaaaagaaaaaatacaaaaatgagctgggcatggtggtgcatgcctgtagtcccagctacttggaggcaggagaattgcttgaacccgggaggcagagatagcagtgagctgagatcatgcaactgcactccagcctggacgacagagcaagactccatgtcccacccccccgcccgtaaccccctccaaaaagccattttactctgcaggaaaaacctagaccagcccccttccccaaactttttagagcgatcacattaaggcatcagaattgatactaggttgagcttacctatatgtggtcttttcctcctcctccttcctgccaacagacatttgagtcatatactatttaactgaggatatatttcatttttctttctaaaattatttaaaaaaataagcagccaggtatggtggctcacacctgtaatcccagcactttgggaggccgaggcagctggatcacgaggtcagaagttggagaccagcctggccaacatggtgaaaccccatctctactaaaaatacaaaaattagctgagtgtggtggtgcgcgcctgtagtcccaggtactcgggaggctgaggcagaagaatcaatcgcttgaacccaggaggtggaggttgcagtgagctgcgatcgtgccactgcactccagcctgacaacagagtgagactccatctcaaaataaataaaaataaataaataaataagcaactggaggttggagtgtcagatttaataagttaaggcattgtaaataaagaatagcagaatgaatcgatggtgccatttgatgaagacattttccctaatatctccaggcacagtggacaaatacgaatacactgaaggatatcagtgtagaccaataaattttttacttgcctaaaagcattcctctttgtcttatagaaattccgggtctaaagttgccattaggatcagacttgctgaataaatagtttagatgtcagtcctctcagttactttgtgtaaagaaaaatctaagccatctgggcttttgtgctttcattatgctggctctaaagacagcgcaaaatggctttttgtttttgggtcaaagcagatgtatgcagcctgccatcttaatttcttttgtatgggttggcggatattttagctgctttgaaatgttgaaaagatttcaaaccaagttgggaaagaacaaaatacattgatttttgtttcccccacaactaagtttactagttcaagtattttgcgaacaagtatctcctgaaataagtacattaatttaacatcatttagatgtttctccaaatttgttgttaatctgtttctttggcccgatgtttaactttcatctgaatcatgcagctaggatttggtttcagcatatgcaaggaaagaatatcggatcctgaaatatattggtaacatattaacataatatgggaaaatgttgtggaataacatttgctctctgaaccacaaaatcttataagaatctctggatatatccacttaattcccttctatctctctttgctaacttgtgcttttatacatacaaacttgattctagtggcacaaactctaccattagtaaacatttactcataactgacttatgtgactttgccactttgaagagtatgcctagaagccagcttttgaatttattttcggttacctgtggaaaaaccattatattaccgaaaaagagagagggatacaatctctaatgttttctaatagcagatgaggttgcagaaatcagtaaatgtatgttatgtgcagattatagactgaagctatttttcagttatcaaataggaagggcaaaagtactttaaaaatacctaattaattgccaggcgccgtggctcatacctgtagtcccagctacttgggaggctgacgggcgaggatcacttgagcctgggaattcgaggctacagtgagctatgattgcgccactgcactccagcctgggcaacagagggaaaccctgtttcaagaagaagtaataattaattcaaatacataatatttggtgttttcctggttgccgttattttaaccttcctgagtagtatttatatttacaaatgtagttggaaaaacttatgtgcctacaggttatgtaggtgctgtgaagagctgaagatggtctctatcctcaggacttaacaccctaaggcagtgtttccaattatagccactgagaccagcagtgttggtgatggtgccgctgtagacaaactagcctcttgaattgttgagcagagactagcccttctgccgtccatccgtagcggggaggtatcgccaggtgtttactaatggcagccataacgacgagcgtttcccaaagactcttggagggaacacaaaccccaagtgatgttgggagaagtgggtggtaggggggtggattaaattaagtttgagaaaggcgacatcatcattattatttttagaaaatcagagcagcatttgatcttaatttctgcagtaaagaaatgtgtttagccaggtgcgatggctcatggctataatcccagccctttgggaggccgaagcaggcggatcacctcaagtcaggagttcaagatcagcctggcctacatggtaaaacctgtctctactaaaaataacaaaattttagctggggggcgtcacgatggcgccggccaactggtttccctggttaaaattggcttccaaggcccttaacccatgtcgcgcggacgaacacttggcaggggcacaacgggaaggatgatttcgcccttgaacccagtgaggtggaggttgcagtgagccaagattgtgccactgcactctagccatgggcagacacagagcaaaactctctctcacaaaaaaaaaaaaaaaaaagaaatgtgtagttctttgcttaatcatgcttcccaaactgccagagaagctgttcataaaatcagtgcccattcaccttaattcactttgggaactgctggctaggtgatgcttccttttttgtggttgctgttttcatttgggttcttattaccaatgttaatcagttaatatcaaccttgtcttctctaggctatcacttgcatgtgagtaccatttggatgttctagtattttaaagtaactttattatttttttagagacagggtcttgctatgttgcccagactggagcgcagtggctattcacaggtgcaattataaagcactacagcctcaaactcctgggctcaagcagtcctcctgcatcagcctcttgagtagctgagacttcagttgtgcaccacagtgcccagcaattttttttgagacagggtctcactgtgtcacccaggttggagggcagtggcacaatcacgactcactccagtctcaacctcctaagctcaagcgatcctcccacctcagcctcccaagaagctgggactacagttgtgcaccaccatgcctggctaatttttgtattttttgtaaataggttttgccatgttgcctagactgatctccagtgcctggggcctagcgatcctctcgcctcagcctcccaaagtgctgggactgcaggtgtgagtgattgcacctggccctgcctagcaattttttttttttttgaggtggagtctcgctctgttgcccaggctggagtacagtggcaccatctcggctcactgcaagctctgcctcccgagttcacaccattctcctgcctcagcctcctgagtagctggaactacaggcacctgccaccatgcccagctaattttttgtattttaatagagacggggtttcactgtgttagccaggatggtctgctaacctcgtgatctacctgcctcggcctcctaaagtgctgggattacaggcatgagccactgtgcccggccagcaatttttaaatacttttttttttcctttggagacagagtctcactctattgcccaggctggagtgcagtggtgcaatctcggcttactgcaatctctgtcttctgggttcaagtgattcttgtgccgtaacctcccgcatagctgggattacaggtgtgtgccaccacacccagctaatttttgtatttttagtaaagatggggtttcaccatgttggccaggctggtctcaaactcctgacctcaggtaatccgcctgcctcagcctcccaaagtgctgggattacaggcgtgagccaccgcacgtggccttaaataacttttaatgccctgtttacacattagcaaaatgttgatggcaatacttacctttctaggttggtttgcagaatagggagggaatgtatgagcctgcttagggatgtgtccgatgttgtaaatacttaacacttgtcacatattatgacttgtcatcccaaaggcagtccctgcacaacgatgatgatgacctttcccaccttttgctaccaaacatgctaattatggacctgtttgtggccaccctccttctcaaccggtttcaactatttttgacagcaaagaatcaagataatatagcctttgaaagtgaatcagtgaagcctgcgctctttcatggtgaccaaaatctgggagaatttctttttatgattgtagactttgcgggcccaggtgttagcctttatgcttgggtgtgggaaggaggaagaaaacaggcttggcaggtccattctagaacattttgtctcacacacagaagtgactgtcatccttgagtgacttcaaggtggtttttaatgttgcagaaagtttggcaggcaggaaacttcatccaaatcctgtttagtctcatggaacttagagacggtagtgttataattagtctgccaatagcttgtctttctgtttggcttcatttcactttgaaaacaaagtcagtatgtagcccatgcaaacaagtttgccaagatctgtgagcacttgatacaccttaacacctggacactgtattctgtggctcccagaactttggatttgagcatctgggaattataggagaccaacatagagttgtcccattttttattttatcaagtaagggcatctaataactcttgccattcttttccttttcttttttttttgagacagagtctcgctctgtcaccaggctgcaatgcagtggtgtgatctcggctcactgcaacctctgcctcctggtttcaagtgattctcctgcctcagcctcccgagtagctgggactacaggtgcgtgccaccacgcccagctaatttttgtatttttagtagagatggggtttcaccatgttagccaggatggtctcaatatcttgaccttgtgatccacccgcctcggcctcccaaagtactgagattacaggtgtgagccaccgtgcccagcttattttcatctttaaagatgtgttttgtttttcaagagacagggtctcaccatgtcatccagtctggagtacagtggtgccatgagagctcctgggctcaagcaatcctcctgcctcaactctggagtagctgggactctaagtgtggaccattacgccggctaagttttacatttttttaagaggcgtgagtctcgctttgttgcccaggctggtgcggaactccttctttcaagcagtcctcttgcttcagcctcccaaaatgttgggattacaggtgagagcccactgcacccagcctaaaagacatttttttaacacgccgaaaatgggaaggacataatcgtgggacagctctttaaaatggaaggagttaaactttatgagaaattatctctgtggtcttatatttctcatttggctattgagaattagtctcagttaagggtttggaaatttctgctacagataattcagcagtaaggatctgttacctttcaggaaaaaatgtactgccacctgcaggtataatctctgggccgtgtctcaggaagaggttcagttctgtatagcacttttaaattgttctcattccctttgcttaaaggtaaggtttttgagcattttaatacatcaagttaaagtgtcaattgtaggctttggtaagataatatagatcagtcatatttgaaaagggaaatacactgtgtgtgtgtgtgtgtgtgtgtgtgtgtgtgtgtgtgtgtatctggaattactttgttggaataaaatcttgttggagagtttaacaaattttactggcaatgtaagaaggggtggacagcagcctcccaccccccaccccatttcttagcagtggtttctgtgaaacttttagagttctgcagatcttgatttaaaatctattgattgagcataatctagtctacaatggtatttgtttttaatattgctgtaactttcagctaattctatagttggttttgcatagctttaagggcaaaacctaatatacaaggtgaaatttagaattagtagttgagtatagattaggcactagaatcctgtttatgccaattttacatcataatatgcaccaacaccacctttgcttttcaaaaagcaaccattcagttctggtagattaactagcaaagagttaaattgagtaagttttcttgcttcgtactttagatattcctcttttcttaccataattactttcatgactatttgccctttcactttgtgacactaaaaaaaaaatgaaaagagaagagccagttagataaatcgttggagaaagcggataaatattgacatcattaaagatctgtgttaatgcgtgatgtggacctgatagtgaaatatttgtttctcctgtgatttatgcaaaatcctcagagtccgatcctgaattcgataaataattattcaaagaaaaaaaaggagtggataaaaatagtttggaagaaaattattatctagtaatatgatttgagagaatcagtttaaggatacttggggaacaatgaatggaaaaatgaaacagagtctcccaattttattggggtgaaggagaaaaagcaaatggattgtgatttgttgctagtcagcagctgattcatgagtgacgggacaacccacttatctgctgtctgttttcccccacttgcagcgtgtcaatctttgtgcttgttgggagaaattataataaaataatatgagttaagtatttgaagttcttgtataaccatgtaattattatttagtagtgtcttcacttaaccttttcaggttaacttgtgcagattggttttgatgctgttaatgaacttcagaagacctagaagcttttttgtagttaagggatatttttccatttcctgtgcctgttccattccttcaaaaaaatttttttttctgtaatttacccatcactatatatttgatgtgctctactaaagtccaaatacttaatgccatttaaaaatactgtttcattttaacttgatttttagcaatgggcagtcaagagtgcttgctgatagaaagttagacaagggagtccaggaccttatggagacaaataagacatattttgaaacatagtgatggtgcccagtagctgacctgttccaacacttggatgctagactcctagccctgcctgctgcttactaactgtgggaccctgggcaagatttttaagctctgtgggcttcagtcttctcatttataaaattgggataagaatatcaccttgccagagggctgattgctggatacagcagaggcatttgccaggttatacaggtaagaatggccataattatatgtatgtatgtgtgtatgtatatatgaatgcatatatgggtatatagacatttgcatacacatgcaagttgcaaaaatgttagattaggtcattgccatagaaaattagaaggggagaatggggcgtggagcatacttgaagctggagcacgtggaagcttctatgacgtgtggaagtcagtgctggaccgggctagctcagtgtggtttcagctggctcgaggcctgtcagggaatgggctggtgcatgtgtggtcgggggccgagtacaaggggaacaggaggaatgaagcagaaccagaaaccatagcagggtttccaaggaaatgagtcctgacagtttcatgattgagccaatgggtgtcaagtaggagcaggcatcttatcttggcagcagcctgtatttcaaagttcctttttttttttttttcctttttcttttttctctctcttttttttagtagagacggggtctcactgcgtcatccaggctggagtgcagtggtgcaatcatagcttgctctaacctcaaactccaggctcaagcaatctacccatctcagcctcccgactagctgggactattaattttttgtagagatggggtttttgctaagttgctttggctggtgtcaaactcctggtctcaagcgatcctcccatcttggccttccagagtgctgggatgacaggcgtgaaccttccaagttccttagtcttatgcattgtaatcagttgtgttgatgcttacagcagctttgtgagcgagggaagggggaagtattcttacctcctttggacagattaggaagacagaaagggaggtttctgagaagaggtatgacatgtgtcaggccacatctcgtagtgatgaggctgccgctgaagcccagggctggtgaggatatgacttccctggtggagctgggctccctctgcctggagcccctacgctttgattgcagcatcttctaaaggcacttttggggatcagtttccccttctgctcttcacttgactggctctcagtacctcttctcctttgtctctctttctgtagcttcttgtgcagtggtgggctggaatcagtacattttaaacagtggagcttttagcaaaagtcaggcaagcatacaacttctacctccatcaccagagtcagaaattacacatatctaaactgcgataggtctgggggcacatgatctaaatgtgcttatacatataaagggttctataagatgcttctttttaaagttttactttatactatgaaaccaagaatatctgtgccacctgcttttctgcctattatgtggaactgcccccacccccaccaagcccccccaccccaaagtcaagtgtcatgccttctatgattgagtcctctttgtctagttatcagatattgtgctaatctcagcaggaaatattatggctttgcctgggtgtttgaaacataaccgtaatatgctcagaaaaactccaagccctcgagccctccagagtccggaataatgaagccaggacaaagagatcatgagctttattattagacgcacttacaaaaaagccatattaatgaaaaacagtttgcgagaagagttggcaaacaagtcagcttccattgttaaaagttcaaatagaacttggctttgttgaaggagagcctgaattagttattagtgtctcagaccacaaaggctgccgcgttgtgatggtctgtggagctcatggaacctaaccatccttctctctcagagaaatgggaaaaatttaaagttttcaaatgaacattaatctccagctttgccgtttcatgcttgctcgtgcataataaaaagggtattaagttcgcagagataaattttggtgtcaggattaacttaaagacattttaagccctttttctaaaaatctggaaaatccttctgactattggagtttcagcctgcttaacacagttgtttgtgttgttagtaataagtactgaccttttgtacagaacttttaatgggcgtagttcaactcacaaaataattgtctttaatatctcagttcttctagcacaccatgaaaagacctaaatgactttaaaactgattcatttgaaaatgtgcattgtttctgaataataactgtttctgaatctgtcttcagggttatgtaagcagctcctaaacattcgaaatctcctttttttttttttttgagatgcatttccgctcttgttgcccaggctggagtgcaatggcgagatctcggctcactgcaatctccgctttccaggttctagcgattttctggcctcagcctcccaagtacttgggattacaggcacctgccaccacgcccggctaatttttttttgtatttttagtagagatggggtttcaccatcttggccagtctggtctcgaactcctgacctcaggtgatccgcctgccttggcctcccaaagtgctgggattacaggtgtgaggcactgcactcggcctgaaatctccttttttaaaaaaaattttaaagataactctccctatgttggatctccttttttctctcatgtattggttttaactttattagtaggaactagtcattttaaatatgggcttgcatatttttgttgtgcatattgcacaacaaaaatgcatattgcatttttttattgtgttttcttgtcaattataacacccactgtgaagacacatatgcatttatgtgtatgatttggtgtacagtgtgcttgtagtggctctgttcctggtagtcataagagtcataagtgccaggaccagagtattttccacaagggcttctgagaatggaaaggatcgtgttttgctagtgacatgtgcaaaggatttcacaggacaggtatgcttaagctcttctgtttctttctttcattcattcattcattcattcattcattcattcagagatggagtgtcgctctgtcgcccaggctggagtgcagtggcacaatcttggctcactgcaacctctgcctcccaggttcaaacgattctcctgcctcagcctcgcaagtagctgggattacaggtgtgcaccaccatgcctggctaattttgtatttgtcatagagacaagttttcaccatgttgttcaggctggtctcgaacctctgacctcaagtgatccacccacctaagcctccgaaagtgctgggattataggcgtgagccaccatgcccggcctgttctttcttttaaattgccgtgttactgtctacttgtaggaaacctggcagagctctgcttaaccttgtaccttctcaccttctcacatatacaggtcagcccatctttcactgcaatctagactctcactttcttccttacttttccactgagcttggaattaaagtacagacgcccctcgacttacaatgaggctctatcctgacaaacccattataagtctaaaatatctcaagtcaaagatgcatttaatccacctaacctactgaacgccatagcctagcctagcctaccttaaacatcctcagaacacttacattagcctacggtttggcaaaatcatctcacacaaagcctattaattaaattaattaatttattttttttgagacagagtttcactctgtcacccaggtgggagtgcagtagtgcgatctcggctcactgcagccttgacttcctggcctcaggtgatcttccccttagcctcttgagtagctgggactgcaggcatacgccaccgtgcctggctaatttttgtattttttgtagagatggggttttgccatgttgcccaggctggtctcgaactcctggctcaagtagtcctcctaccttggccccccaaagtgctggaattgcaggtgtgagccactgcacctggcttgtgtgtcccaatttgatcatgagattgcagcaaatcagttccatcttcaggctccacttctaattctagtgcccttgctattcccaccacatctgcaatgacttcctccactgaagtcttgaacccctcaatgtcatacatgagggttggaataatcttccagactcctcctaatcttgatattttgacctcctttcatgaatcacagatgttcttgatggcatctagaatggtgaatcctttccagaaggttttcaatgtattttgcctggctccatcagagcaatcaccatctactatggcactaggtatataggcttatgaaatgcattccttaaataataagacttgagagtcaaagttactccttgatccgtgggctgcagaatgggtgttgtcttagcaggcatgaaaacatgaatctccttgtacatctttatcagagctcttgggtgaccaggtgcattgtcagtgagcagtaatattttgaaagaaatctttttttctgagcagtaggtttcaacagtggacttaacatatcactaaaaccatgctgtaaacagatgtactggcatctcagttctgttattccgtttatagagatgagtagatttagcataattcttaagagctctaacgttttcagaatggtaaatgagcactggcttcaacttaaagtcctcatttgcattaacccctaacaagagagtctgtgtgtcctttgaagccaggccttgagttctcctctttaattgtggaagttctagatggcagcttctagtaggaggctgttttgtccacactgaaaacctttttagtgtagccaccttcatcaatgatcttatttagatcttctgaataacttgctgcagcttctttgtcaacatgtcctgcttccccttgctcttttgtgttgtggagacggcttcttttcttaaatctcatcaacgaatctgtgctggctccagacttttcttctgcagcttactgacctctcagccttgatagaattgaagagaatgagggccttgctctggattaagctttggctgaagggattgttgtggctggtttgatctatccagaccactcaaacttcctctatatcagcaacaagactgttttaccttcttttcattcatttgttcactgtagtggcacttttaatttccttcaagaaattttccttcaagaattttacctttgcaacttggctgtttggcttccagcttgtcttaactttcgccatgccttcctcactcagctgcgtcatttgtagcttttgatttaaagtgagagatgcgtgactcttttttacttgaacatttagtggccattgtggggttatttcattggcccaatttcaatattgttgtgtctcagaggatatgaaggccccaggagagggagagagacagggaacagctggtcggtggagcagtcagaacacacattaggttcactgtcttgtatgggtgtggtttgtggcgcccccaaacaattacaataggagcatcaaagatcaaatattataataatggaaaagtttgaattattgtgagaattaccaaaatatgacacggatgtgaagtgagcacctgctgttgtaaaaacagcagcagtagacttgcacagggttgccacaaaccctcgatttgtaagaaaatgcagtgtctgtgaattaaacgaggtgtgcctgtatttgaggtgggctcagtttgccagtgagggaaaggcaccagcatatatcagacaccttgcattccctgggttctgtgctaagtgcctaactcatgtgtattaaaaaagaataacagttttattgagatgtaacccacaaaccatagactttactcaaagtgtaccattcagcaacttctttagtgtatttacagagttgtgcagtcatcaccacagtcaaatttagaacactttcatcaccccgaaagaaaaccttgtacctgttagcagccagtccctataaccctcctcctaacccctggcaaccactaatctactttctgtctctatgaatttgcttattctggacatattatgtaaatggaaacataataatatatagccttttgtgtctggactctttcacttagcatatttacaaggttcgtcagtatgtttttttttcttttgagacggaattttgctcttgttgcctaggctgaagtgcaatggtgtgatcttggctcaccgcaacctgtgcctcccgggtttcagcaattctcctgcttcagcctcccaagtagctgggattacaggcctctgccaccacgccctgctaattttgtatttttagtagagatggggtttctccatgttggtcaggctggtctcgaactcctgacctcaggtgatctgcccgcctcggcctcccaaagtactgggattacaggtgtgagccacctctccctgcctatcagtacatcatttttattgccaaataatactccctggtatagtcacaccacattatgtctatctatcatctgttacaaccatttgggttgtttccacttttggctaataggaaaaatgctggtacgaacattcatggtaaccttttcgtgtggacatacgtttttatttttcttgggtatatatctaggagtgaattgctggatcatatggtaactgtatttagcctttcaaagaatgaccagactgttttccaaagcgtctgcaccattttacattcccaccagccatgagttaactcatatatatttaaaaggcataaatacaactatcaagtgagcagagaacaattttaagttttaaaaaaatcctgatccaaatctcaaagtctctgaaggacgtgactgctctgaatgagatacagcttttcccagttttcagatatccgcaaggtgggggctgtataccccttggtgcatgtccgtcatattttcatcagtttccatctgcccatcttcttgggcacatgtgtagtcattgagtttttgctgttggccttcttcattatctttgactctggaatgtagaaaatgaggtggagttgatggatgaagatgcaaaccactggaggtgggttataaccaaagtaggaataggggttaaatttttactatttttgtctgtaacagtggaggaggagctgttctctcatatgaatagtgaccatttgttatctactgaaagagtgtaagagcccctttgtccttacactgtgttttgattccatcgcattctaaaatgcaaatttgaatagataagattacaaggatatcaccagaaagaaagaatctccagacactctttttgggagggggatgagaagttaggcaaggagtgaggatactgacgatagtatgcccctatctctcctaaactttgttcttaggaggtttcaccctgattcccatcagtttccctaaccctcagatcctctggctcttagatattcagaccagatttctggtacaagctgtgcagggcttttacatcctttgctttcatagacacttacaaagacacagcaatttcttgttgacacatttgagaggagtagggggaacaagtgaccttatttttattatgatccatgtactgggaaaactctcccagagcatgatattaatgtttttgttatcaaaaatgtcttttttttttttttaaagacttttgccctccttaattagtaacctacttttttttggggtctttcttctttctggccttctgcctttccctaatctttccattaattcagagagtgttttcctgatatttctacagatttccttgatagtggggatggggttggtggacaggaagagtgtggggagataattatgtcatattctgagctgatgtggcttgttatcttctggatgttgtgagttctcctagtttttgtaccataagtttgagccaagctgacatcttgctgtctttgtacatatctcaccaaaaaaaaaaaaaaaaaaaaaacagccaaaaatgactttggtgtgatctcggctcactggaacctcagcttcttgtgcctcagcttcccgagtagctgggattacaggcatgctccacaacgcccggctaattttgtattttttagtagagatggggtttcatcatgttggccaggctgatctcgaactcctgacctcaggtgatctgcccaccctatctcaaagtgctgggattacaggcatgagccaccacgccaggccctgattctgtttttgtttactggattaataaataccttgtgtgttatctctaaattcttccccacccctctacccacccgagacagtctcactctgtcgcccatgctggagtacagtgacgcaatctcgacttactgcaacctccacctcctgggttcaagcaattctcttgcctcagcctctcgagtagctggggtacaggcgtgtgccaccacggtggcccgcctaatttttgtattgttagtagagatggggtttcaccatgttgtccaggctagtctttaactcctgacctcatgatccgcctgcctcggcctcccaaagtgttgggattacaggtgtgagccactgcgcccaactgttatctctaaattctcaatgggcacttggaaatgtgcccatctgccaaaaatggcttggaaaacacataatgtttaaagctaggactcattccattgatttttgtttaaaactaagaggtgtattcatatttggtttgaatatgtccttttcatttcacttaagggcagccaaggaattactgtcctattatttagtttaagaaaatttcaaggtgacctgtaaatgaaaagtgttgatttgtgacccagtctttggagttggttttagatgacaaacgtaaagtcctcatcatgtaatcttagtaccacacgtggtagctgctgttcatccctttagcagaaaattattaagcagccattagttccaggaatttgatgagacagtgagaacccagaagtttttgtgagacaagtcctggtccccacagattggtccatacgagggtggtgagagggggtcctcagcaccccctgctattgtagacaccaggatttgctcttgccctccttcccatctacccacatgcagttccacgtcctcatcacggtgcaccaggaaatcagccacttcggcatatgagctggaagtttctctccttgattgatgattactaggcaggggtaagaaaaccgaggttacaatagaatgtaagtgacctgagaggtttctgtccaaggtgctgtgggagagaaggccagcccgctcagactagatgtggtggggaagctcaaaagaggggtgactgggagggtgtgctgagccaaggaaggaaagacagacagaccccaggagagttaacccttacagggactcaaagttaatctaatgcgtatggagtcagcttggcaggtgaaacaatggggcgttcgggggggcctggcagagaaaccacattaaataattgatattttgtcctcgaagtgattgggaaacaactgtcagagaattccaatcagggtatggccagattacatcactgataacagtaatatgactaactgaaatatcagagttgcttacacagtaccaagaactgtgctaaatgtgtacaatacttatgtgcatgatctcactctgtttgcactaagaaacatagccatttggattattcttatattatagatgaggaaactaaggattggagagcagagtaactggaacaagttaagattgctcagccagtgaggtgcagagtggagttcagcactgccaaatctcatgttctgcaaacttgagcagtttcccttgaaggaggaaagattctagtcaatcctgttttgggaaacagcagccaaagaaaccaaaatcttatctctgaaaatacctttcaattctatattatcaaggccaagaaaaattgtcattaaaactagtaaaatggccgggcacagtggctcacacctataatcccagcactttgggaggctgaggtgggcaaatcacgaggtcaggagttcgagaccagcctggccaacatggtgaaacctcgtctctactaataatacaaaaattatccaggtgtggtggtggacacctgtactcccagctactcaggaggctgaggcaggagaatcatttgagcctgggaggcggaggttgcagtgagccgagatcatgccactgcactccagcctgggcgacagagtaagactcaatctcaaaaaaaaaaaaaacaaacctagtaaaatatattttaaaacatcattaaaattaaagttcaaaatttaaagaaacatatcttggactctaatttgagaaacgttggctttatgccacaggatgctagaggcagagagatgaatttggaggcagttgtagaggtctgggttgaaagatgttagtactggagccccagtagaggcaggaggaggtggagtagaggggaggcagtagaggggagagaaggtggattctagattgtgttattatctgatcccaaggacttgcaatgtggctgcagtggttggcaatggagggattttaggttgactctggtttctgacttgggtagctgatagcaaaggtgtcattccctgaggaaggggtaaggaagtagccacaaggtgaacaggaggagatgccgaggtcagtttttgttttgagatgcttgtgaaacatcaaggtgttttggagtcgtaggaatggaggtttacagcagagtttaagttcatgtgatagccatgttacctgaagggatctgggcttatgactgagaagacagggctccaaaaggggttctaaaattaagaccgggacatgaggtcaggagtaaagggccctcagaggtgagagctcatccaccagtagttgaggagcaagcagccaagaattgggggttccatccatgcctcttgaatttctctagactgaaacttactatgtttaaaaccagagggttagaggagaagcccttttttccttctgagagcttgtgactccttgggtagatcttttgttttgtttttgttgttttttgaaagctgttctacaatgctcattttataaaaatgtattaaaccccttatatttatccagatacattcactgatagtgattttgattggactgatttcctttttaagcctagaaatgtatacaagctttagaaaacagggaaagagtcatagaaaagtattaaaaacacctacaaagccaggtgcagtggggaacacctgtaatcctagcactgtgggaggctgaagtggtcagattgttttgagctcaggagtttgacaccagcctggacaacgtggcaaaaccctgtctctacacaaaaattagcagggtgtggtggcatgcgcctgtagtcccagctacctggttgggggctaaggcggggagcatcacttgaacccaagaggtggaggccgcggtgagctgagattgctccactgcactccaggctgggtgacaaagtgagacctgtctcaaaaataaataaataaacacacacacacccaaaaacctataaacttgccacacattattggagttctgatatatataaatttttttatttccataggttattgggggaacagttggtgtttggttatatgaataagttctttagtggtgattagagagattttggtgcacccatcacctgagtagtatacactgcacccaatttgtagtcttttatccctcacccccttcccaccctttcccattgattccccaaagtccattgtgtcattcttacgcctttgcatcctcatagctttgctcccacatatgaatgagaacatacgatgtttgtttttccattcctgagttacttcacttagaataatagtctccagtctcatccaggttgctgtgaataccattaattcattcctttttatggctgagtagtattccattgtatatatatataccacagtttctttatccactcattgattaacgggcatttgggctggttccacattgttgcaattgcgaattgtgctgctataaacgtgcgtgcgcaagtatcttttttgtataatgacttcttttcctctgggtagatacccagtagtgggattgctggatcaaatggtagttctacttttagttctttaaggaatctccacaccgttttccatggtggttgtacttgtttgcattcccaccagcagtgtagaagtgttccctgttcaccgcatccatgacaacattgattcttttttaattttttgactgtggccgttcctgcaggagtaaggtggtgtcacatggtggttttgatttgcatttcctgatcattaggggtgttgaacatgttttcatatgtttcttggccatttgtgtatcatcttttggtcccatgtctcctttactcagcttccctcagtgacatcttgcaaaaccagagcgtaacatcccagccaggatattgacattgacgcagtggatacagatcatttccatcagcacaggaccctcctgttgcccttcacagccatcctcattaccctcctgcccagttccctccttagcctctggcaaccaccagtctgttcttcatcctctgtaattttgtcatttcaagaatattctatgaatagaatcacatagcatgtaaccaggaattggctttttcagcttttgcctattgtaaatgtgctataaatatttgtgtgcaagtttttttgcaaatgtaagtttttagaatgaaggcccaagagtacagtcgccctgtgtgtgtgtgtgtgtgtgtgtgagtgtgtgtgtgtgtgtgcctattaaaaaaataacgttaggattatactacatatatgcatagtagaattttattacaaattcattttagtataactccacaatgaaaaaaccatttttatacagtgattgttttctgcacactaaattcctaaatgtggaaagactggctcgaagagtttgaacatctttttttttttcttgatagacttggcctgcatagtgggtataagcaacaagaaagcgttctaattacacatcttagcataacgaaaacaacaaggatgcttttctttgtgcagtagatgtcccttaaaaattatacagaaagttttcttttgtgaataaacaaagtactgtagttgaggatttaaaggaaatctgtacctgagtctataaaatcacagttcctgaccttacatataaatacaaatttgaggtctggttttccctttttttttttgagatggagtctccctctgtcgcccaggctggagtgcagtggcacaatctcagctcactgcaacctctgcctcctgggttcaagtaattcgtcaacctcagcctcccaagtagctgggactaaaggcgcgcaccatgacgcccggctaatttttgtgatttttagtaggggtttcaccacgttggccaggctggtcccgaactcctcacctcacgtgatccgcctgcctcggcctctcaaagtgctgggatgagaggtgtgagccaccgcacctggctggttttccttaatgtacaactatcctagtatattcttgtgtgcgtgtgcgtgtgcgtgtgtgtgtgtgtgtattagccgttccttccaactgagctaactttgtgtggcatttaactttttcctcttaagttaccaagagtgctcagggcctgggtatcaccgaggcctttctggttgctgagtagttactgtgaaagtgtgttcgttgcgtctgcactgcttgttgtgtggcatctccactggcagatgtgctgctggcacactagcccctggatgtttcagacttcttgacttatcctgttagcctgcctgcagccctgcggcgctgtcagaaaggtttgagctggatggttagtatttaccgctcagtgactggtctgccagcagctttatgatgttgtgtgcaccatccctgatacttttgggggtgcgcgatttgtgtacatgacggcaggaagaaaccttccattttgggaacagcagtgtttgtggcgattgctcctcaagaggattcagaagattgctttcctgtggagtttctgttgaattgcatcttgcagtgagatttattctttatctcttgtctctagaaagtctcggtgctgtgtttgatgttagtgttgcccatgatgatgagcaggtagagaagattctgtgccctccctaactacttatgtgcctttcatgtccttcaggtcagaagccaggcagcacccagggcacagggggcccttcccaagtcagcccctgctgcagccacgctcaaccacagatgccccgtgccacatcacccttgcatctgtgtccctcctggccattacctgtcccacatggatcatctctattgtgccctgggcatttctaccataacagcccctactgcactgtcaggattgcctatttttcagaaccctcagtggactgtaaactctttgcagggaggggctgtttaattaatcattgtatccccagggtccagctaacaggccaccatgagtgattgaggaaacttaaaagagagtaaataaatgaaaagtaacggaataaatgagtgagattaaacctagtacactggggctgggcatggtggtgtgcacctgtagtcccagttaactctgtaggctgaggcgggaggactgcttgagcccaggagttccaggctgtagttcactccagcctgggtgacagagtgagaacctgtctcaaaacaaaacaaaacaaaacaaacttagtgtaccaggaaagtgatgcaaaatcagcttgtccttcctcctctctaccctgccctctcctttgaagggtcactgggattctttgcttttttttttttttttttggagacagagtctctctctgtcatccaggctggagtgcagtggcgcaatctcagctcactgcaacctgcacctcctcggtttaagtgattcccctgcctcagcctcccaagtaactgggattacaggcatgtgacactgtgccctgctaacttttgttatttttagtagagacggggggtggtggtttcaccatgttggccaagctggtcttgaactcctgacctcaggtgatccaaaatgctgacctcgtcttcccaaagtgctgggattataccttctttgcttttgactccattcccagggcatccaccctcagcgatctctttgccttcatcttcatgatgtaatcacaccacgttctctttgtcaatttaaaagaggagcaactcaagcaaagtggagggctaaggggacagtagcaccagcagtgggccaggcaggggtgagctgtgtgctgccctcaccaatctaagcctcagcatctctgccgcggagatactaatgcctttaccgtatacattcgaacatcaattcagggtgaggaatgtgcccagggactcatagccagtaaggaagtggcggagctggaattcaaaaggccatctctgaacacgtggccctctaaggtctgactctaccacgcatgcttccccatgataccaagaaattgaactctccctgtgctgtgtgctgttggggaagtttcctgacttctctgatcctctgtgaattcatccttttaaaaatgagcatcagtattacctccccatctgaggatcaaatgaggtaacattagcaatgtctgatgcatgcagctggcacttaataaacccgttccctctgcttggccctcttattttgttttggcacctaaaggatacactgggcattgaaaacctgatgacagtttaaaggacttaatttcacaaactagtttgagtctttgaaaaagaaactaacaatctttgtgttatctatacttcatagttatctaacaaagtagcagaagagttacgtatataaagataacattggctgggcgcagtggctcacgcctgtaatcccaacactttgggaagccagggtgggcggatcacttgagtacgggagttcgagaccagcctggccatcatggtgaaaccgcatctctactaaaaatacaaaaattagccaggcttggtggtgcttgcctgtaattccagctatccgggaggctgagccaggagaattgcttgaacccaggaggcggaggaggttgcagtgagtcgagactgtgccactgcattccagcctgggtgacagtgagactccgtctccaaaaaaacaaaaaaagataatgttaacccctaggctatagtaactagagtgccaaatctctgacaagtttgagctgaaaacagggcagtattgctattttttcctccgcacgctagcagagtagacctgtgtgaatttccttttgattagattccaatgaaattctctaggggacttgacgttttcttgcccccaaataatttctccagtcttgtgaggaagcagcaaaaacaataggaaaaggcagatttgcagttaggtggattgttttcttcttagactcttcttggttgcaaaggaacgccataaaagtataaattactcagtacaaaataatcatggagcttaagcacgcatacaccagtcattgaaagcacagggtcagtgaagctgaacataagctcgtttttgtttacatgattgctaatttcagccatatgtcaggaggcagatatcttaacaacctttgttattgatcactactttgattcatgaattaaagagccaatacacgaaaggaggaaaataagagcgacatccccagaaacaacgtggaattccaggaaaaatctaaacgaggccagccaacttcgtgcaaagggattaaaataggagaagagagtgttatgacaaatagattttcatcagagagcttacaggcaaggttgtcataaaacatggagaacgcacacgcagcctccctttgcccgctccttcctcccgcacaggagctgttccggagagtgtgttctctctcatcttcagagcctgggctcctcctgccgcactccctgagactcttgctttttcctcatagaatgctctatgttgttctttgtattctgttcccctgataggaattgctaccttttattgtgttcttgttgtatgccagtcactgtgacttttacctagattattttccttagtttttatggtaattctatgagttgtctctgatcatcatccttattttacagacggagaaaatactgggccagagaaatgaaaatcttgtttgttgtccttaagttataggtagcatagatctaggagaggtcaatccagctagaaatgattctaaggccatgtttgcctcttattccactcttttttgttgtgtttttttttttattactatgttttgtttttcgagactgagtctcattctatatcacccaggctggagtgcagtggtgcagtcttggctcactgtaacctccgcctcccgggttcaagcgattcttttgcctctgcctcccaaatagctgggattacaggcacccaccaccatgcccggctaattattgtatttttagtagagacagggtttcaccgtgttgaccaggctggtctcgatctcctgacctgccaccttgatctgcccaccttggcttccgaaagtgctggaattacaggcatgagccaccgtgcccggcctggttttgttttttgagacagggtctcgctgtcttgtccaggctggagtgcaatgacgtgatctcagcaaattgcaatgtccgcctcctgggctcaagtaattctcatgcctcagcctcctgaatagctgggattaccggcatatgccactgcatccggctgtccactctgcctttctgtatgtataatacccattttgagggccaggaccattccttcagtatttgttgagtctgccagggctgggcactggggacaagatgggctgggttcctgcctcagagtagtgagacgtgaagtcaactgagagggtcatagctggcatttaaaagaaatgaaataggatataaaatatagggaggcatcaaacgttgtgatgctgagtgttgtgttaggaaacttttgttaaactacagtagttcacagggaaaaacatttctcactgtgggtcgtggtcagaagagtgtgaaagatcctgaccaagaggttccagggtgggcgtgtgatggcttttaaacaagataatggataagtgattataatgtgtcataaggagcaatgaggacacacacgtgatagaataaggaagagagtggcaggggtgcctctgggcaagaccactggtgtcttccgagaggatagcatttgagctgagaccccaaggaggagagtagcaggaagacagttgcccagacatgggaagaggtgcaagatccagggccaggaaggagcaaaggaatattctcagaaacagagatagtgtggaccatattgtttgaccataattaatgcagtacaattagaaaatctcaaaaatgtaaacagtctccaattcctagaaatcctcctcctcctccttaacttgggtcaaataaaaacgaatgaatataatatgacataatattgtcatgctgattttgatttacctctgttcagtgtttttatttcttcgattgtttttgaaagtttttttgttttgttttgttttgtttctttgagacagagtcttgctctgttgcccagtctggtgtgtagtggtgtgatcttggctcactgcaacctccgcctcccgggttcaagcgattctcctgcctcagcctcctgagtagctgggactacaggtgcgtgccaccacgcccagctaatttttgtatttttagtagagacagggtttcaccatgttggccaagttggtctcaatctcttgacctcgtgattcgcctgccttgacctcccaaagtgctgggattacaagcgtgagccaccgcgcccggctgaaagatgtttttatgatttatgaaaagttttacttacaggcattggcttattgtcatcatttttacttagtgtctgggtagacatctggttgtttggcatctcaggacatttctagaccgtactattgtcattttgggtagtattgggtatcactttgatgtttggcagcattcctggtctgtgcccatttaatgccaggtagcacccttctcctctcccccaaattctaacaaccacaaatctttccaggtgttgtcgagtgtccccagtagtggcgggggcgggaaggagattgagaacctctactctaggagaaaagccaagctagtgtgagaggaagatgctgtgcttgagaatactctgtatgtcatctagcgattagggtttttattttttcattttaatttcccttcagttggaaaagttaggttttaagactgggggctcctaatgacttgtaataaaagaaatctgtgtataagccccttctccaagttatgttttcagtcgtattgatcagtttcctttgttctgcccccacgccaatccagttcaccatgttaccagcggtttgtacttctagaacagaacagtttgttctcaggtatcattttatccaagtggatttcttgtctgttaatcctccatgttttgctcattccttccctccttttccatagtttatgctccattaaagtaactcagtttattccaacttgtgatttttagaaaaacatcttgttacagtattgtggcccttgtttccttcaggaaaagttccataaaaataaccgccccccgccccccgcccccagccaggcgcagtggctcacgcctgtaatcccaacattttgggaggccaaggcgggcagatcacgaggtcaggagttcgagaccatcctggctaacacggtgaaacctgtctctactaaaaatacaaaaaaaatgagctgggcgtggtggcgggcgcctgtagtcccagctactcgggaggctgaggcaggagaatggcatgaaccctggaggcggagtttgcagtgagccgagattgtgccactgcactctagcctgggcgacagagtgagactctgtctcacaaaaaaaaaaaaaaaaaaatccccactccccccccccccgcgcaagatggagtcttgccctgtcatccagactggagtgcagtggtgccatctcggctcactacaacatctgccccccgggttcaagtgattctcatgcctcagcctcttgattagctgggattaccgtcacgtgccaccatgcctggctaatttttgtgtttttagtagtgacgggatttcaccacgttggccaggctggtcttgaactcctggcctcaagtgatctgctgactgcctcagcctcccaaagtgctgggattacaggcgtgagctactgagcccagccagtaatgccattctttaaacttagagttttctttcctgctgtataccttgcacgactaataccctgctaattgttgcacatagaggtgacttttgatagttcaagaatctctcttaagaaattcttcagtaagattgtgggtctctttaatcctttgaaatctttccaaattaggccgggtgcggtggctcacgcctgtaatcccagcactttgggaggccgaggcgggcggatcacgaggtcaggagatcgagaccgtcctggctaacacagtgaaaccccgtctctactaaaaatacaaaaaattagccgggcgtggttgcgggcgcctgtagtcccagctacgcgggaggctgaggcaggagaatggcctgaacctgggaggcggagcttgcggtgagccgagattgtgccactgcactccagcctgggcgacagagggagactccgtctcaaaaaaaaaaaaaataaaaataaataaaaaagaaaaaaaaatatttccaaattaaatcaggtgttcactcacccaataatgtattaagatactagaacgcagggcgctggttctgtttctcacctccttagggtttctcctttaatattaatccatcaggctgcccctgaatacctgatgtaattataacccccaggtactccttagtccaccctgaccttcattacgtttcatagactccatcaccacctgcgatactgtctattcacttgtatatttgttttttattttcttcccttgaattggaatgtaagctcgatccccagtgcctagaacacaccagccaaacaatgtttaaaaatttgcttgaatgagtgattttctaaatttctaaaattttttcctcataggaattatttgcttgactcgttttttttttccaacttttattttaagtttagtttgtcacgtaggtaaacgtgtgccgtggtggcttgccgcacacgccatcccatcacctaggtcttaagcccagcatccattagctattcttcctgatgctctccccaaatttctaaatgtatctgatccttatttagcaccttctgaatgccagacaatgttctaaggtctttaccaacttgagcccacctctgaatggatggtttatccttgcttttcctccacaaatacatttttctctactattctttttttttttttgaaatacacattgttttgagcagctgcaatcctgtatcttgaaataatgcttttttttttccccctcttcctagccttctgttttattcatgtagcgattgtctcccgtcatgattctgtcttcctgtggtcctgagaaggaatggttctagttctcttgatttttccacccctggaatgggcatgcgtaatgtgctcctgaaaataggaggaaaggggccgggcgcggtggctcacgcctgtaatcccagcactttgggaggccgaggcaggtggatcacgaggtcaggagatcaagaccatcctggctaacacagtgaaaccccatctctgctaaaaatacaaaaaattagctgggcgtggtggtgggcgcctgtagtcccagctactcgggaggctgatgcaggagaatggcataaacctgggaggtggaggttgcagtgagccaagatcgcgccactgcactccagcctgggtgacagagcgagactccgtctcaaaaaaaaaaaaaaaaaaaaaaaaaaaaaaaaaaaagaaaataggaggaaaggaagtcaaatgtatgaaggtggggaactctagtttacaggttatagccctatttttcagtgatggtttccagctctgaactgttcacttgggctatacatgattttgctattcctggtgcatcaaaaaagacaatgaaatgtgtacataggatgtacacataggaggtacacataggatgtacacatttcattgtcttttttgatgcaccaggaacagcaagataattacataggatgtaaacattaagtcattttatatatataccttatatagatattttatacatacatatacatacatatacaaaacattttatatattatatattatacattatatgtatataaaacatcttatatattatatattatacatatatgtatataaacatcttacataatatattaggatataaggtatcttaagatataagatcttatataatatatataagatgttttatatgtatagatgtataatatataatatataagatgttttatatatgtaaaatacatataagatatatgtattacatataagatgttttatatgtgtgaaatatataccatacacattatatgtaataagtatgtgtatattacatatatgtaaaatataattagtgtctgtgttttgtagtgtcttaagtattatgtatgattatttccagaaagcagaatatgtatctataaatacaagtaaaaattataatattctaaatcttcaaaatctggatttctcagtatacctagagtgacagttagtagaagctgtttgttttcacgttgagaaggacttgctgttggtgagtttgcaggggctggagagggagatagttgtgctggcttcagtgccctgtcttcttgcttagaagaaaatttgggaagggaactcgagttgcgctggcaggagccttgagtcagcagagtgagatgagacctcaggtgtgtgccgggagctggcaggtggcatgggccctactttatactacttggttggccgagagttgaccagcaggcaagttctgtttctgccccaccctggtcggcacttttctttggaagacgcaagtacctgtctggttgtagctcttctgaaaatgtgcctggattggcatcatggggatgtggcgtgctaggggaaggcagggcattctagctatttaacttctgggaatttctaggttgccccaaggctgctttgactctggcctaagtttctgtttcttaactttcttccatggtgttgatgacttaaaatgaagggtctacatgtttcttcactcttgaatgtccttgtgccttctgggtgcgaagcacttctaccctgctccctaggtggccccaggcctctgccagccctgtggggctcatgtggcagggttggccaccttaccatgagatggggccactaggactgtctcctctcctggtggatgtctgagcccaggaagcagctggggacagtggcttttcttcataagagacgggtgggtccctatcttggcctcgagcagtttctcaggactggcttgaccaactctagtggttcatgtggcagaaatgctactgctgaagttgtaatttttctctagaaaaatgaaacatgccatttgtcatggctcatgaaaaaaaaccattggattggtacttttgcatttcttagtgtgtcattctcctttgcaataacataccatttgttgccatgtaggcagccagtcagtatctaaaaatagcctctccaataaaaacattccacacatatgattgcagaaaattgttttgtgtgcacacatgcacatgccagtttgtgcgtgtctgaaggctgagcacttttcatgttatttaacatccttttttttttaaatctcttgatgtttttattttacttaaaggaggattgtaatccaagtatttaaaaactaccaactctagtaaatgagtaaatacagagtggaactccgcaatcaaatgattttgttattgcttgagtttgtaaagctggtcaagctttggtcaacagatggagcttaatgtgatgtggttaatcctgaaccaaatcacttaggacgaagagcactgagtagacattagaaatccatgcaaattcagcaatctgacggtaccagagtcaccttatgtacatgctataacatgtctgtagcgctcattgctgtttttggaattttaaagaagataggttcttgagcaaacaaaaaaaccaattttattttaaatcagaatgcatttgttctgccgagagagtacacaaatgctatatatcctggttgaaagggaatattgtccaaggagattttctaaacattcctgtgatgatgcgttccagtctttgaaaagatatatagactatttaatcaatatgaacgtataccatatttaaagtacttaaattaataattaaatggaataactattataaagctttgaaattatgtgattcaatatgaaacattatatagggaaaccaaattactttctaaaacttagaaagtttcttaattgttactgatttatatcaaatggagaaataatgcagagaagtgaactataagtttataatttctgtgattcccaaaagatggttcatacttgaactaatatcttttaggaacatctaatagcaatggtcaaaataattgcttcttttagaaatatataggtgacagctgggctctgtggctcatgcctgtaatcccagcacttctggggggccaagacaggtggattgcttgagcccaggggtttgagaccagcctgggcaacatgacaaaaccctgtatctaaaaaaaaaaaaatgcaaaaattagctggctggtggcacatgcctgtagtcccagctcgggaggctgaggtgggaggatcacttgagtctcagaggtggaggctgcggtgagctgtaatcatgccactgcactccagcctgagtaacagagtgaaatcatgcctcaaaacaacaacaacaacaaagatatgtgtatatatatatatatacacacacacacacacacacacacgcacacacacacacacacatacatacacacacagagagagagagagagataggtgacataaaatgaaagagatttttgcgatatatttttgattgtccaatttagaatctttttcctgaaattataccgagattgtattgtcagtttgggaaacttgtgtgaaaaatcacttactgctgataatgaaataattgaattcctctccctccctcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatgtaagttccacttgtaattcctttaaaaagatcctcacgtttgagtgaatgcttatttttgttttcagagagtatttcttgccttttgagaattcttgttaatctaagtaaaattatgttttcaagggatttgccacattagaaacttgggtcaaaaatcatgttttcctagagtttattgcctaggttttattagtggggatttactttctgtggaagggccttctgcacatcgaggtagtttgaccttgctgcttgtgaatacgctgtgttgtgttcagtttctaagtgttctgccacggaaagaagtcatggagttgtagactgaccgagggaaaatgttgacttgtggacatgagtacttgagcttaagctgtcttttctggatttttctctttctgtggattttcagtcatttttctggctctgaagcccaccctagggtgataacttgcattcaagggaacccatctttctaagttgtgggattcctgtttgctattttgaatggagaaatacataaaaagtggtcatgcacatttttctctcaacttctatgaaatgtgactatacctgtattataaagtgatatttaagaatcacttgttataaatttttgacgtgaaagtacagatactgcattatctgtcaagatcagttgacctgcagattttctccccttttccatctgcctgtttgcaagtctttataggaaactaaaggcaactggttatgtatgtttatttctcttgtccagctcaaatttatatagtttttaagccaaaattataatactttaaaaactcttgatcttttagtcatttttattctttaggagttacatttctttgccaatatgtttgtgattatgattaataataaattagcctttgccaggtgctgtggctcacacctgtaatcccagcactttgtgaggccgaggtgggcggatcacgaggtctggagtttgagacaagcctgacgaacatggtgaaatcccatctctactaaaaatacaaaaactagctgggcatggtggcacatgcctgtaatcccggctactcaggaggctgaggcaggagaattgcttgaacccgggaggcagaggttgcagtgagccaagatcgcgccactgcactccggcctgggtgacagagcgaaactctgtctcagaaaaaaaaggccaggtgcggtggctcacgcctgtaatcccagcactttgggaggctgagacgggcggatcacgagatcaagagatcggaccatcctggccaacatggtgaatccccgtctctactaaaaatacaaaaattagctgggcgtggtggcgtgtgcctgtaatcccagctactcgggagcctgaggcaggagaatcgcttgaacctgggaggcggagtttgcagtgagctaagatcgcgccactgcactccaaccaggcgacagcaagactccatctcaaaaaaaaaaaaaagaaaaatcagccttaaaatggatagtaggtgctaattgaaactcaaggcatgcttaatattcaggttcttccaatttatctacccttagactgagaaaggagctgggaaagagaaagaattatatatttatgggtttaaactgctaaattttcctcagttaaaaaaaaaaagagtgtatttgccttttttttttttttttgagacagagtctcactctgtcaccaggctggagtgcactggcactatcttggctcactgcaggctccgcctcctgggttcaagtgattctcctgcctcagcctcccgagtagctgggactacaggcgtgtgctaccacgcccagctaatttttgtattttcagtagagacaaggtcaccatgttggtcaggatggtctcgatctcctgaccttgtgatccgcccgcctcggcctcccaaagtgctgggattacaggcatgagccactgtgccccgccctttttttttttttttttttacactgtgaaagtgtcatttttgtcaaatcgacctaatgtttgccaaatgttttcaaacagccctgtccagagaaattcaatcatgctgtcttcctctgacttgctgagctagcttgtcctgtctttagattaaaatattttccatatgttcagaaaaggtaatgtttatacctgttggtgtgaaagtggcgatgcattctgtgttttgcatgagctggcataatgtgcatttatttctctgttctcatctcaaagatccccttgtagatgaccagtgaaccacctctttcccatagaataccactgcataggtatccacatgaccgctgcactgtgcgtgtgttgttattattaaatatttgacactgtcgtgtaactatttgtttacatagcagtttctttgctaggtttgtcaaggacttattttgtcttcctggaaccaaggacactgccaggcacctggtagttgtgcaataaatgtttataaaataaatgccattcatattacaaagtcttgtagttgataaaatgtgaacctggattttaaaattttttattggtgtatgtctcttgtaggtgcagataggttgaatatacctaatccaaaaactccaaatccacaatgcttcaaaatccaagacattttgcatgctgatgtgttgctgaaaggaaatgctcattgggaatattttggattttgaatttaacttaaattatgcttaaccagtacatagtatgcaaatattccaaaatccaaaaaatattgaaatccacaacactttgtgtcccaggcatttcacacaagggatgctcaatctatattttgaaactcatactttgctgtcattagagaaaaaacacaagtttgttttttttttgtaatagtgtcttgctatgttgcccaggctagactcaaactcctgagctaaagtgatcctcctgccttagcctcctgagtacctgggattacaggcacgtgccagcatgcccacctagacacaagttgttattgtacattttcaatagtcaagaaaaagtaagtaaattagaaggaaaaaaaaactacacaagggtttaaaaggcagacccttttaaaaagttttttatttattttcctcttttcatgataataatgttaaacctgacagctaaattgccaatacatactatgaataagatcttggtcttggaataaggtcatattcttcctttctaaggggaaacccgtaggatttttgtgcatccaatttgcagttcagttcagttaattatgccattgtagaccttccgtttgaggcttgcaaaattgtatattatccataaagcagccaccatgattttttaaaattatcattgaagccattcaccggagatgtcagcgtctgttggactccgctcacatcgagacaagaccgccacctgtcagaacagccactgcttctccacatttgatcctggctcggagcaatgcctgtctatatctttaaaagagaaaaaaaataaaatgacttgaattgttccagagatgttgcattagttttcttttgctggataaccagttaccataagtgtaccaacttaaaaaaacaaaacggccaggcacagtggctcacgcctgtaatcccagcactttgggaggccgaggcgggcggatcacgaggtcaggagatcgagaccatcctggctaacatggtgaaaccccgtctccactaaaaaaaaaagtacaaaaaaattagccgggtgtggtggcgggcgcctgtagtcctaggtactcgggaggctgaggcaggaaaatggcgtgaacccgggaggcggagcttgcagtgagccgagatcgcgcactgccctccagcctgggtgacagagcgagactccgtctcaggaaaaaataaataaatgaagattacagttctgtaggttgaaagtcccataagtctcaccagcagaaatcaaagggtcagcagggctgcgtctgtttccagatgctctagaggaggatccgtttcctgctcattgtgtcgttggctgaattcagttacttgcagttggaggactgaggtccttgttttcttgctgactgtcacctgagggctgttcccagcttctagaggccgctcacattccctggtctcctgatctgtggctccctttcttcatcttcagtgccagtaaccatgtattgtttccctctcatggcttcaaatctttcctccttctcctccactgtcttctttctctctctctgactgcagccaagaaaggctgtctgcttttaaggcctcacatgattagattgggcctccctggatgatctccccatctcaggcttcataaccataatcacctgtgcagagcccctttgccatgtgacattatctagtcacaggctctgggatgagtgtggatggatgtctttgcgggaggagccattattctgcccaccatacgtgtcctcctttttttgttgttgttggtttttttttttttttagagccagggtctcactttgtctcctgggctggaatgcagtgacatgatcgctgttccctgcagcctctaactcactcctgggctccagtgatcctctcgcctgagtatatatatagtactacagtatataatatataggactataggtgtgagccactgcacttggttaatttttaagtttttttaatttttttaaatttataaaacattgctatgttgcacaggctggtcttgaactcctgggctcaagtgatcctccctcctgggccttccaacgtgttgggatgacaggcatgagcctccgcatccagccaggtactctcctttgagtcatatcattgaggagggactcctgtggcattttccccctgctggcgtctggatgtttcattatttgttgactttctgttctgagctgtcaggttccatgggttgctggcaagtggctcatcgccaggtagagaggctgccattctttgctaaggagtaatgttagctttttctccttggggactggtctttttatctgagaactttgtcagaaaccaggaaaatatttttttattgtagcttttggcatcttctattgaaatggggtagaaagtgataaaaaaaaaaaaaaaataaaagcacccagaatagtcaagttagagttgatcttcccttttcttcactaacctcctctttggctccgtattgataattgaatctttctgaacaccagtttttaaaataaacgtgttttcaaaggtcagatatcataatccctcttaacagggatgttttaaagtaaaagaagtgaaagctctgggaactttaacctttgtacctttgtctccatcttagccatctcatagcaacaagtgtttatttagaaagttcctgcctcgaacttggctccattttaagggggatttggaagaagtttacagcatcatccctagcctcaaagcttgcaatttagtggggagataacaccaaggccagctcacagcacatggccttggatagctgaagtcctgtcattgagggttatgtgatgatgacacaggcttgggtttgagtgtgcttatgaagcccctgaaccttaccgctgggccctttagctattcctgtgggtgcattcctgtcccaggcttgtcgctgaggggacagaggccgtaccgagtttgatgccagtgtccataggtctggactgcgtggtttaagctgcagtgcctgggttagagcccctctgcgctggctgtaactgcctgtgcagaagcccggccttctatgcccctgttagattctcttcctggaaccccaggctcttcctgcctgagacttcccctcatcaatcttatccttcctctggccacttcaagactagagccctgctctgctcccagttcccagccaggggccccaggtttccaccctgaacctcttggctatgggtttgctgccttgaggagagggggttggctctctcctgattgtccccttccttggaatgggtctgatgagggcctagacttcttcatctcctgtcaccgcctgctaagacctggcaagggcaaatacccgctaaggagaggaggagcagggtatgtgtttgtggtacagagacataacctatgtgtggctcaggaagccctatggaggtggtggtggtggtgacgctacaaaggcatgagatcaatcagggttgagtagaaagcctggcatggtggctcatgcttgtaatcccagctctttgggaggctgaggcgggaggatcgcttgagcccatgagttcaagacaagcctgggcaattaggcgaagtcccatctctacaaaagattgcaaaaattagccagccgtggtggcgtgcccctgtagtcccttctactcaggaagctggggtgggaggattgcctgagccggggaggttgaggcagcagtgagccgagattgtgtcactgtactccagcctgggcaacagagcaagaccctgtctcaacaaaagagaaaaagaaaagaactgatgagaaggaaaggccagtgaacaccatacatgaagatggagagctgagagtgagcttgatgcggcctcatcgcagcgggagaaggctgtctttgctcatggaatcagatgctggctggggaatgtgcagaaattaggtgggatgggcagcctgaggttagaagccttaaaccattggttccccacctaggatgattctgccgtggggacattttgtaatatctaaaagacatttttggtctcatagctacggtcaagcgacgctactggcatttactgagtagaggccagggatgctgagaaacatcccggagtgcctggggcagccccagagtcatctggcctaagatgtcagtggtgccagaacatccctcccccacttaccatcagctcacctggaaagtttggggctgatggtacacagaccccactatatttgttaaagttttctttttgttttttttttttttttgagacggagtcttgctctttcgcccaggctggagtgcagtggtgccatgtcggctcactgcaacctctgcctcctgggttcaagcaattcttctgcctcagtctcctgagtagctgggattacaggcatccgccaccacacccggctaatttttgtatttttttgtagatacagggtttcaccacgttggccaggctggtctcgaactgacctcgggagatccacccgccttggcctctcaaagtgttgggattacagacgtgagccactgcacctggcctttattttgttttagagacaggatcccgctctgtcacccaggctggagtgcaatggtgtgatcatagttctttgcagccttgacctcccaggtcagcctctagagcagctgggactacaggcacgcaccaccacgcctggctaatttttaaatttttgtcaagactgggatcttgctatgttgtccaggatgatcttgaactcttgacctcaagccatcctcccaccttgacctcccaaagtgctgggatttataggcatgagccactgcacccagtctgtttaaaggtttctgaaaggagaatttctctaagaaaaatttcagaagatttaagagggaagtgatatggctgagatgagaaaggacagatgggctgagggcgtgttgcagtaattcagtaggggagggctgagggttttagaccagggtagagatgggagaaaagtcatggggactgtagggagggaggtgatggaagaggctccatgtcactgtctcccggtcttgtcaagtgctgtggctgtgaaaacgtggcaccgtcctggaagctcctgagcagagtgagaacaagtgttttttaggtgcctgttttctgtcttcctgtgctctctggccctggatcatctcaaattattatgtacccagcatctaagcacagtgttgacaagagcaggagaggtttctgttgcaccgaaggcaagctcagtggccagagtggaagggctgccaggttccgaggcgtggcagttttgtttcctgctgaatggaagagaagcacattctcttcattacagggattgtggagctctgggtcagttgcgcagaggagactcctctcccagtctctaaggaatggctcaaaaccacatcacggggagagctgcagggaacttcagcggtcgcctgcaattatggtgttgaggctggctccagaggaagctcttccctgttccacccagccttttggttagtttgtttgtcttgccgaacaaacagcacagagatcagaatcaaaggagccaattttaagaaatggggctgtttctaaagataaatgcttcagtaagcacgaactatgcttcacagctaatgtatttttagatgtttcaaaaatatcctcctttggttaggtggcattccagcccaaatctgcaaatgtgtttgatgttgcttctgaattaactttgaagcctgcatctgtcaggcaaaatgtgttagcaggcatcagccagagaaaggcctattgattttagcagccggttgaacagagttcacctgcagggaagtcacggcctgcttgccatgtgaaggctgggcataccctgccgtggactggactgtttgggaatcttgcaaattgaaatctgtgtttcattttcttgagttgagtcttcccaaggtagacttggttggcttgtttacatccctttccaaggctcgagtcaagtcacagcgcgcctctcacggaggcagcgtggcctgaaggccgcgtggttggttggttagcactgccttggcattggggtgcccttgggacagatgaacgcagtgcagtttgaacacacttggggcagatgaacacagtcaggactttctgggtttttttggcttttttttttttccacatgaaatcaagactcgtagccaaaagatgattgtaaccatctgtctgactatatgtattttaaaactttaccaaacatttatgctccggagtggccgcttccacatcagcacatgagagtggcaatttgaaacttgtttttttgtgatttttttttttcttccttgtctctctttgggtttagattcctttcaaggctgggcgtggtggctcatgcctgtaatcccagcactttgggaggccgaggcaggctgatcacaaggtcaggagtttgagaccagcctggccaacatggtgaaaccccatctctactaaaaatacaaaaattagccaggcgtggtggcgggtgcctgtagtcccagctacttgggaggctgaggcaggagaatcgcttgaacctgggaggagaaggttgcagtgagccgagattgtgccactgcactccagcctatgcaatagagtgagactgtctcaaaaataataataataaaaaagatacattcctttcaatcaggagagaattttagtcagaaagtcactcaggtgaaatggaaatgccagcctctaccttgaagaccttgacttcagttaacagcttgtctcttgagatggtttaattttcaacaaacttgaatgcttcacgatttttaaaaaattgtttctaagtgtttattttttatttttatttattattatttagacctcactcttttgcccaggctggagtgtagtggtgcgatcatagctcaccacagcctccaactcctgggctcaagcagtcctcctacctcagcttcccaagtagctgcgactatgggtgcgtgccaccacagccagctaattttttgtatttttaaaattttttgtagagatggaggcttgtcgtgttgctcaggttggtctcaaatttctggcctcaagcgatcctcccacctgggcttcctaaagtgctgggattacaggcatgagtcactacacgtggctgaaatgtttctaattgtttaattggacaacatcagacaattgggttatgtagaagatagtgggcataaagcactagaagacagttaaaacatgaatttatttggtggattggtggtgaaatcatgtgtcctcagcatatcgatgctgatgccgccctgcctgggtaccaggctctgtgttaggctccagggatgcagaatgactctggcttacaggaatggcttgttgaaagactgagtaaatgaaaggtccctaattgattagtgaagacagacacaggcaaacgatgaacaatagctcagggtgacaatgggtgtgataaaaatacatgggaacacaaagaaggagcgtcacaatgaggaggggatgagagggtcagaaaatgattcctcactgaggtgctattaatagttggcctgagttttgagcatatgtagaggaatttggccaagaaggaggatagctgtcctggcagcagatcatcatgtggaaagacggaaatattgtgatgcattgttatttaatatccaacgcaggacattctagatgccagaacaaaggttgcatgctgctggctggcaaggcggtcgagagcaatggaggaaggaatggctctgtgcaactcagtgagcttgaacggactcatgaaagctgtaggggataactttaagcatgcgttttggggaagcgtcacttggtcacagggtggtggatgagaaaggaggggcttccagttaggaggggttactgtgtgagataccgagaggtagatgctaagtgtttaactgggtttgggggccaagtaagctgaatttctgtaggattactggattactcatttgggtaggctgtggtgccatttgtcaagttgtcactatgtgtgaagtaacaggtgtttgggggaggttagccatgtctgttgagcttgagccagtggaccactgaacatatggatctgtaacttacagctgaagttgcactcaagataaagatttaggaagtaagtcactgccgtatttagccgaggtgtttgagagagaaggaaacggggggatggtgagtacgaaataaatctggataatggatctcacttcttaacaactcttccctttagctgccatagcacagactttaaataacccatttccccagtgcatttcaaattgtatcttctacatccagcttttcaggactacatgacgaaaagcattgtggttttattttcattaacaatagcgatgatacatacctctgatttctgtagcacatagcggtcatgtggggtaacagaggatcccttgttgttactgatcagaatcttagtcccgggggagtgaagcagtgccaggggaggttcttcagggctgtggacttggtgtcttctgacttgaccaaaccatgctgtttagatgagttatttctgcattgggattgtgatatccaacctgggtcccttggtctctataagcatcctgtatgaggccactgagtcactttaagttttctcagttatacttgattttttttttttttgagacggagtcttgctctgtcgcccaggttggagtgcagtggcactatcttggctcactgcaagctcctcctcctgggttcatgccattctcctgcctcagcctcctgagtagctgggactacgtagtaggcgcccgccaccacgcccagctaatttttttatatttttagtagagatggggtttcaccgtgttaacgtggtctcgatctcctgacctcgtgatccgcccgcctctgcctcccaaagtgctgggatcacaggtgtgagccgtcgcacccggcctttttttggaggtagagtcttactctgtggcccaggctggagtgcagtggcgtgatctcggttcactgcaacctctggctcactgcaacctccacctcccgattcttctacctcagcatccccagtagctgggattacaggtgcccgccaccatgcccagctaatttttttttttaaattgtaatagagatggggttttgccatgttggccaggctggtctcaaactcctgacctcaaatgacccacctgcctcagcctcccaaagtgctgggattataggcgtgatccactgcacccggccagttacacttgattaaaaaaaaattattggctgtatttaagatacacaacatgatattttgatatacatatgcatgctgaagtcaaatgatacttgattttttgggggtgtgaaatttgacactaggtgttatacccttaggccttttgaaaaccttgacttggtagattttagattgaagagatgaagtgagcttctccaacatttttaagcaatttgtgctgcagctgttccaaattattaaaatgggcaagggaatgtattttgggggtgagttatgtggaacttttctgacaagaaaatgtttttatgtgcttcaaaatagaatgtacttcctatttctgaaaagccattaaaccgaccagcttatttattcttgtggaatttgaaatccaacatgaggaaaccggtacgtggccccacctcgtgtttgggagctgcatgtgtccacagtcttaaactgcatggcatcatcatggccgtttgtggagcggtaacaatatcttttcatagagtgagaaatgacgtgagcccatggcaaatgttgtctcatagaccttaggatttcttttttttcttttcttttttttttttttttttttttgagatggagtctcactgtgttgcccgggctagagtgcagtgccatgatggttcactgcaatctctgcttcctgggttcaagcgattctcctgcctcagcctcccgagtagctgggattacaggcatccgccaccacgcctggctaattttgtatttttagtagagacggggtttcaccatgttggccaggctggtcttgaactcctgacttcaagtaatctgctggccttggcctcccaaagtgctgggattacaggtgtgagctactgcacccagccaggatttcttaccacactttatctttgcttcacttgacacttaacaagctagctctttccccacctccagctgccatttttactcacgttacatgttgaacttttcttattactcagtgaacctcttacacatgtagcctatacttcagtgacaaagtcatccatgcaaattgaagagtggggtggtaagtttaagatgggggagataagatgtccttgactgtaattatttttgccaaagaatgcttgacatttcaaataattttttttgaggtggggtctcactgtattacccaggctggagtgcagtggtcatggctcactacagccttgacctccccaggctcaggtgatcctcccacctcagcctgccgagtagctgggactacaggcatgcactaccacacccagctaattttcgtatttttagtagagatggggtttcgccacattgcccaggctggtctcaaactcctgggctcaagccatcctcctgccttggctggtctcgaactcctgacctcaggtgatcctcctgcctcagcttcccaaagtgctgggattacaggccggagcctctgcgcgcgaccataatttgtctttcttgaaataaacgattgggaactatgactatggttgccggtgttattttacatccctgttttagcaggttcagaagtgccatttgtcatgtgcatggacacaaacagtaaaaacccagtagtaagtgaagtccttctgtgagctgaagcccttcccccactccctttggtgacctgttacgaaaatacttcattagggcttgggctgctgtatcaccttttggtgattggattaagggggtaaagaccccgagggaaatctcagaggaaggagcctttgtggaagttagtcaatgcaaggtgaggccctgagcagaccaggacagcacagatgaagggagtgggtgggtcgccctggagttaatgaaaagtggaacacacgggacaaggagacgtcagccatggtgatgaggtgatgaggtgatgaggctgacagagccctgtgggtggatgggtgatggagaaggcattcgctgtagatccacagtgtggcacattctcaaaaatccagggttcctgccttcactctgactcacgggctccgtgaccgtagggacaatatcttattgtccccttgccggttccattacctgtcagaagaggcaggagcagtgacctctgctgcccatcacagggttatggaagagcaaatgagtgggtgtgcgaatgtgtaaacaatccttttggccataggtactaaatggaggtaggtagtctaagggaggcctttgaattattaataagtaagtaatattgggctgttgtctactgagtaatttttatacaatgaggcaaaattttctataatcttaagaaatcaggttctttctttgtaccagccagacacacattttacatattctttccttttttgcttttcaaggaagagatttcagattattgagttttggttccaattaaatctggtcgtttgatgttcctgttggtttgtgggagttcatttgctgaatttaccgccagccacaacataatatctttattaattatttaaactctgacattactgtctccctgaaaatatcagtgccttttgttctctcttcctgaatagtctatagcttgtcaccagaacatttttatttaatttgggttcaaatttgaaggtgtgtatgctgaaacttttttttttcttttgagatagggtctcactctgtcaggctggagtgcggtggcacaatcttggttcaatgcaacctctgcctcctgggctcaggtgatcctcccacctcagcctcctgagtagctgagaccacatgtgtgcaccatcatacctggctaactttttaatgtattttttgtagagacagggttttgacattagtgcccaggctggttaactcctggactcaagtgatcctcccgcctcggcctcccaaactgctgggattacgggcatgagccatcaggcctggcctttttttaaatttaattttttttttaaatttttttaaagagacaaggtttccactttgttaccaaggctggagtgcagtgatgcaatcacggctcactgaagccttgacctcctgggctcaagccatcctcccacctcagcctccctagtggctgggaatacaggcatgtgctaccacacatgggtaaatttttttttttttttgagagagaggatctcactgtgttgcccaggccggtcttgaactcctgggctcaagtgatcctcccaaagtgttgggataacaggcgtgagccaccacacccaacctctaaaactttttatttaaagttaaggagcataatgtttcttgttatttcctctcaagtctgtgcttgtttttaatctctctttatacttagagattaatgtattctatacaacaccataattcccagcattacttattttttttaatttttctttctttcttttttttttttttttttagagacagtctcgctctgtcccccaggctggagtgcagtggcgtgatctcagctcactgcaagctctgcctcccgggttcatgccaatctcctgcctcagcctcctgagtagctgggactacaggcgcctgccactacgcccggctaatttttgtatttttagtagagacggggtttcaccctgttagccaggatggtctcaatctcctgacctcatgatccacccgcctcagcatcccagagtgttgggattacaggcatgagccactgcacccggctcctatttttttctttattaaactaaaaaaaaaattttattttggtaaaatgcatgaacaaaatgtatcacagccgttgttaatgcacagttcgatagcgttaagtatatttacgttaccctgcagcaatctccagaactcttctcctcttgcagaactgaatccatactcattaaacaacagctccccatttcccccatctccagcccctggcaaccacccttccactttctgtcaatttgattattctggatcctcatataagtggaattgtacatttccactttctctatcaatttgagtattctggatacctcatacaagtggactcgcacagtgtttatctttttgtgactgtcataattcacttagcataatgtcttaagggttcatccatgttgtagcaagggtctgaatttccatccctttcagggctgaataattccgttgtatggatgtgccacattttttgtatctgttcatttattggcagacacatgggttgcttctaccttttggctgttgtttactgaatattttttatacatggtataaaaagtttgaaaaaacatccttgagttagtggcaatatgcaaaaaagaataagaaagtgcttggaggatgtgggtttaaggaaaatcttgaaaacagcagatgccggacatgttatgaacatatgtatcttagttttctcttgtttagagtacgaaatatggtctaaaccataggtttagaaatttttgtagagtatgaattttttcttttcagaatatgaatcacaaaacgagaaggaccacagcagtagcacctacattcttacagagtcatgttggaatatagccatgtaccattaaatgtatgatcttagccaggcatggtggctcatgcctgtaatgccagcactttgggaggctgatgcaagcaggccagatgaagccaggagtttgagagcagcctggctaatgtggtgaaaccccattcgtctctactaaaaatacaaaaattagccaggtgtggtggtgggcgcctgtaatcccagctactcgggaggctgaggcaggagaattgctttaacccgggaggcggaggctgcagtaagctgagattgcgccactgcacggcagcctgggcaacggagcgagactctgtctcaaaaataaataaatgcatgattgatctttaaaaatcaggagcagctgtttaagtgctctttctctacccaacaagcagaaagggtcctgaccattttttgaggaatttggggagttcaactcatggttcagtttaaagctataaagtagatcatggggcatgaaagatcgtcacacatctgaggcaggcagcttctagggtgcacgtaacttttatttattacttaccttaaaaggtgaaaggttttaaacatactgaaatacaaatctttttggaaaagaatttttttttttcacttgatgtgatatatggtgtgtaaaatgaaaagcaaaataaaagcctggcttggtatcttctgttacgttaaccacgcattcagacgaccttttacctgaaaacacttttcaataccccctgacatagtggcccttggaggaaaagcctttcattccacaggagatttggcgcttccttccaacacagccacgggggtggcgcatggcaaggctgagaaagaaccagtgtagtgaggccaagcagattggagaacagcggaagcttaggagcctggggtggtttcattgtagattagaagatagagtcttcctcacttgctgtgggcatcgcttttatgggcggagagcctgaatgagtcccagaatcctcaagaaaagatgaaatcaggttcctaacctgggtaaagaacccacgagcacatgctgtacccttcagaagcttctcatcaaaacgggaacaatcaaggctttcttgcctaaagcagcaacagtctgttattaatatttatgcagaattttaaaaatatatttttaagtagagatggggtcttcctatattgcccaggctggtcttgaactccttggctcaggcagttctcccaccttggcctccaaaagtgctgggattatagtcatgacccaccgtagctggccgggattttaaatttattgacaatgtgtagtaatgagggaccatatttttttcatggtaactcactaggctgactgacagatgaagcatgcattttattgtaagagtcagatacaaagatcaatattattgtaggaaaagtgtgcaaccaccagagctgtgctggtcattggccatgattaacatcttctataactaaaccagctggatggttttggtctttcactctcgaaccgtgtgctttttgaggccatctggtaaagtgttctgtttcacagcatgcccgattatcttttcttctgaaagatggtgactcagaattgattggtggcagtagtgtggggtggcagggactcggcttagcagaggagagtatcccgatgccttttgtgagctgcgtgaccatcagcaaggatgccacataattctgcagagtctgtgggctgcctccccagggagcgtccgctgttaagagtcctttctcagccgggcacagtggttcatatctgtaatcccagcactttgggaggctgaggtgggtggatcacctgaggtcaggagtttgaggccagcctggccaaaatatatgaaatcccgtctctagtagaaatgcaaaaattaggtgggcgtaggggcacacacctgttatcccagctacttgggaaggtgagacaggagaatcgcttgaacacgggaggcgaaggttgcagtgagccgagattgtgccactgttctccagcctggatgacagagcgagactcagtctcaaaaaaaaaaaaaagtatttctcttctaaagcactgctgattctggtggaagaggacctgtggacattgatttctgggttgcatatgttgtctctagttgccacagctactacattgtcattctgaaacatttaaaaactatttcactggacaaggtgtggtgtgaattactgtaaaaagtcaagcatgagaccattttggatgttgcgtcttcacctttgctaacaggcttaatgccactttgtcttctaccttcattcaaagcccatgtcatccacactgtcagaacgagcagtatcttaaaaggatgctctatggctagtgaggttccccaaccaggaggaggaatatggtttaaaaaacatgatcattcttttgaagaaagctgtgtaagaagttttaataatggttttataagtaaatcagtgccttaagaaagaaaggctcatcttagaattttacagcaaccatacaaacgtgtcatgaatggggcatgcaaaatgatatgggcatatcattttttaaaaggtgtgttaatgatgggtgaatatcctaataataaattaattaaatttaataataagcttaatgcccatgactgtggctttcaccctctgcttgcaactgaggaagaggattggtgtgtgctcagttgagcccgccgtgttgatggttggcagtgttgactgttgcttgtcagcttcctctgacctacctggctgcataaagagtgacagtcctgtcacagtagggaaaaaaataagaatgtatttcacagtaaaaatgaacatttttgatacttagcagaaaaaagaaaataatgtaaacaactatcaaaaaggtagaaaacaaacatggcattttaaacaaagtagtggaaggggccaggcactcacagcctcaagtattgtctgcctgctccctcacctctgcagatgttagatagaaggaggcactggagtgtctgtggtccaggcactgatggaggatggaggcatcccaaggagtaggacacttttttttttccaacttccatctttttttttctggccaaatcttccccatagtgctccgacaggacaaaatgggttttctagagagttgatgtttccaaggacctgaacatttactcataaaagcaccagatctttttttttctaattaaggtgaaattcatttaacataaaattaaccattttgaagtgtacaactcagtggcatttagtacattcacaatgctgtacaaccaacaactctgtttcagtatgctttctgctgccaaaacaggataccacacactgggtaatttataaggagcaaaagtttacttggcttatggttctggagactggccagtccaagagcatggcgctggcatctggtgggaccctcttgctgtgtcatggcctgaggcatcacatgatgagaaagcttgagtgtgagacagagagaatgcatgtcgaacttactcttttattaagagcccactctgcaataactaactcactcctgcaataatggcattaatccattatgagagcagagccccatgacataatcagctcttacctttgtaatcaccttcctaatactgttacaatggcaattaaatttcaacacaagtttaggaggggacaaacattcaaaccatacaacctgtatcttagttctacaatatttttatcaccttaggtggaaaccctgtaccagtgaagcagtcattcccctctcctgccactgtctgcttttagcaaccacccatcttgctgtttctatggacttaacctattctggatatgtgaacttttgtgtctggcttaatatgtctccaaggctcattcacattgtagcatggatcagcactttattcctttttgtggctaagtaatattacatggtgtgggtatgccacatccattcatctgatgatgggcccttggcattgtttccacctttggctgttgtgaatggtgcttctgtgaacatgtgtgtacaagtgtttgagtattttctttcgcttctttttgatatgtatctaggagtggaatcgctgggtcatatggtaatatcttttatgtttttaacctttttttaaatcttttgcttcatattatttccaaaacacattccaggttgagtaacccttatccagaatgcttgggacctgaagtgttttggacttctgatattttctctgatttagaagtatctgcattatacttaccagttgggcatccctcatcagaaaatctgaaatctgaaatgcccccatgaacatttcttttcagcatcatgttggtgctcaaaaagcttcagattttacagcatttcagattttggttttcggattagtgatactcaacctgtatggacttatttgcatttgaaaagttatactgaacaaaacaatactttgcttgatgttcctggctgatactatgaatataaaatattacaaattgctataatatggtatagatgctctcaggatgtttggactttctgtctagttttcttgttttttgttaccctccgccaacccccctgggtgtatgcatccctggtgtctttttgtgtgttcaaatttcctcttctaacaaagacaccagtcagattggattagggcccaccctaatggcctcattttaagttagtcacttatttaaagcccctatctccaagcatagtaacattcttaagtacttgggattagggcttcagcatgtgaatttggggagaaggcatgaatcagcccttaacagcccataaagccctagacacactgtacgagctttgtaaaagttggttggtggttagtggttgatggtggttgcaggactctctgctcccacccctgtctgactgacttccctagttgtgtctgagcctggaagccaggtaatcagagttagtatttcctgtaaaagtagaagtgaatagttatgtccacatggagaggcctaaggcattaagctttggtaactctgtagcctctatttatttatttattttccttctttctttcttttctttctttctttctttctttctttctttctttctttctttctttctttctttctttcgtctttcttttctttctttttcctttctttcctttctttttcttttgtgttgtgttctgttcttttctttttcttccctttctttcctttcttcctctctttccctttctttccttctttcttttcttctttctttctttccttctttctttctctctctctctctcgcacgctcgctctttctctttctcgctctcgctctctctctgttctttttttttttttttttgacagagtctcgctctgtcgcccaggttggagtgcagtggcgcaatcttggctcactgcaacctccacctcccaggttcaagagattctcctgcctcagcctcccgagtagctgggattacaggtgtgtgccaccgggcctggctaattttttgtatttttagtagagacggggtttcactctgttagccagggtggtcttggtctcctgatcttgagatcctcgcacctcggccccccaaaatgctgggattacagtcgtgagccactgcgctcggtctgatacctagcattttcgaaatggtcacgttatcttttaaaagctgtagctaactctgcatagcataaaatttgccattttgactattttgaagtgtacaattcagtcatattaggtacattcacagacctagcactttgggaggccaaggagggaggatcactcaaaaccaggagttcgagactagcctgggtaacaaagcaagaccatgtctctacaaaaaaaattaaaaataaaaataaataataataaggacattcacaatgttctgcatccacaagtaccaaccacttccataactttttttgagatggaatctcactctgtcgcccaggctggagtgcagtagcactattttgggtcactgcaacctccggctcctgggttcaagtgattctcctttcccagcctcctgtgtagggattacaggcaggcatcaccatgcctggctaatttttgtatttttagtagagatggggtttcaccatgttggccaggctggccttgaactcctgacctcaggtgatctgcccgcctcagcctctggaagtgctgggattacaggcatgagccaccaggcccggcccacttccagaacttccccatcaccctaaatagaaactctgcacccattaaattgtaaatgtccttctcccccaacccctggctacctctcttctcctttctgtcccgtcactttttaaccatgctgtttcacagtagccatttgatgagacaggagactggacctggccagtcctttgcccatgggaagggattaagattggtgaggtcagcggggagcagggatctgggcctggggagcagggcctggggagcagggactgggcctgggccgcctcaccatcttccttctcttgtttccctttcactgccatccctctttgaaatggcttcattcatttgtccagaatatcaagatttggtacccagaaaggcagggacagtgtgcacccgggagacagaagacgtctttcccccggcgcacactcggtgggttttgttggagctcatccagtggcctgggttagaagtgacgcatccctgtctcactctgtgcttgcagacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgccacgacaaccagtgcatcctcatcaggtaacggggctcacagccagtcggactttcccatggcccaggagtccctccgcgcacccccaaccccagcctccttagggcattaaccagaggaagcttttacaaccgcctgagtttctccgacagagttttctgttttgaatggcatggtaacttcagctttcagaaggagcttacttagcaaagcagatggaccatgttgcttggctcttgtcctcagaataattattccattctgttccttttttttttttttttttttaaagcaacatttatttgccttaattattctttgatttatttcaatgatgaggcatggtccttctatctgtttaaggaaatcttgcatagttctttcaaatttaaatgttttatatagcctacagtgctactcacaaggcttatgtatgtgaacaaggtttcttttttctctactgcaataaaataactctagatagaatctcccaaatttaggaatttttaataatagggtgctcttaaagttaattagccacagaagaggggcttactgtgtgtatgttaagggcatgtttatttcaatatttttttttagtgggtgagaaggcacttggcatgtctattttagctgagtcgtactcgcttttacaaagaaactattaggagccccaatatcagctcctttattactagaaactgtctaaaaaagtagtagaatttcttttttttttttttgagttggagtttcgctcttgttgcccaggctggagtgcaatggtgcgatctcagctcactgcaacctccgcctcctgggttcaagtgattctcctgcctcagcctcccgagtagctgggattacaggcatgcgtcgccaccaccccagctaattttgcatttttagtagagacggagtttctctgtgttggtcaggctggtcttaaactcccgacctcaggtgatccgcctgcctcagcatcccaaagtgctgggattacaggcgtgagccaccgctcccggcgagtatttttaaaataaatatttattggctgggcacaatggctcacacttgtactcccagcactttaggaggccgaggagggtggttcacttgagttcaggagttggagaccagcctggccaacatgatgaaaccccatttctactaaaaatgcaaaatcagccaggcgcggtggctcatgcctatagttccagctacttgcgaggctgagatgggaggatcactttaacccggaggtggaggttgcagtgagctgagatcacaccactgcactccagcctgggtgacagagtgagactccttctcaataaataaataaataaaatttcttaatttttattattaacattcaaattgacctcatcacatgtatgctattgacatcctgttggagtttgttaattatttctattggacctgtgctctagtgatgatcctcacacccctgggtgatactcagagcagacgggatgcatgtcagtctcttctagtgaggtttccgtggaggcgccaagcatttcttcattcatttctcctcgcaggagttcactcacggggtatagttgttactgaggagccacagtcttgtaaagctgccagtgtgaacgaagattccgacatctgcttcagatggctttctagtcccaacttgtggcaacttggctctcgtcctcagaataattatattatttcctcagaatagttattatgttatttcaggaggaatgggaaagggagaggaaagggtggtttggatttggcgggtgatgtcgggggagggggggacactaaaaagacccctctctccggatttccgattcagtggaagtaagaccacaggagacatatggagagccatatgtcagcctaagactcccagccaagtgggcctgtgagcactgcagccccgaatcacacagacagacccacctggtcatgggtatagccaggtaactggtggccatgatgactgtgggaaactgattcccagatggtggagaaaagcaggcaggtgctgcctttctcctttcaccccagagcacttagagcagccccccgccccccgctcctgtggggagggactggggttgggggaggacagaggtgccagaggaggcccctctgaaaccctggggcagggaaatggatggagaatgttagcattatcccatgtgagagctgattgaggatggataagaaataatggctcatggtttctgaaggattctgcgtgttggactctgtgccaagagcttgccaggcatcggcacattgaaacccctgacagccctttgatttgggtgctctatgatgatatctgcaggtgccacacacggaaagccatttgcaggggttgtgttcttctcactggcagtttttacccgttatcttttttgtagttccttttttttttaaacaaatggggattacatgtatatgaacagctgaattctgtctctgtctctgtctgtctctgtctctccctctctctctctctctctctctctgtgtgtgtgtgtgtgtgtatgtatgtgtgtgtctaacaggaggggagcatatgggcagaggtactgtcttctcgttacctaaagtctaacaggactaataatttgttgggccatagaaacaacttggatagagggactgtcagtgtattcagttaaacagatagggatcataacggcttgcagttaatcgaaatgaagcggctgcttaatatagaaacagcttttaagattcacatacccaataaaacaatttaatctgtgactagaaccactatttgtgggctcttctaaatgacttcataaaagttctggagttagaatttaaagatcattatttcagcatacagaatataatttaagaagattaacagaagggaagagaacaatctattttaacagatcaagttggtgtccacacttagatccttaaataattgccattgataattgcttgtatttattacattcagtggaaaaaatgagagcatgactaatatatcatttgctagacagagccgctaaagaagaaagcgaaacatcaaatgagatcattgtgcatatgtgtgtgtgtgtgtgtatgtgtgtgtgtgtgtatgtatgtattaaaacggaaggaggttggcattttcatggtatttaaaaataagggggagaggggggtggatcccaaacagaaagctccaattatgcaatgctgatgtgaacagagtaactgtatttatctaaattaattcaggaaacagagactttaagaatagatttctcattaaaatgtgttttagttttaatagctctcttcagcagttttttaaagtgggggttgaagctgtgggaattaagagaaaatggaatatagaaataggagttgctggacgtaggagccctgtttagatttccttgggcatgatctgccccctgctggctaaaatgtgttttactactttaaaaacattctcatgcttgagaaaataagcctgtttgaattatataggacttcatagatcaatttttctctcgctttataagtgaacatcgattggataggctcctctgctacttggtggcaatgccaggtccctgggcttctagtccaagcctcttcctttgatttcattttcaaggttgttgcctctcttaaggtctagttttaattttgccatttttgtgtacatttaaatgaatgctcatgctattacagttttgaatatatgtgtgtgtgtgtgtatatatatatatatatataaatttaaaacttacttgaattttccatctcataaggtcagtgtttgactttggttgatctctagtacatttgacattgactctagtttttcatacaccgtataggccagacagggtttagtttattatggtgtattagtccgttttcacactgttgataaagatatgctcgagactgggcaatttacaaaagaaagaggtttaattggagttacaggtccacgtggctggggaagcctcacaatcatggtggaaggcaaggagaagcaagtcacgtcttacatggatggaagcaggcaaagagacagtgaagaagatgcaaaggcagaaacccctgataaaaccattagatctcatgaaacccactcactactgcgagaacagcatggggaaaccaccctcatgattcagtcgtctcccaccaggtccctcccacaacatggcgggaaccatgggagtacaattcaagatgagatctgggtggggacacagccaaaccatatcatgtggtctttgcagtacatatgacttcttaaggtgtataatacagacaaggcctgtggctaattcatctttgcagcctggtacccagcacagtgtctgggagaggaccagcattcaacagctgccaatcaaaggatgaatatacagaatgactgttggttcaggatctttgcttgctttgtgtgttttggtttttcaaaacttgagtgatttctacttaaccatgtcctggactggtaattgagtgtttggtctttttctatttctagaaatacatttagaggtgatagtgttggaatgcggaacaaaacttgcatcctcgattagaaaggcaccaagcagaataaggcatgggggcgtgctcttgtaatatagcagatgaaagaggtggagtgggaaacacaaagaaaaaggaactgaaattcatcgagaagacttattcttgtgtattcctcagaggggcccaagaggcattttctgtagggaagccgaggcccagaactgtttggttggcttgctgaagaaactttagctattggcaacaaacataggatttgaacttcagtctctctgcctgtgaagtctgtatttctgttttttgtttgttttttgagatagagtcttgctctgttgcccatgctggagtgcggtggcacaatctcggctcctcctcccaagttcaagcaattctcctgcttcagcctcccaggtagctggggttacaggcgtgcaccatcatggctggctaacttttttttatcgtatttttacgatatgaggtttcaccatgttggtcaggctggtctccaactcctgacctcaagtgatctgcctgcctcagcctcccaaagtgctaagattacaggcatgagtgaagtctgtatttccagaacagaatcctactttctggtacagcttccaaacaaaagggctttgtttggcttgctaagacctttggagttaatcttttaggcagtagagaagtttcccaagttcatctaacaattgaaggaatgatccgatttatattttgagaaaatcatgtggatcaagggaattgatttctaagtagtgttatagatggcagcaaaaagttttgtgtaaagagccaaagagtgtatattttaggctttgtgggcgaaagcacctctgttgcaactaatcaactctgcccttgtagtgtgaaagcactcagtatgcaacgcacagcctgcactgtgttccaataaaactttatttataaaaacaggcagcaggtcagagttgaggaccattgtttgctgacacatgggctggatctagaaaactgccagccttgatgtgtgctgctgggaggctagcgtgtcctgtgcaccaaaggccctgctcgtatcagattccttttccttcaggtgtgtcatggatccctcctctctgctcacccgaggacattgctgcatctctgagcctccttgccctggattctttgacctctctctcaactggattgttgacgttattcaaaatcttttagtatgttccatcttggaaaaaaatacaaaagatgctcgtttggttccacagcctcattcaactactccttcgtctcagcaagctgcccccacgccccccaccatggcgccccatcctatatttcttcctggctctccacggccactcctcagcttctcagtcatttttcatctgctgtcttctcacccacctgcgttttcttctctgagtctgcaggactctccaagtttatacaccctcaacttctcatttgagtcccagacttaagtcccagtgccccttaggtgtcatcactgagatgtctcaggggtggcatgttctaaagtcagtatcatcttctcccagaaacttgtccctcctcttgtgcctcctattctcagccagtagcctctccatcctaccctgtcccaagcctgagatctggaagtgattcttccccgccgccaccaaattaaggtaaacttacacacggtaaagtatgccagtcataagcatccagtttgatgagttttgacaaatgcacaaacctggtggtaccaattcctgaatcatcacgccagcaaacactcaggggccccaggagtcatccctgatgcctccctgtcacttgctgcccaccccctggccaggcccctcagcaatcctgtccctttccctccagtctttcttgggcctctcacttcatctctgctgcccccgcggcccttcccgcatcacctttttggtctccctgattcttctcttgcctcctttctgtccattctccacgcaacagtcagaatgattctttggggcctggtggctcatgcctgtaatgccagcactttgggaggccgaggcgggtagatcacctgaggtcagaagttcgagaccagcctggccaacatggtgaaactccgtctctactaaaaattacaaaaattagctgggcgtggtggcaggcgcctgtaatcccagctactcgggaggcaggagaatcgcttgaacctggggaggtggtggttgcagtgagccaagattgcgccactgcactccagcctgggagacagagcgaaactcacacacacacacacaaaagaacgatcctttagaagcttaaatctgatcatgacactctcctgcttaggaactgtcttgtgactttccattgtgcttacaaaaaattctcacaatttttaatacagcctgtggccccccatcagtgctttgggtttgttttcacattttcattattatagttagaaagtttttttttttttttttttttttaaagcaaaacaaaacaatataagctccttttggttaatctgaatgcacacatttttgccaaagcctgtgtttgtattggctggcctgctggcacaaggcatagaactgtaattgccttgggctaatgaggaccaagtggaactgcaggctggaggaggaggagacgggttagacagaaatgtactacctgcagagtctgtgaccttgacattagtatctcgggacatctggcatatttctgggttttagcagtttgtgagttatttaattatatttcttctttgccctgttgtttgtaaaacacttccacagcccaatatatgagtagacaccacttacctcctggtagagtcctatctgaattatgtgaggctgctttccagagtagcagttcttcaacctggcttcatagtagaatcattcaaaaaaaaagagagacagggtctcgggtctcgctctgtcacccaggctagagtgcagtggtgcaatctctgctcactgcaacctccgcctcccggattcaagtgattctcctgcctcagcctcctgagtagctggaactacaggcacccgctactatgcctggctaatttttgtatttttagtagagacggggtttcaccatgttcgccaggctggcctcgaactcctgaccttaagtgatctccctgtcttggcctcccaaagtggtaggattacagatgtgagctactgcccccggccaaaaatttttttttttaaataaaaatgacagagttctacacccacaggtttggacgagggacctattaggtgattctaatatgcagccagggttgagagccaccaccgtagagctctgtgcaaatctgagggtttttccaagttttacttgcacagcttgagtatcccttatccaaaatgctttgggctaggcatatttcagctttcaggttttttccaatgtttttggattttggaatctttgcattatactggtcgagcatccctcatgtgaaaatttgccccaaagaaccccaaagaacatttctattgaatgtcatgttggcactaaaaaaaagtttcagattcttgaccatttcagatttcatattttcagatttagggttactcagttggtataatgcagatattctcaaaatccagaatctgaaatcagaaacacttctcgtccccagcatttcagataggagatcttccacctgtataagagattgacagagattgatatccatgacttggtccatttccagccgtattttttctcaatgtgtcatacactcttgaagcatctttatgacgacgagaatcctgggttttctttctttgaccaagcctctgctgtagagtttgaagagtatcgtatcttctccataattgtatttttgccatattgggtgagccaaggtaggctggctgctatgacagacagccatcaaatcttaggggtgtaacacagggatggtctatttcttgctcctctcacggcccctggtgggtaggggagggactcgagtctactctgtaggcttctttgcttgggagatgtaccatctctgaggacacttaggtggcaagcggaaggtggagcccagaggactgtgaagggggtttttagctaccaggcatagaagtggctgatagccccatggctcagttgttcaactggctacacttggtccccttgttactgcctgcctgccgggttttttgttttttgttttttttaattatttttttgagatggagtctggctctgttgcccaggctggaatgcagtggtgtgatctccattcattgcaacctccacctcccaggttcaagtgattcttctgcctcagcctcccatgtagctgggattacagacatgcgccaccacgcccggctaatttttgtattttgagtagagacagggtttcaccatgttagccaggctggtctcaaacttctgacctcaagtaatccacccgcctcagcctcccatggtgctgggattacaggcgcaagccacagtgcccggcctctgcctgctgtttttactgcaagggagtctaaatgttttcggcttctgtgtgcccgaggataaagaggtaggtagaggaacacataacattatttctgcctcaccattttcactagacaacttaaccttctagtttttgttttaataactcagccaccaacagctgtcgcgtcaatatagatatgttttaaatatggaagatgatttaaatcgttccttgaaactgtctctcttggtttctgtgagtcattctgtgcactgttgttgaatgcctcccccgtgccaggcactgggctgagcagatgccagttattcaatgtatgctaagctctgtactgggaagattctggtggctggtaagggaaaccccaactaaaggtggcctaatttatgctgccttttactatttcagactacatgaggcagggcagtttcagggatgtggattcagcccccgccccggctgggcttgcctctgattttcttggcttttgctttatgatttcaagacaggtttagatcgtcagatctttgttgtctgccgcaaaagggacatttccgcccagtgtcgtgtgtgtgcgcaaacctcccctaggagcccacagtacccttgacattacgacattatgtctttgtggaatcgtgacactggcccctgcccaggcctgtcgctagcagagcaggtgaaaggactgtggttgtctagaccagtggagatccctgggacccctgcacccagcccggcatgttggcgtcatctctgagtcatttcttctcttttattacatgcaattgattcacatttttagcaaaattcctctttcttgataacgtcccagctcttggtactccacaggacttctctttagaacgcaaaaggggctcatctgcccatcccaccattcagcggttgtcagcgtgctgcctcgtgatggcgtttgtatggctgtgctcttgcttatcccttcagtttacctttcttgtaagtttccagcctctttgctacttctgttctctgcacaacaccaagcatggtgccatatgccagatggatggggtttctccgttcaagtctctctcatgtccgtatcttcctctccgtctccagccttgttaactgtgtttgggacctggccaccgcgggcctaaacaacggcagcagctggtctcccgagggacccttcggtccttctagagcttttcctccagagctgcgtttcctacaggtggccttgatgaggtcatcaccaccctccagctcctgcacttgcctctgaagcatccagctgaacctcagctcatcttctctgccgcctttcgtctcagcccagctgacctaaccagacctggatctcattctcccataagaatctttcccagcttctgtggtttctgtgctttcttggcctgactcatgtttgctggtcttttaaggcataactcatcccttatttacttctgtcctttgcctcccttccctctggattttttgttcacttgtccttaactatcactaacacgtgaccttggcaggactttggatcaggccgagctggcattaagagtccaactcggacactcagccatgcttccctcatgggattattgtgggaataacatgagttagtgtgggttgtgtacccgcaggttcattgccttgtcccctcagtattattcatgaatgattgcatttttattcatgtgtacctgctttaagtttctcagaaagatcatgttagtgagctcatgcatttaaccaaacgtttacacagtggaggtgtttgggatgaactagtgaacaaaatgaagatccctctttcccagagcttaccttccctgtgaggcaccatacatcttatgacctttccttaggaaaaggtagttctatttgcctcatttgccaaaagaggcgagtaaggccagacacaatgtggccagcaggagaaaggacttttgctttcttttaactcagctctttggaaacaggcattttgatctccctcttcccacctttctaccattgttctgttgagtaattatagtgccattgaccaaagctgatttttttttaaaaattatagttagaagcacaaacttttccgttttgtctttcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcaggtatttattgattttcttgtttccaactaataggattcactttccttatggtatggcttatttaaagaagagttaaaattagttggtcgcgtttctctttttcttgacttctcttttacaattccttaagaaaaggtcttgccatgcacatagtaatatctcatgaacccagcaacaactccttctgcctcctgccccttcatcgtcaggccaggtctgagatggggactgagtggcgcccaatggctgtctgcagagcctttgactccagcttcatgtgtttttgaagcacctgcatcagataaggcacttgtattggagtttatggagaagaataaacttgactagttttctggaggccttgttagcagcagaaatgtcagcccccagccactgtgtaaaagggggcttagcgtggagacgagcagggttcaggtcagcatccaccgcttggaggcttaacatgagcagaacgggcctctcgtgtgtggaagatgagtgatgcattctatataacagggagcctcaaaacttagaaagagggctaggtgtcacccgagttgttgtataaactatgtcattgcctgatagatggtttgtgccttataagactttagaaccggtagggactttatacaccctattatttagagatttgtccaggggtcggcaaaccacagcctcgtgcccatatcttgcagcctgtttttgttttttgttttttagcatgtaaacacaccatttaaaatcgtggtaaaatatacctagcactaaatgtgtgttaactgtttttcagtgtacggcgcagtggcgttggcattaagtacattcatgtttgttatgcaaccattgctgccatctgtctccaaaacttcatcttcctcctgtaatctgtttttataaataaagttttattggaacccagccacactcatgagtagtgtttacagctgcttttaggctatagtggcagagctgagtagttgcaaccgagatcccgtggtctgcaaagcctaaaatacttactgtctggtcctttccagaaaaagtttgccggcccctgatctagtcagactccatcttacacttggaaaagacccaaagaaattaaatgagttgcccccgggacatacaacaaataggtgaaatttccaggactggaacttcttcagtttctagaattggggtgggctttttctgtgcagtccctggattgtgcatgtaaggccacactcactggtgcaggaacgagccattgcggtccccttaactgtgtggcatcccttggcagcacagctacgctcactaagatggatatgcagataagcccatttcaacaagcattttgaaaatctggctcttccggaaataaacattgccaccctcagtccttttggtttcagatttttcttgcagttgtatattttgacatttgtgagaagtgctattgctgtcttcagacccacccttattaatgctgtctgctgccctcactgtcttcacagccccatcatggaagctttcggcaatgcgaagaccgtgtacaacaacaactctagtcgctttgggaagtttgttcagctgaacatctgtcagaaaggaaatattcagggcgggagaattgtagattgtatcctctttcatttatttttatctatagtaattgattctctaagtggaaactgttctcactaattataaggattgaaaaagaatgtgaaacatttctttctctggttctttaacgaattagacagttagttattgctctaatgttagtatacctgttaattttttctatgagatggacatggtacatgtgcctatagttacagctacttgggaggctgaggcaggaggattgcttgagctcaagagttagaggccagcctgagcaacatagcaagaccctgtctcttaaaaaaataaaataatttttaaaaattattctgtgcggccaggcgcagtggctcatgcctgtaatcccagcactgtgggaggccaaggtggtcagatcacttgaggtcaggagtttgagaccagcccggccaacatggtgaaaccccaccgatactaaaaatacaaaaattagccaggcttggtggcgtgtgcctgtattcccagctacttgggaggctgagacaggagaatcgcttgaacccaggtagcagaggttgcagtgagccgagatcgtgccactgcactccagcctgggcgagagagcgagacactgtgttaaaaaaaaaaaaaaaaaattctgtgaaataaagaaccgtatttgttttataaatctctgatataatttccataatctgaaacattgacttcatcattaaacttcaggtatttgtttgaaatcaactgtgtcagttagtttggtacctgacagggtaccatgtgtcaggcctggaattagatttagatgaaatagtctatactttgtttgcttgtctgttggcactggaagcttctatgtcaaaggaacagggaactgtaattatttgagcaccaaagaatagaaaatgaaagactagttgagcatggcacatagctttgtttttttccttgacttgccattgcttttcacatgaagatttattagaaaaagtaagtaaacgtgatttaatccacattttcttccataataacaattttcagaaattattggtttgtgtgaattaagcacaggacacatctctgaatataaatctgatttatcttcccagaaccgagtagtaaggcaaaatcccggggaaaggaattatcacatattttatgcactgctggcagggctggaacatgaagaaagaggtgagtgggacgacagctggataatgtggactagcaactcattttccatttaaatagatgtcagtaaatgagagaacatctgttttaatgttgacatttcaccgatagcaatgaaatgtacactatgcgaacaccaaaaagatgctgaatttacagtagggagaaataatagggagaaaattatcagtagagaaaccttagatattttttttttgagtcttggtacatttttaatgtaaaggatgtttattaaaaatacatattacagctggtttcacttttcagccaccctgaataaagttaatttctaaatattttatttttggctgggtgcagtggcatacacctgtaatcccagtactctgggaggccaagcagacggatcactggagatcaggagttcaagaccagccaggccaatatggtgaaactccgtctctactaaaaacacaaaaattagccaggcatggtggttcgtgcctgtaattccagctactcaggaggctgaggcaggagaatcgcttgaacccgggaggcagaagttgcggtgagctgagattgtgccactgcactccagcctgggtgacagagctagactctgtttcattaaaaagaaaaaagaaagattttttaagagaaaacaaacaggatcctcatcagttgttctttcagtaacattttttaaataatctcatttagtttcagtaattgttttctattttccctagatggtaactaagagggaactttattatctttatgggagactgttaagagcacagaattatatatatatactttaaaaagtcagagtgaaaactctgaatttcatcttgtcctggagaactgtgacatcatgtttttgtctttctgtagaagaattttatttatctacgccagaaaactaccactacttgaatcagtctggatgtgtagaagacaagacaatcagtgaccaggaatcctttagggaagttattgtaagttacttttaaatgttttccctattaagatatcagataccttattaagagtaacagatttcattttcggtttcaaaagatttttttaaatagaaatagaagtaattccatttggaccagtgggtgagaacaggtatttccttcttgttccaagtcatgaacttgttccaagttctaggctgaaaggggtttgaggactcttctttccttagaagatgagcgaatgtgtcattcagggcagatgggcagtttacttgggacagtgtgttcagaaagtgtaccttccacccccaaaaaaccccccaaatcatgggcttcactctggaaccagcagatcctccattttggggcttacaagtaagatttctttgaaaaacaaattctatagctaaaaacaaatctgccagccattggcccaggtgactgttgttgcagaattttgctcctttgttcagctaaaacctggggtcttgtcacacgatcaggaaaacttaggcacagggacacgttgaagggtgagtagagcagggttttattgggtgaaaggaagatggccaggcgcggtggctcatgcctataatcccagcactttgggaggccaaggcgggcagatcacgaggtcaggagattgagaccatcctggctaacacggtgaaaccccgtctccactaaaaatacaaacaattagccgggcgtggtggcgggcgcctatagtcccagctactcgggaggctgaggcaggagaatggcgtgaacccgggaggcggagcttgcagtgagccgagatcgcgcaactgcactccagcctgggagacagcgagactccgtctcaaaaaaaaaaaaaaaaaaacctcagcaaagcgagaggggttcctgctaacaggcccccacctcacatgttgatttccaggtcactacaggagcggaagagagcaggcttctcttccccgtggaagaattccccgtggccccacccacttcccccagtgcgtacgtcaggctccagttcactgtgggatgcccagacaagccctgggcaggttccctcatcgacccaaaagcatctaatgtaaacattcttgggacgcttggagattctccagggaccccattttatctgcctaagcatttggctgtctcatgttaaggtatcatccagccctcgtggcttgtgatggccatttctggttgcgtgagcattagtcatcctgtctctgcattgtggcatgccatggtctcttgcaagggctttgttacaaggtatctgcatttaagatagcccagtcatcgagcgttgcgaacagccccacccaatcgggcctggccaggagatttcatcactgtgatcttaagttctttaccagagcccttattagaacagttagatgcagccgggcacggtggctcatgcctgtaatcccagcactttgggagggtgaggcaggcggatcacgaggtcaggagttcaagaccagcctggccaacatagtgaaaccccgtcactgctaaaaacacacaaaaaattagctggatatggtggcgggcgactgcagtcccagctacttaggagcctgaggcaggagaatcgcttgaacctgggaggcggaggttgcagtgagctgagatcacgcctttgcactccagccttgtgacagtgcaagactccgtctcaaaaaaaaaaaaaaaaaaaaaaaaaaaaaaaagttagatgcaatgcacctagggtggcgtcattatcattctaatcatcacaaatgcagctgacatttagtgagcacttactgttatgaacttcacatggagtttactttccaatcactctcatcaaccctctgatggtaggaagtatggttgtctccattctaagactcagagaagttagtgaccagcctaaccttacccagtacctggtgcagcccatatccatacacagtctaactctggatcccacactctaaaccgcgatgcagtaatacctggtttcagtgcacctcagattcgtcctcctaggctgccgctggaagactagcagctcttcattctgttttccttttcattgtcatagattatttgttacaactgtctgtggaatgaaatcagaatatttttaacaaatggatataaatcatgcatcatttctctatggctaacatgtgtctccttaagttgaaaatgaaattccaaacggactaggctatatacatgattgttttccactctgcctcccttttaaagatgtcacaacctgccatttataatgcagagcggtttctcgctccatctctcctattttctaacctgttaacaaaaaccctcctgcagacagcaccttttggcatctgcctgcggaggtgtgggatttggccttgcacgttgggttttatgcagtgtttttctaagtattttaattatcttttccaattttatattggccctttagacctctcactactcaaaccttccatcacggttcatttattactgtctgctgaaaagatgatgtgttagaataaattctcattctcgtttttgaggagcagggcaaaaaaaaaagacttgtctctggcttttttcctattttatttcttgtttctttcttgaagtaacgaacaataatttgtgataaaagaatacagacaagacacctgattatccacatggcagtgtcactgcaggtcccatcacctgcgagctcgcttgctggccgctagggagcacttggcagtggcagctcccttgtcctgggaaggccctgagaaatcagatactccgttggtactctgtgttctctcgggacatcattttccacttcagaactgtctgttctttttgtcagctacaagtaaacttttggaacttggcttcccttcagtgattgctagcttttattgctacattgaaataataggtcttggcatttgaaatttgattttatgacaaaaggatatgtcaatcacctagaaaggaagagaaatttatacatgaaattgacataatgagcatacctaacaaatttattctagttaatacattctacttataaaagatatttatagatccttaaatatctaatttgcaattactttttagtgttagtctagcaggtgtatcaatgaaaacttagctgatgtttattaatatcacaaacatgacatttttgctataataatagcaaaatttaacccgttactctttaaccttgtactggaaattctaagcagtgcagcaaaaagaaaaagagaaaaaaaagtgtaacttttgggaaagagggaggaaaatatattcctttctatatacaataagattttcttctcccaaacctatgagaatcaagaattgggggataggcggggtacagtggctcatgtctgtaatgtcagcactttgggaggctgaggtgggcagatcacttgagcacaggagttcaagaccagcctgggcaacatggcaaaaacccatctctacaaaaaaatacaaaaattagccgggtgtagtggcacacacgtgtaaacccagctacttgggaggctgaggtgggaggatggcttgagtctgggagatggaggttacagtgagccgagattatgtcactgcactccagcctgggcgacagggccaggccccatctcaaaaataaaaaaattagaaaaagaattgggtcatgcctataattccagcactttgggaggctgaggctatggatcacgaggtctggagttcaagaccagcctggccaacatagtgaaaccccatctgtactaaaaatacaaaaattagctgggcgtggtggcacgtgcctgtagtcccagctactcaggaggctgagacaggagaattgcttgaacctgggaggtggaggttgcagtgagctgagatcgcgccactgcactccagcctgggcgacagagcaagactctgtctcgagaaaacaaacaaacaaacaaacaaacaaaattggccaggcattgtggtgtacctgtagtcctagctaccttggaggtgtgaggattacctgagcccagggagttcgaggctgtagtgagccatgatcatgccattgcactgcagcctggatgacagagtaagaccctgtctcaaaaacaaaaaacatgattctttttatcaactttaatgttagtgtattctggcaataggaccttttaagaattttgcttatttcattgagaatttgccttaatgtatttttaaaatttatcattggtcgcaataaacattaatataaaaaagtacctatgaggtattctgaacagttttaggagcgtcttggtttttcctggggcagaggcaatgaacctatgctaaatttcataggcatttcttatacagcccttcaaattgccccttaaagtgttaggtcaggatgaaaagctatttcaagtcagtagtaacaactggtttattttattgcttgcatttggcccaccaggttggtggctgatgaaatgtgtatgaagtaacaggagtctttgctgagtgatcatctgtttattcttttactccacaaatatcgaatgtttacagcgtgcctggcactgagcagggctggggtttcctgaccatatggaccttcctgggtatatctgtggggcttgaatggtgtgtgaccttgtgtacgcatgcgtgaattcatttgtcatgagtcagattttattaaaatttaaaggaccaactttttactttcatgttgtgaaacttggaaatgtcagtctctttcagtgttggaaaacttgggtggtcagccaattttatattataaagtatttttaaaataatataatattacttgataaaacataacattggccgggcacggtggctcacgcctgtaatcccagcactttgggaggccgaggcaggcagatcatgaggtcaggagatcgagaccatcctggctaacacagtgaaaccccgtctctactaaaaatacacaaaattagccgggtgtggtggtgggcgcctgtagtcccagctactcgggagcctgaggcaggagaatggcgtgaacccaggaggcagagcttgcattgagctgagattgcaccgttgcactccagcctgggcaacagagtgagactccgtctcaaaaaaataaattaaaaaaataaataaataagtaacatgatgtaataaattattactgagttacttacttgtaatttactgtgcccaaaatagcctcccctgtcaccctttcagacacaccatttgttgacttcttctggaggtaccttctctgagggtgacactcctccctttgtttccagggtgacaagctgagctccttttgtgcatgatgattgggactctgccgtgtattcgccaccatcccccaacacacattcacgttcacaagcatctgttttttatgtgctgaatcatagaatttcccatggttttttcagtcttgaagcctagtgttgaaatactaattataataagccttgaagtggctactcttgtcaaaggggtggagattgcttattaacaaagattgtaaataggagagtaagaaacaataaatagagactcttgctggagttttagcatacatgtctgcattggcgagaactggttttagacattaaattattccatgttatgattaatgcagttgccgcttatcacaacactactaactacttgcccaatcacttagagttagactagaaagcaaagaagtccacaaatttattaatatagtaaacacatttgttcatttgcttacatatcttcttatacaacctttgtatttttttttagaacttaaccaaaaatttttatttatgggatatgtgtcaatattttttatttggcagttagaaattttctactacttatttcacttttttttttttttttttgagacaaggtctcactctgttgcccaggctggagcacagtggtgtgataatggctctctgcacccttgaactcctgggatcagatgatcctcctgccctagcctcccaagtagctgggagtacaggtgtatgccagcacactaggcgaatttttaattttttttagaaatggggttcttgctatgttgccaggctaaaaaatgattatatattagttatgaatatatcttgtcatagatgaagaaaactttaatcatagaaagggaaaaatttaacttttgcacagtgtaggtgcattataattattttgctgatatctgatatggtctttaacacagtttaaaaagtcttgagaataacaaattatttgtatttcttaaccgtatttctttgcttttaccttttagaagaaatcactgataaatatctttaaatttgaataattattttctcataggctttttaaaattgataagcacttggcaaatagttcttattctttgtttctgtttgtatgcatgaaatgatagccttcccaccttcaagtaatttatggtattttaatttttataatcaactttattgagatataatgaacacataattaaatacgtccatttaaagtatacatttcagtgaattttgaatttacacacccatttatccacaactgtgatcaagataaaagggaatcctctgccccaaaagtttctctgtgccccttcccaggcaatcccaacccccccacacctggccctaggaaactactgatctaatttagtccctctggtatatggttatcttctttagagttccatgtaactaaaatatgcactatgtagtgtcctgtatccagcttcctccagccatccatgtggcacgtatcactattcactgctttttttggtattccgttgaatagacagcagtttgtttatccattcacccattgattgtctcattttttgttgtaaaagtatttattgccagcaacattaaaagacatgatagaatagaatgttcatgagcttgccagcactgttaactcacagttaacccttaacagtaactattggaactagtttcaaatttgtaaattttcttcccagactgcattttaaaaataatataggtacaaaatagcttttttgcttttttacaaaaagctactgtaaatataactgtgcctctatatcatgtgcataattttctttaaaaagtataccataggctgggcgccgtggctcacgcctataatcccagcactttgggaggccaaggcgggtggatcacctgaggtcgggagttcgagaccagcctgaccaacatggagaaccccctgtctctactaaatatacaaaattagccaggtgtggtggtgcatgcctataatcccagctactcgggaggctgaggcaggagaatcacttgaacccggaaggcggaggttgtagtgagccgagatcatgccattgcactccagcctgggcaacaagagtgaaactccatctcaaaaaaaaaaaaaagtatgcaatattcatataacttactatatttgacttgtataattgtagaataattagaattattttttctgtgaaagtgttaattaaggtaactctgtagtgaatgttttctaaaggttttttttcttttcttgaaattttccttgaaacaaattttcagcattgaaattattggagattatatagatttcttttttatgtctttataaagtaacagagttgggtcaataataataataataatgataagttcctggctgggcacggtggctcatgcctgtaattccagcactttgggagacctaggtgggcagattgcttgagcgcaggagtttgagactggcttgggcaacaccgcaaaactccatctctcctaaaaatacaaaaatttagccaggtgtgttggtgtgcacctgttgtcccagctactcaggaggctgaggtgggagaatcacctgagcctgggaagtcaaggctgcagtgagccttgatcacaccactgcccgccagtgcaggtgacaggagtgagaccctgtatcaaaataataataataataataataataataataataataataaatcataatagtaagttcctagatttgggtcagttgggccagagtttgaattttggttgcgcgaccctgagaaagttatttttcttctctgaacctttgttgttggtttttctctcagatatgaaaattctagtattatatacatattatatacctaggacaattctgtcagataatcatgttgttttccaaaaagattatactaatttatagtactaacaaccattgtataaatgtctcttttctactaatctttgtcattctgaaattttttgctaatttgacagaactgatctcatatttaccttaatttgtacatgttcgatttctaggaaggaaaaaaacagtactctggatttgcatttctccctatttttatcgctcatgtatatgtcagtggatcttttaattctttccctctccattgtttgccttttctttcctgccattattgctttttctttataaagaaattaatcttggcctggcgtggtggttcacacctgtaatcctggcactttgggaagccaaggtgggcatatcacttgaggttgggagttcgagaccagcctgaccaacatggagaaacctcgtatctactgaaaatacaaaattagccaggcgtggtggcgcatgcctgtaatccctgctacttaggaggctaaagcaggagaatcgcttgaacctgggaggcacggggtgcggtgagccgagatcgtgccactgcaccccaggctgggcgaaacagcgaaactccatctcagaaagaaaacaaaaaaaagggaaagaaattgaacttttcgcagtgttaaatctccagttgtttccttttgcaatttatgttgcttcagagcggtgcgtggtttccttcttcccactctcctatggtccttgtgtgagtccaagttctttttgtaggtcattttcatcgatattgccaacaagtctgcccccaagtttgtgtgtacgtgtctggttttcttttcttttttaatagctttttttggtcacaagaatgcagctcctcagtcacagtagaaaatcagcaaatcttagatatgattcagaaaacacctggcttcagttgtttagatactgttggtaacagattcctgtaagtgcctgtttatttttatttttcctcaaacagcattatgttaacttccacttagtatcctcaggccaagataagaccataaaaaatcctttggagaaattaaaaatagagatgtgatgagtgcctaaggaagataggtccagatctatttagattttccatcagcatttatttaatttttttctttttttaagagacagggtcttaactgtgtcacccaggctcccaggctggagtacacatgcgatcatagctcaccgtaaccttgaactcctgggttcatgcgatactcctgcctcagccaagccaggagctgggactgcaggtgtgcaccaacacacctggctaattttttaaaattcttggcttggcatggtggctcacgcctgtaatcccagcactttggaaggccaagctggaaggattgcttgaggccaggagtttgagaccagcctggccaacatgagacccccatctctacaaacaaaacaaaacaaaacaaaacaaaaatacaccccctctccaagtactccctctccacatttttacatctaaagaaaataataaatatttcattacactctgatagctgtacagaaaactgtttctttattgttgtcatgactgtgactccctgaggtaattcttttgtagcatatataggaggcttgtatgtaagggggacactatgtttatttcattgattatctctgagcatgctatagttctttatcttcctcctcttatgtgcactatgtaatgtcctcatcattttaaaagtgagttgctattgggcgggcgcggtggctcacgcctgtaatcccagaactttgggaggccaaggttggtggctcacttgaggtcaggagttcaagaccagcctggtcaacatggtgaaacccagtctctacaaaaaacacacacaaaaaattagctaggcatggtggcacacacctgtaatcccagctactcgggaggctgaggcacgagaattgcttgaacccaggaggcggaggttgcagtgagccaagatcgtgccactgcactccagcttgggtgacagaacgagactgtctcaaaacaaaaaaacaagtgagtggttatgcatctattttttgtttctttgccttttcaataacacctagtaattttatattatcagggatattctacattttcttcagtgtgaaaaaacgacataaaattaaatacatttattttcttctagacggcaatggacgtgatgcagttcagcaaggaggaagtttgggaagtgtcgaggctgcttgctggtatactgcatcttgggaacatagaatttatcactgctggtggggcacaggtttccttcaaaacaggtaagattatgcctgcctgccctcctcgctccctttgttccccgtgggaaacttaaacctaaattattgactgtctagcctttcagaaagaaaattctggccaggtgcggtggctcttgcctgtaaccccagcactttgggaggtggaggcgggcagattgcttgagcccaggagttcgagaccagcctgggcaatgtggccaaaccccatctctactaaaaatacaaaaattagccaggcatgatggtgtgcccctgtagtcccagctgcttgggaggagagggtgggaggatcacctgagcctctgcgggttgaaggtgcaatgagctgagatgatgccactgcactccagtctgggcaacagagtgagatcttgtatcaccaaaaaaaaaaaaaaaaaaaaaaaaaaagaaaagagaaaatgttctgactccttgaatagagagctacagaatgttagttgtgtcagatatgaagcgtcggttaggaaaggctcagagtatatgaaaagttactagtcaattgggatagcagccattttctctttttaaaaagaaggaaaatgagtcaagtacgtggaaatatgagcaaccaggaatcgacataggaaaatgttgagagtcaggtggcattgtcctgttgagtgccagcatggtagaatggttaattaagtccctttgttttgcaagccagtatgctggcttcatagccctcccctgcttcatactgtttcctgtgttctttatcccctgaatactcatgacttctcacctgtacagtgtctcagagatttgctgtcaagataaaatgagttaccatatagctacgtcagttgtcattttgcttgagtgatttatgtattaatttttaaaacttttctgatggaagcaagagatgaggtcatggaagctggaaattggatgagttcaagttcagagtggttctagaggagaccagaactgtaggccagtaattctcaaatgtctggttctacccagcacctcttaatattctcaaaaatcatagaacccccgagagcttttgtttatgtgggttgtatctgttgatgtttaccacattaaaagttaaaactttttggctgggcacagtggcccatgcctgtaatcctagcactttgggaggatgaggcaggtggatcacttgaggtcaggagttcgagaccaacctggccaacatggtgaaaccccgtctctactaaaaatacaaaaattagccaggcgtggtggtgtgcgcctgtaattccagctacttgggagactgaggcacgagaatctcttgaacctgggaggtggaggttgcagtgagccaagatcatgccagtgcactatagcctgggtgacaaagtgagactctatctcaaaaaaaaagtgaaaacttctaatcaaaagttaaaatgagatgtttaaaaaatattctttattaatttaaaaagaacaataataaacccattgcatactaaaataaatgttctatttttatttaaaagactgttttccaaatcagaaaacaggaaggatagtcacattgtcttatctttttgcaaatttctttaatgtctggcatattgaaagacagttgggggctgggcgcagtggcttctacctgtaatcccagaactttctttaggaggccaaggtaggtggatcacgtgaggtcaggagttggagaccagccaggccgatacggtgaaacccgtcgctactaaaaatacaaaaattagccgggcttggtggcgggcacctgtaatcctagctacttgggaagctgaggcaagagaatcgcttgaacccaggacgcggaggttgcagtgagccgagatcatgccactgcactccagcctgggagacaaagcaagactctatctcaaaaaaaaaaaaaaaaaaaagacagttgggttgtcatatctcttctgcctttaatttgttgaggtacctcatgtgtagcctttggaatactcttctgtatactggtgagagaattagagtgaaaaaagcagataacatcttagtgttattaatgaaagtagtaggccgggcatggtggctcatgcttgtaatcccaacattttgggaggccaaggcagggagatcacttgaggtcaggagttcaagaccaacctagccaacatggtgaaaccctgtctctactaaaaatactcaggaggctgaggcaggagaatcatctgaaccagggaggcggaggttgcagtgagctgagatcatgccaccgtactccagcctgggctacagagtgagactccatctcaaaaaaaaaaaaaaaaagaaagtaggtgggcatggtggctcatgcctgtaatcccagcactttgggaggccaaggcgggtagatcatgaggtcaagagatcaagaccgtcctggccaacgtggaggtcaacagattgagaccatcctggccaacatgatgaaaccccatctctactaaatatgcaaaaaaattagccaggcgtggtagcgggtgcctatagtcccagctgcttgggaggctgaggcaggagaatggcgtgaacccgggaggcagaacttgcagtgaaccgagatcattgcactccagcctgggcgacagagcgagactccgtctcaaaaaaaaggagttgcaaatctctgacaggatcttggggacacccataggattcccagaccacacttcgtccaagcacgaggctctatgctactaatctaggattcactaagggaatgagtaacttagcaataacatgcaatctctaaactctgcgtgagggattcaggtgtgttctctgcgttaaggtatcgctaagcctggttagcttcttgggggcggtgggttcattcacctttgtcttattctctgcagctttgggcagatctgcggagttacttgggctggacccaacacagctcacagatgctttgacccagagatcaatgttcctcaggggagaagagatcctcacgcctctcaatgttcaacaggtacacacgctttgccatctgatcttgcgttactagacactcctgggttttcagatccataggtttgattgaaatatgtaattataataacagttataactgtaatatattaataactgttcaaatgactggttcatgataaaaataaagaagataccaaaggattgggaatagacaaagctattgaattgctgtctaattgtctaaaataacatcgaattgttgtttaagaggatgggtcgaatgcagattgcctgactttgaacttgacccttctacttactactgtctgctcttgggaaatttagtcactatgcctcagtttcctccactataagacaagcataattatacctaattcataggattcttataagaaaaataacaaatatatgctgagcatttaatgtctggtacagagtaagtgctaaataaacattacttacgacaataatgtgttgttataatgaaaacaatataataatatgttttatttatatttgcctctgctactgcgctgagccaatgtatatgtgctagctctttgtattagggttttcttagagggacagaatatgatagatagattgatagatataaaggggagtttattaagtattaacttacatgatcagaaggtcccacaataggctgtgtgcaagctaaggagcaaggagagccagtctgagtcccaaaactgaagaacttggagtccgatgttctagggcaggaagcatccggcatgggagaaagatgtaggctgggaggctgtgccagtctcgccttttcgcatttttctgcctgctttattttcactaggagcttgtgcccaccagattaaggatggatgtgccttccctagcccactgactcagatgtcacccacacagacacacccaggattaatactttgtatccttcaatcaagttgacactcagtattaaccatcacactcctctaatatgtttttaattggataaatgaaaatgctgaccatattatgaagaaaaactttgtaaatacaaagtataatagaaaatcagaaaaattttaaaaagagctcacatcttaattattgttttaaacctggtgccaggtgcggtggctcacacctgtaatcccagcactttgagaggctgaggcgggcagatcacctgaggtcaggagtttgagaccagcctgaccaacatggagaaaccccatctctactaaaaatagaaaaattaaccaggtgtggtggcacatgcctgtaatcccagctactcagggggctgaagcaggagaatcgcttgaacctgggaggtggaggttgctgtgagccgagatcacgccattgcactccagcctgggtgacagagctagactccgtctcaaaaaaacaaaaaacaaaaaaaacctggtaacatttgtacctgtatatatggtttagattcttttgtataacagcatagcaagttgagtttggaatcctggtatttaatcttaacagaagagaaatatgtgaattccagtttatcttttctttagatatctgtcctttcctagatgagatcgattgacttcacactggagggccagatgctatgctagtcttgtgtgtgtctctcaagtggggaatggatggccttgcctgtctggggtgcccggggtcagctgagtctgtgctggtttctctcccacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggtaggtttcctaacagtgcagcacgtgaattctcttctgtccatgattagctgctattgaacaaatctctgtgagcaaactctttttttttcttttttttttgagaaggagtctcactctgtatcccaggctggagtgcagtggcgtgatcacagctcactgcaacttccacatcctggttcaagtgattctcccacctcagcctcccaagaagctgagattacaggtgcctgccaccacagccggctaatttttcttgtattttcaatagagacggggttgcaccatgctggtcaggctggtcttggactcccgacctcaggtgatctgcccacctcggcctcccaaagtgctgggataacaggtgtgagccactgtgccagacaacaggcattgatatttttctctgcagatcttttctttgtcttttcttcacctttctatataatcgtgagtacactaaagatacttattgaatgctttccccccttaggttaatcactttgaacagttcaatataaactatgcaaacgagaaacttcaggagtacttcaacaagcatattttttctttagaacaactagaatatagccggtaagcactcatagaattccatttcaatttttttttttaaagcagcaactagattcgttttgaagctatgttttcatttaacttggctgtttaaaatctttctacagggaaggattagtgtgggaagatattgactggatagacaatggagaatgcctggacttgattgagaaggtaatgtatttttgaagaatggttacagtcccaagggggtccagctggactgattcatatttatgggaacaaaataacgtgcacgaacacgcacatcaacgatgtgaatgtttagaacacaatggaccatttggaaacataaatgtaaatgtgcaaggttgaatttaaatacttggctgcttcaaacctattgtctcattgaactcagtattttagaatcaacagtgtgtgaattggcttcccttagattttaagtcagaagcaaagccttgccagtaccaatatagatttgccagttgtaaaagttttatccccaaaattgcaacgggttcaatttttttttaagatttatataagaacttaattggttttctctatagtgtatcattatggattttccaatcgagaaattaccatgccttttcttttaaccactcatttgttagagagtagagaagagctctcaaatagtttgggacgcacacattcaacttttttttttttttttttttcccctgagacggagtctcactctgtcgcccaggctggagtatagtgacacagacttggctcactgcaacctccgtctcccaggttcaagtgattctcctgcctcagcctccccagtagctgggattacaggtgtatgccaccacgcccagttaatttttttgtatatttagtagaaacagggtttcactgttggccaggctggtctggaactcctgacctcaaatgatctgcccatcttggcttcccaaagtgctggaattacaggcatgagctacccatgcacccagccacattcaacttttaattcattttttctttttcttcttctagaaacttggcctcctagcccttatcaatgaagaaagccattttcctcaagccacagacagcaccttattggagaagctacacagtcagcatgcggtatgtcgaaacctgcaattcttcatcacattggagtagcacgtctgtgggttgggattacacaccagacatgtcagtccgctggcccaactgtgcctcccacattgaacatttattctcaaaccaaagctgttcttctattactagaactaaattgaaataagcaaaagggttagatttggagctacttgttagaatgcccaagcttatttagagaacgtaaaattgttaatctattataatgacacaatcgagagttaacatggtttttataaagtgcaccatatgccgtgtcctgaaacgcagatccatggcaagtttggaaatgattttcactgtcttttgtatttagtgttctctggaagtcaaaggaaatcagtgagtgaaataaggcattgtatttttttttttttttttttttttttttttagaataaccacttttatgtgaagcccagagttgcagttaacaattttggagtgaagcactatgctggagaggtaactttttattaagatacctattgatatttgcctgtttggtattcagagaaaacagtggtttcagaagccaatcatgaatttattgggctgggcatggtggctcacatgagcctacagtcccagtactttgggaggctgaggcaggaggatcacttgaggacaggagtttgagaccagcctgggcaacatagatataaaaaacatcttacaagatattttttaaaaagttagcctggcatggtgacacatctgttgtcctagctgttctggaggccgaggtgggaggattgcttgggcataggaatttgaggctgcatgagctatgatcacgtcactgcacttcagcctgggaaatagagcaagaccctgtctcttaaaaaataaataaataaatttcttggaatgatttctttttgtggctctttcagggaagttgcttatgacctgaaactattctttcaatcagttttctcctctcttatttattaaaactaggtgcaatatgatgtccgaggtatcttggagaagaacagagatacatttcgagatgaccttctcaatttgctaagagaaagccggtatgtcagtcttctcaccgagaagtacttagcaagcaaatgaatatttgtgcaaatgcttttaattcacaaatatagaacaaattgctgttatgtaagaaacttagtattgtttttcccaggtaatacttcatcaatgaagtaactcaaaagtataacaataatacaagcaaggtcgggcatggtggctcacgcctgtaatcccagcactttgggatgccaaggtgggcaaatcacgtgaggtcaggagtttgagaccagcctggccaacatagtgaaaccccatctctactgaaaatacaaaaattagccaagcatggtggcaggcacctgtaatcccagctacttgggaggctgaaacaggagaatcgctttaacctgggaggtggaggttgcagtgacccaagattgcgccattgcagtccagcctgggtgacaagagtgaaactctgtctcaaaataaataaataaataaataaattaataataataataataatataagcaatgactgccatttagtgaggtactgaaataaaccaaccacagaggtataagtaacatactgttattaatcctcttatgcagatgaggaaaccgagtcttgaagcagttaaagctgttaagtgacttccccaagacctctcaactggtaaccagtgagccatcgagtccagttttgatctggtctggttggcttgagaaccttaatatcttaagcagtgtggtctgctgtcttcacagggagcttagagctgcgtggttaagctgatttcagccttggttttataggactcctgtgtctctagttagtaaaataaatgccttaattcagctataattataaatttattacatattcatttattcgttcatgaattataaatttacaccattaaatcaataaagaaaacacacagaaacttgcagtgataagttatttgtatgtattagaccaggaagtgtcctttttggtttttttttggtttgttttttttttttggagacagggtctcgttctgtcacccagactggagtgcagtggcacaatctcggctcactgcaacctccacctcccaggttcacgccattctcctgcctcagcctcccgagtagctgggactacaggtgcccgccaccacgcctggctatttttttttttttttttgtatctttagtagagacagggtttcgccatgtcagccaggatggtctccatctcctgacctcatgatccgcccacctcggcctcccaaagtgctgggattacaggcgtgagccaccatgcccggcggaagtgtactatttttaggaggctttgtaagagagaaagagtttagggaaaaaaccctttcctgaaagctttcagcacctgtgttggatctggtgggaatctgtaacaaaaacacatgtttaatatctaaggaaggaaagtagcaaaaaagtttaaaagctgtaatacttttagaaatgtaaatactagatggccacctgtcacttagataggaatgaattgggacaaagggagcccatataaggtagtatcagcctagaaactcagaatttgaaacatttgatcttcaaacttattttaactcttctatgtgagggttcactatatacaacattgttagctattttatttttaggtgagttttcagacctgtaaaaatgatgggtgtttaaaaaacaccatagcatgctgtcaaagcaatttcttagtttaatgcgatacgtttaaataaaagccctgtattgatgttaagtagaggcagtttgtcgtagtgaaaagattgcaggcctggagaccagcgaggtggagtttcgccagctgcctctgtgccagcgtgaagcagttttgtgagtggtgtaaagaacttcctgtctcaaccccaggtttccccttgcaaaccgaggagctggggctgttcacttgcttcactctctttcacctttgacatctgtgacattttaatggaaccaaagcttctctccaaagagctcaaagcacagttagagaacttaagagagtgagcattaaagagcacccgagaacaaaaatgaaaaaggttggggcaaagcaagaagcgaccagggaaagctctaatattgccgcttgtggggaggcagatgctcagaagtcttccctgactgtcctggtgacagtgaagccaccaaccccaccagctccatagcccatgataccttccatgcaaggaagatttaaaaatcattgaaggctgggcgggcgcggtggctcacgcctataatcctaacactttgggaggccgaggcgggtggatcacctgaagtcaggagttcaagaccagcctggccaacatggtgaaaccctgtctctactacaaaatataaaaattagccaggcgtgatggcaggcgcctataatcccagctactcagaaggctgaagcaggagaatcgcttgaacccgggaggcagaggttgcagtgagccgagatcgcaccactgcactccagcctgggtgaaagagcgaaactctgtctaaaaaaaaaaaattattgggaagcttttcacttttaccttgttaatagtagcaatggattttacagaactttttaaataataactaatatcaatatatatgatatgccaggtagcatgctttctgccttttacatgcatgttctcctttcattctcacctggcattaggggataaattaaaaaattatctccattttccagatgaaaaaactgaggcttagagagagatgaaacatcttgcccaagcaacacagctgggaagtggggagacaggatttgaaccatcgcctgcctcaccctgtaattagtgttccccaggagcacctttccatccgttaactgcttcaatctttgcaacactgcaagatggcaaaactaataactcacttttgcaagtgaggagaccgaggctacagaggcttagatggcattccagaaagcacagagctcctaagtgggattccaccctttgtcactgtcatgccagtccccttctctgcaagactctggtctctgacactgccacgtgttttcagtgcctaaagctctttggcagtgtttggtttgaaatctttggaagctgtcttagttcttccaggcctagggtgtattactttgaattatcattgagaaagggcaccattaattacaataatcttgcacctaataatgggtgtgtgtgcctcactgacctcctgctcttgcctcacacagatttgactttatctacgatctttttgaacatgtttcaagccgcaacaaccaggataccttgaaatgtggaagcaaacatcggcggcctacagtcagctcacagttcaaggttcgttttcactgctggcttagaggaatccgtcgttactgtatttttaagaactgaaaagaggatttgggtgtatgtgaagtctatgagaatatttgtttatttttgtttccttttatatcatgcttttaaaccagatagtgctttagaaataaaatagagttttggctcacgcctgtattctcagcactttgggaggccgaggtgggcagatcacctgagctcaggggttcaaaaccagccggggcaacatggtgaaatcctgtctctacaaaaaatacagaaatcatctgggtgcggtggcgcatgcctgtagtcccagctactcaggaggctgaggtgggaggattgcctgagcctggatgatcaagattgcagagagctgtgattgcaccactgcactccagcctgggtgacagcgtaagacctagactctgtctaaaaaaagagagaaaagaaataaaatagactttttctctgagtcagatgaaaacatgtagatcctttttaaaaaaataaatggctatttcttctaagcttttgaaatagcaaactccttaaggccatttgggaccactctgatttgtatttagagactcatgtggaaatgggatatatttcttctcatatctggatgttttttccccctggttagatgagactgatgtcagttaccttgtcctaggctcttaatcttccagcagaggttttcagttttctttttctagaaggtcggtttgccaggacttctctgagaaagctttttttttttccgtgtgtgtgtgtgtgtgtgtgtgtgtgtgtgtgtgtgtgtttgtgtgtgtgtgagacagggtcttgttctgtcacccagactggagtgcagtggtgtaatcacgcctcactgcagcctcaaactcccaggcgcaagtgattctcccccctcagcctcctgagtagctggcactacaggtgtaagccactacacccgacttttttttttttttttttttttttaaaggcagagtctcgctctgtcacccaggctggaatgcaatggcacgatctcagctcactgcaacctctacctcccagattcaagagattcttctgcctcagcctcccaagtagctgggactagaggcatgcgccattacgcatggctaatttttcatacccggctaatttttagatgttttactgagatggggtcttattatgttgcccaggctgatctcaaaattctggcctccagcgatcctcctgcctcagcctcccaaagtgctggaattacagacgtgagccactgcacccacccttgggtttttgaaatgtttgagactttaaactggactagcagtgaaggaaatggaaaagggtgggtgagctttccaggtgcaggcgaaggcaggagaagagcccagacacagagatgcaagtcctgtctctgaggactgtcaacagacagtagaacaccagccggacaggacacctcgtgagaatttaagatggtatcaaaatatgaagggccgtgaatgtcaggatgttttgtcttgtgagaaattttaaagttttctgagctggagaagtaattaatccatgtagtgttcagacagttcagttttcttcaacaagattatgagaagaaaaaagagacagatggagggaaagccagtggattaaaagagactgaaaagatgcatccaccaattacaatgaatggaccatatttgcattttgatgcaaaagaacaaaccctttaaaatttatgggctgggcatggtgacacatgcctgtaatcccagcactttaggaggcctaggtggaaagattgcttgagtcgaggagttcgagaccagcctgggcaacatagcgaggcctcatctctacaaaaaaaattaaaaagttattcggcatgcccttgtattcccagctactcaggaggctgaggtaggaggatcacttgagtctggaaggttgaagctgccgtgagctgtgatcacaccactgtactccagcctgggtggcagaatgagaccctgtctcaaataaataaataaataataaaatttttaaaaatcataaaatttgaagcagttgagcattttaatatgaaatgtgagaccattgcacattttaatattagtttaaggaattaatgtcatcttttcaggtgtgatgatgctgtggttacacagtgctttaaagtgtttagcctttaatcctacatactgaaatgctgctggaggaaatcacatcatgtctgggatttgcttttccacaggggtgggtatagtatgtgtggatcaggcgaaatgagattagccctgagctgaagctggtaatgagaactcattgtatgcttttgtctgctttggtaaatgttaaaaactctaaaaaaaaaaaaaaaaaaaaagttggaaaagaaagtagtattaaagattgatctggagtctgtaagtctggcgatttgaaggtaagagtgagagattgtggctcagagaccagtgaagtgctggcatagactgtcatttcgatggaactaatgaattgggaagaataatgacagtggaagagtggctatttctcagtttttctgtactaaacgttgaaatatcctaggatgatttttgtttgttgacagaatggtttattaaaattgtactatttcaggccgggcgcggtggctcacgcctgtaatcccagcactttgggaggctgaggccggtggatcacgaagtcaggagatcgagaccatcctggctaacacggtgaaaccgcatctccactaaaaatacaaaaaattctccgggcatggtggcgggcgcctgtagtcccagctactctggaggctgaggcaggagaagggcatgagcccgggaggcggagcttgcagtgagccgagatcacgccactgcactccagcctgggtgatagagcgagactccgtctcaaataaataaataaataaataaaatagaattttactatttcaaaggaagtgataaatgagtttggtgtattatcgaataatttcaattattaatacattgactcagtatgtttattttatattagaatgacaattaaaaaatgaaaacctctaagttattagtcctatgatttatattgtgttttttaaattattgtttctaagtgcctagagtactgagaaatttaaagaatgacataataagagactaaatcaacatatactttttctaataggactcactgcattccttaatggcaacgctaagctcctctaatcctttctttgttcgctgtatcaagccaaacatgcagaaggtaagattgatgacagtcctaggctgggatctgtctcgagggacacagcctcctggggtggttactcacagatttggtttctccaaagtcctttcattgtagatggttggaaatggatatgacattattataacttgacatgaaatgaaaaagttccctttgtcccttgggcctgttagtctgcttttgagtgatgttattaagctttagggacatctatttgaaaaggaaacattgtgaagcctttacttttttttttttttagcgtttggtttaaaattcttgggaaaagtttcagagtgtgatacatcattttacaggaaatatttgatgtgtggtggctgattttttttttaaagtttttatttgtctttctttccttcttttttttgctttattgttattttaaacacgatgaagaggctttaagtagtaatgctagattttaagtactttaaatagttgtttataactaattagaaagcactctaaaggttgtcataagtattaatgtcttggctctttgattttagctttctaatttcataatccgattacaaggaatgtgagcttaaaaaggaaaagctacctaaacaaagaaactatagtgttagatatatgcagtcgctgaatccacagctaattaggtagcttgtcttaaagtattgttaatacatttaaattattttgattcagcaaacagcctcttaggaatgcttcttatgtgagaaaacccctacaaattttaattgtaatgtaatttttatgtaatttaattgtaatgtaatttttatgtaatttaattgtaatgtaattaaattgtaaaatttaattgtaattttaagagctaatgttaaagaactagatgccatcctcataaggtttaaggtaaaaaatctgatctgaactgtttcccatgagacttggtttattatattctggtaatttgactgatgctggatcttatcttttataatgccaaccagttgcctttggcttaatattgcatggattcctcatttatagtttaaagatgtatgcttataagaaccacagtagccgggcatggtggctcacgcctgtaatcccagcactttgggaggtcgaggtgggcgggtcacatgaggtcaggaatttgagaccagcctggccaacatggtgaaaccctatctctactaaaaatacagaaatttgctaggcatggtgtcacgtgcctgtaatcccagccactcaggaggctgaggcacgagaatcacttgaacccaggaggtggaggttgcagtgagccaagatctgccactgcactccagcctgggagatagagccagactctgtctcccaaaaaaaaaaaaaaaaaaaaaggccgggcacggtggctcacgcctgtaatcccagcactttgggaggccgaggcgggtggatcacaaggtcaggagatggagaccatcctggttaacatgatgaaaccacgtctctactaaaaatattaaaaaactagctgggtgtggtggcaggtgcctgtagtcccacctacttgggaggctgaggcaggagaattgcctgaacccgggaggcggagcttgcagtgagctgaggtcatgccactgcactccatcctgggcgacagagctagactgtctcaaaacaaacaaacaaaaacaacaacaacaaaaaaccagaaccacaatgttgaattatctgtcttctagagaggcaaaattggacatctctttaagagaaaataacctgttcagtttgttaccttactgtgagatatgatggtgagaatttggtgtttgtgtgacctgaagtgacaaagtggttttctgttgaagatctgtgctgactttatgtgcatgattctggtagtttaaaaagtaacccatctttccgtttttcaaaagtatgtcaaaatatttaaggttatcaccaaaaaaatggtaacataaaaaaatgcatagcttttttggggacatagtgtaggaaattaatagttggaacatctctccatagataacactatgtcacgtagctggtttatgttccacttggtttgctttgtacactctggtgggcagtatttaccagacaatagaagtgggctttggtgcttgatgtagactcccaggagttgctcagtatccgatggcgttctctcctctttctacaataaggatgatagtgccatatttaatctttcaaacgtgcaaggtcttttgtcaatttaaagtcctgggtgtttggctaggcgtggtggctcacgcctgtaatcccagcactttgggaggctgagagataggttggatgacttgacgtcagaaattcgaaaccagcctggccaacatgatgaaaccctgtctctcctaaaaatacaaaaattagccaggcgtggtggcacacgtctgtagtcccagctacttgggaggctgaggcaggagaattgcttgaacccgggaggcggaggctgcagtgagccgagatcacgccactgcactccagcctgtggaatacagcaagactctgtttcaaaaaatacaaattaaaaaaataaagtctcggttgctgggatgcatctcacagtttctggtgagccatagtctaattggaagcttttttcccattcttcgtggtgtgaaacagttttacaatcgtaggcatcttaaattcctgccctggcagtgctataataaagtagaaactttaatttgaaatactcagtccccagtgtttctgttttctctcttggatggcacagagttagtttttcctataaattgtactagcttttgaaattaggcctgcttggaagcagttcagcagccagactattgcagaaccgaccttatttttccatgctgagatttgatagtacctaattgctttgaattttgcatttagaaaatgaactaactcaacctcacgtttgcatttgtattggctcactttacatgtcctgaagtatggcagacactaattaataacgcaccagtgataggctatagaaacctttccaagaatgtcttggtgcccttttaaaggcactcagaaggctgggagcggtgggggcggtggctcacgcctgtaatcccagcactttgggagaccaagatgggcggaattggagaccagcctggccaacatggtgaaacctcgtctctactaaaaaaaaaaaaaaaaaattagccaggtttggtggcgcgtgcctgtaatcccagctacttgggaggctaaggcaggagaattacctgaacctgggaggtggtggttgccatgagctgagatcacgacattgcactccagcctgggcgacagagtgagactctgtctcaaaaaaatgaaaaaataaaggcactcagcaagtgaaggcagaggcacaagagctgacttgtctgaggcctaaaatgcaggtgtgatggtagatggagatgctaatttgattatggcaagatagctatggctcgattagcattcatttggttccactggaaatatcggactgtcaccacctattatgttctgtgaaatgtgtgcaaatgacctttatttagacttccttatatattttttttaatccaaagatagattcttatagaaatttcgcaggaaaaatcttgccttcttcctctccagagatggggaatgtgtattttcagcgtggagggatgagacggtttctcctcacctcattttcctctccagtcgcagtccaccgaaggacttgggagatcgtattcaaatatgtgtgtatttaggtattttgtgtattattcagaagcaaggagcatgggttttagaaaatatagaagttttttgtttgtttgtttgtttgtttgagacagagttttgctcttgttacccaggctggagtgcaatggtgcaatctcagctcaccacaacctccgtctcccgagttcaagcgattctcctgcctcagcctcctgagtagctgggattacaggcatgcaccaccacgccctgctaattttgtatttttagtagagatggggtttctccatgttggtcaggctggtctcaaactcttgacctcaggtgatctccttgcctcggcctcccaaagtgctgggattacatgtgtgagccactgagcctggtcagaagtatctttttgtgtgtgttatatgatcttaaagacataagaatggcagctgtaaagtccataacctagagacctgtagcattggaacaacagaaacacctgtagctgcttttgtgccttcaggcataaagactcacacactcgccgggctagtgggagcacaccccctttacccgccctggctgctacggcaggctgcctctcctccttgccaagtgtttgaaccccagaacgcgcatctggggttgaagaatctagaaatcctttgtgagcttttgtttgggttgttaatttttttttttttaatttgggttttctatgtattgttttgaaaaacaggtgcaaaggaggagtgtataattgaaatgctgaacgcatatgtcaattcggctgtcacaatatgtgggcttttttctttttctataaacagccttttactaatcttgggtattgtatagaaggcagtttgctagcctcactggcgctcagcgaggaagcacctagaaaagcctgcttcccgagagacgccagtctgcagtgggccttgtccttggatgttaccctcctctgaacttagagttttcagagttcacaaagggtagacttctccattccacgagttttcgttggtaatgaggacttctagcttttttgattgtgatttgcttgggcggtggcggtggtacccaaaagtgctccagccaaccacagatttctctaagatagaaaacctgcttttcctcatcagaacctccccaagggtgtccctgcctggtgttttagcaagtaagttccaggcagaaaagtctctcattaacattcttcagaaaagccccgaggaggttcagggcagaattaaagaagggaacagactgatacacatcaggaacaccttctggggtttgagaaccagttgcccgcagttgcctgcagattcagcctgggctgcctcttggaacacgtctggctggctctcctccctgtttggtctttaggtttgctgtgtccaggatgcagattctaggaaggaaacgtcatgggttccagcagcatcatctttaaatctttgacttgacagaacaataccctcaaagattcagtccagccttctccagaaaggcaggggcctaatcacctaatgtttctgggactggtttctggtggaagaaggcctctagcacaagcagcctcttgggatagggtttatcttttttttttttttttttgaggtggagtctctctgtcacccaggctggagtgcagtggcgcaatctcagttcactgcaacctccacctcccgggttcaagcgattctcctgcctcagccttccaagtagcgaagattacaggcatgtgcaaccacgcccagctgatttttgtatttttagtagagatggcttttcaccatgttggccaggctggtctcaaactcctgacctcaagtggtccacctgcctcagcctcccaaagtgctgggagccactgcgtgcagcatggagtaaggtttacggaagggaagaagggaaagatgcctgtgctgggggaggctgaagaccaggcctcaggggagggaaaccagcagggctagagtttccatgcagccaaatttgctggaaaatggaatatcaagtgagagaaggaagctggagacgtggagtggagttagggaggtcacgtgagccttgtgggctgtcgatcttggagccccatctgtctctaccccgagacacaaggatgaagatgaggatgtgtaaaccatctcacacaggggtcttctgtaaaggactttggggggatgtcagctcctttcacataaatgagtcctgatgacctgtattcctctcttccacggggcttccttcttaggtcagactcagcccctcaggttgacaacatcctagacaactcatgaccacacacatgcagtgagagctctgtgcagacattatggaagcatgagccttttgtttccagaggtgtaataatttgatgaatgaatttaatgaatctagcacatttcctcccggggatttatatttatgtaatccaggtgctgcctgctatttctccctccctccctccctccctctctccctctctccctctttttcttttctttcttcctttcttcatttcctttctttatttcagacctgaccaggagcaatggctcacacctgtaatcccagcgctttgggaggctgatggggggcgggggggcgcggatcacttgaggccaggagttcgagaccagcctggccaacgtggtgaaaccccatctctaccaaaaaaacaaaaatttgctgggcgtggtggtgtacacctgtaaccccagctacttgggaggctgaggcacgagagttgtttgaacccaggaggtgtaggttgcagtgagctgagatcacaccactgcactcccgcctgggtgagagtgagactctgtctcagaaaaaaaaacttcaaaaagacaaaaagtagccaggagtggtagtgtacacctgtagtcccggctacctgagaggctgaggtgggaggatcatccgagcctgggaggtcaaggctgcagtgagccgagatcgcaccagtgcacttcggcctgtgcaacacagtgagacctgtctcaaagaaaaaaacaaagacaaaatatttctttaaaaagttcggatgataatgtgacacatttcttgccttgaattttgggtcccatgttattcttcctctatctttttctctttttttttcttcctgtatctttttttttttcttttttttttttttttttttttttttttgagacggagtttcgctctgtcgcccagtctagagtgcagtggcacgatctcggctcactgcaagctccgcctccagggttcaagtgattctcctgcctcagcctcccaagtagctgggactacaggcacctgccaccccgcacggctaattttttgtatttttagtagagacgggggtttctctgtgttagccagactggtctcaatctcctgacctcgtgatccacccgcctcggcctcccgaagtgctgggattacaggtgtgagccaccgcgtccagcctctatcttcttttatgcatctggtttctctttagctttactaagcttttgactttggtctctttgccctaatgctagtttgtgaataaagtgttcagtgaatatagaagaccaagtgcagctctgcagggcctgtctcagcctttgcaccctgctgcacacctcagggtccagactatttataggtgctcagtaacgttgagttactcatcatggtacattgtagaaattgctcatggtgtgtgagtgctcaactgtgcgaaagataaaaacgtaactattgccatagattctgttttagttgatttattttatttttggcatgcttttctcttctgatcatctttgatttgtgtagctggaggatacccgggcatcgccagtaggtcagtattggggtggtgtctttaatgtgtatcaatctttttatgctgacatgctccttcgccctgtctacctccctcagctgaccccttctagacatagccccacctcaggttcagggccctttaggaacagccaagcacagcaccaggggctcattcacaaatacttcttgatctgagggctgatgcttcatatacaaatatccccatctccaaatgggtattcacccacaggcctttgttatctgccacaattgggcagggagtctgggtgtgagggtctgccacatgacaaggtttaaactgaaaggttaattaaacattagattttaacattgagatggaactttctggaattatagactattcactctgtccaaacattatttattgccatgtttcacagaatctaaattccaagagtgtaaaatgcatccttgtttcctgtcactgtggaagcaaaggcaccaccgattacagcagagcacaatgatttcttatcgcttagctcttgctcgttgctttgcagaaagtatgaaatggaggtcattcatccaccacaaataggcaccttgcttttctgtttccaggcctttttgcagataaaataactttctgtttcactggtaaatctgtagtgtgatatttcaactccgcttaaaagacagctggacttgatgtgaggagtggcagtagtgtccataatttgcaaagatagtacaaaaattatgatgaaattcactcacatccaggcactggtcgcagcatggtggctgcttgggtggtagtgtcagagatgtttgaaccagagcaactccatcttgaataggagctggggaaaatgaggctgaaacctactaggctgcattctcagacgcagccattctaagtcacaggatgagataggaggtcagcacaaaatacaggtcataaagaccttgctgataaaacaggttgccgtaaagaaggtggccaaaactgaccaaaaccaagatggccacgagagtgacctctggttgtcctcactgtgacactcgcatcagcaccgtgacagtttacaaatgccacggcagcctcaggaagttaccctatatcgtctaaaaaggggaggcatgaataatgcaccccttgtttagcatatcatcaagaaataaacataaaaatggacaaccagcagcccttgggactgctgtgtctatggagtagccattcttttattcctttactttcttaataaacttgctttcactttaccctatggactcaccctaaattctttcttacatgagatccaagaaccctctcttggggtctggacggggacctctttcttagaacaacagcatgtctgagacacatcccagtttcagcatgtccacatgggagcatgtatgcattaagaattgaggaaatatgatctagttctctcttttaaatgttacataaagggatcatcctcccttttcctaaggaaccctcagaaacagagaatttaatctttcctaacacttaaaggtagccaggtgcttttttaattttttaattttaattttttcatttttgagagacaaggtcttattctgttgcccaggcgggagcgtagtggcactatcataactcgcagaagccttgaactcctgggctcaagcaatctcctgccccagcctcccaaatagctgggagtacaggcatacaccaccactgggcctggctaattttttaatttttcatagagacgaggtcttactgtgttgcccaggctggtctcaaacttttggcctcaagcgattctcctgctttggcctcccaaagtgctgggattacagatgtgactcaccgtgcctggtctgcttttgaatttttgttttttaagcccttagtgttcatgggaaaggtttttatttttgttttgagatggagtctcgcttttggtccaggctggagtgcagtggcacgatcttggctcactgcaacctccacctcccccgggttcaagcaattctcttgcctcagcctccagagtagctgggattacagatacccgccaccactcccagctaatttttgtatttttagtagagacggggtttcaccatgttggccaggatagtctcaaactcctgacctcaggtgatccacacgcctctgcctcccaaagtgctgggattaccggcgtgagctaccgcgcccggcctgggaaaggtcttaattgtaatgaatgaaatctgcatttctgcatcttccattcgctgctcttcttctggccatttgagattaatgtgaaaatgtcagatattcgttcataggagcgtgtcaaatatttttaagctcttaataagaatacattttcctgctccagtaaacagcctctgagcataattttatctcggaatttttgtttaaacatcaacacattatgcaataccatctcaaagctcttgtgggcgattaggattttttttttttagagctttgcttacctttttactgcctgtgtttgctttcatgttgtttgtttttattttctgtttcatcttttgtgactgttttcccacagctgcattgaccactaccccacctgttccccagccccagccaccgctccctctgcaagcctgcttagttacccgcagggcctgggtgactcagtccttcatgtcctgcaccaagggcacaggaagccctgcgccgcgcctgctgagacccagggtgtcggggtgctctgggtctagcacattatgatacaccataatcccgttggcatgggaagggtatcgcacagccacccaggtgcagaggagccatgaagccaccgatacaatagatcaaaggtgtgcacccaggtttcgcccaggcctcatcactacaccttgtgtggccgggcgtcctttccctgtgtttaacgtgtgtgtattgacagtacctactgagggagggtggttatgtgtattaagtgaggtcatggggacatgatacagctacatgttattgtgtatgtaaaataacacatacttacattatatgtttatatttttaccacttattttgtcctaacaaatttaatcccaaatttaagctgagtcacaggaaaatctaactgttttaagaccttttctctcttaagttttaaatcacttctgacagattgtcataaggagccttaaaaaagtttttcctttagtctttggcattgtcacgggatggacatttttatcttgatttttaacattaatagacttttttaaagaacattaaaaaatttacagaaaatgtgagcatatactacagactgtttccacactgcccccctccaccaccattttccctttcattaatatcttgtactaatgtggtacatttgttataataaagcagtattgctacattattattaaagtccaaagttgatattaggagtccactgtctgtgttgtatggttctttgacttttgacaaataagtactgtcatgtgtcaaaatgccagatgtttattatcagttcataatgtaacaaacatttttttccaagtcattttctataagaatgggaggtttctgattccctggtcaaagggtgaagcattgagaatgaagtttctttttttttttgcaatggagtctcactctttcactcaggctagagtgcagtggtgcaatctcggctcactgcaaccactgcctcccgagttcaagcaattctcctgcctcagcctcccgagtagctgggactacaggtgtgcactgccacgcctggccgatttttgtatttttaatagagatgggatttcatcatgttggccagggtggtctcaagctcctgacctcaggtgatccactcacctcggcctcccaaagtgctgggattacagacgtaagccaccgtgtccagctgagaatgaagtttctgttgctcactatagaactggtgaatgatatggacaagattaatggaaggatagagagggcagaagcatcaacttgcgagttaggacttcttagaattatccaggttgtcagcccctttcactcctctgtgcatttggttagtctttgggaatggctcatttcctctgtgtacttactggaaagcacctcgttgacattccataatccttcctggtgttttgttttgtggtggagttttgttcttgttgcccaggctagagtacagtgacacagtatctgctcactgcaacctccgtctcccgggttcaagagattctcctgcttcagcatctcaagtagctggaattacaggcatgcaccaccatgcccggctaattttgtatttttagtagagatggggtttctccatgctctccaggctagtctcgaactcccgacctcaggcagtccacccgcttcagcctcccaaagtgctgggattacaggcgtgagccatcacgcctggcctttttatgtatgtatttttttttttttgagaccgagtcttgctctgtgtcacccaggctggagtgcagtggtgtgatctcagccactgcaatgtccgcttcctgttttcaagcaattctcctgcctcagcctcccgagtagctggaattagaggcacccaccaccatgcctggctaatttttgtgttgatgagatttcaccatgttggccaggctggtctcgaactcctgacctcaaatgatccacccacctaggcctcccgaagtgctgggattataggcgtgagccaccatgcgggcccttctggtttttgattgccactcatgtcccctgttgttttgactgtctcctgcacctggagcacccattgccagcatctttgacttttgaaaacatttcatatagaagacctgtaaaaagctgcctttttacctttggaggaaattttagtaaaggaagcatttaaagcaaccattcttctccctaaacaaaacaatcccagtaaagccctcagtggtcacttccatcctgtttaccaagttgtcatggaaactattcatcagagctctgtagagatcaggataaattgcagcgagtgaagctcagcaccagcaaagagtgctgttcttgttctctgggtggattttccaagatcacaactaaactgcttgattttgtcctgggactttttttaaaaaaaaattattgattggcttttaaaatcaagaatctttgggccctgaaatgtaattacacatttgttgatgcgtgcatgatggttagtttgcccctgcagtcaaaagtgtcttcagcagttcctatcacgtcagcctcgccaggctggacttcctttgagtagaatcaggaatgaattaagcagcacagcccgagacgcaccacataaaaggctgggaacaccagccagccgaagaaagcccatttttgtgtctgtcagcttagatgcccttgcccggactgctaaagatgcagctatttacagtggacagaaactgaaggggtgaaagaaaacccaaggtagggatttttctctttcttgttctgcttaaaagtttcatgtaacttgccatgatgatggtattgtaaaactgcagagatcatacacggggaacagattttgctgtttctccaggcacggaagtgtttacaagtgggttagtgctgattttgattgcatgtacaagtttgaactacaaatttttttttgtaaaaatgaaggacacaattcactgatcagttaaggcgttgataatgcaatatattttcatatggaattcaccttttataggaaaacttcttttttaatattaggttgaagggggaaattggtggtttcttttgtttgaattttttccaaagtatttttctttaagagtttatacactgcagtcatccagcttttccctgcctcgtgctttataggaacctttaaagaaatctgcacaagaataatctcttttttaatcgcattataaacctgttcatacgcaagtatggaaatgtgagatgttatcggagttgaatggtcatctgttgaatatcatgtgcttgtttcacacaagcatacacatgttggaattttgcaatcggcctggaaaaacctgatgaggcatattctgttgggattccctttactccccgaagtagaggtccccaaagaaagaacaaaataaagagtgactgaaatgctaatctctgcctccccccgatggaggaatggtgttcagttgatgtctattcagttgctaaatgtgccctggaagggaggtgttttcattgtgaaagtggtctttcatattaaatcgagttacatttaaaagaaatgaataagcacttggctgactgctactaggctaaatctgctttcgtcgcgtagataagatttctggtgctaagcgaaaaccaagtatgagaatgttgggtttttttttttttgccatcaattttagagagtaattaatctgacacacacttattaccctcataagaaagaggcaaaggtaagttgtctatgggaaaatgccacatattttctacctctcttacaacgttaaactggttttctcatacctcgcttctgtttagtttacaaatgtgggtcctcaggtccggaaccgcattgctgcttgcgagagggctggaatgatggaatacagaagtgcttccctctctctgctgaatgcctcggtggctgaaggatatgtacgggaaggtggtgcaattagagaggcgaccccagtcggtcggcttccctcccgggaggtgccagctgctaaaatggggtgtacataattgcagcttccaccactgcatttttactttggcttatcctgatgaacttactgaatcatgtccaatctgaatggcactcctgctcccactgtgagcaaatcccttccctcccctacctgcacccccaactcccacccctgtccgtctagctcatgcagactgagatatttttttttcccctctaagcattagccgccctgaattaacgttttcacgggcagccccctcaatgtgtgctttctggtagtgactttgttctaaagctcactttgctcccccagcggctacaaaggaccaattcccaaatccccatcagcctccctcccagctgtcactccctcagaagactctggagcaaagggccaggtttgagactggagaccagaggttaggggtggactgcggttctcaagatcagggtctgaaactcccctgggtcttctctcatctgtgcagatggtccactctgcttcattagctcttcagcacttcactctgttcttcttcatcctaggggtactttccttgtttttttctccggcaagttctttctatgaccctcaaaaatatgcgacaaagaatagtgacaataataaaaacaccaccgcattagatgctggggtttgcgttcacccctcctcaatataaagacgattcttactgattataaaatattagggaaatatgtgaaatgttttaaaaattagttacccataattttaccagccagagacaaccctctttatatttgttgtgtatatacttttcttccctttaaattgggatcatagtttaccttaattttgtaacctacttttttttttaacttaataaatcttgaaacattctttcgcattttttcatgactataaaattctgtcagtggctatactttcaagtcagatttctattactggattgtttatttgttgttgcaaataatagtactgtatttttcatgtgcacaaatactttctccttaaggtaaattcttgaaagtgtatttgccaatcagaatatgcacgttgttatgactttgatgtatatatagccaaactgccctcattaaagccaacagcaaacaagatatatatatccaatgtgtataacaatggatgtatagctttaatatataaagagccttcacaaatcaataagaacatgttttagtagaaaaacgagtaaaaaacagaaacaagaaatttgcaaaaggtgaaatataaaattacttgaagttctcaatagtgtaatcaaataaatgaagtttaaaatgagatacttttgctagtgtgaggattgaatggtttaatggttttatgctttttttttttttttttgggacatgattatgttgcccaggctggagtgcaggggctatttacaagcacaatcatagcacactacagtctcaaactcctggctgcaagagatcctcctgcctcggcactggagtagctggggctataggggcacaccactgctcctggctctgtgttgctttttaataacacttcttggtttctgtgactatttgaagaaactgccattaatggattctgctattctgctgctgggagtataaattgttgcaaccttttctgaagaacagttgtgtacttttttttttttttttttttgagatggagtctccctttgttgcccaggctggagtgcagtggtgcaaacctggcccactgcaatctctgcctcctaggttcatgcaattctcctgcctcagcctcctgagtagctgggattacaggcgtgcaccaccacgcccagctaatttttgcatttttagtagagacagggtttcaccatgttggccaggctggtttcaaactcctgacctcatgatccacccgccttgacataccaaagttctgggattacagccctgagtcaccatgctcggcctctttttttgttgttgttgtttttttaactttgtcttgcctcccctgggagctgaatgattatatagatatacatacacatacacctgctgagaagggagaagtgagggcgaataggaacttgactgggctccctcaccttgagcaatcttctcctcactgctaaacatttccaaaaagagtctgtgactattttcttctttctaatgccaggcaatcaaggctgcacttgctacccttctgcaggaagcttcccagccagcacagtttctctctgccctgcctcttaatccccacccctgctcccaggcctgggacactgctaaccacccctccttcctgacacctctctgaccacccctcctcctcttgactggttcctctggaggtaggcatggcctcgggttctgcccccagtttctcactcgctgggctccaaaagaaacactggcttctctccttcagctccaggctaggtgagtacctctcccctgtgtatttccacctcaaaaccctcctctaagctttggcctcatcatctcccttaattttgtaacttacttgattttcctagttttctagattttctagttccgtgctactctgcttcacctgtttagcactttgaactgaaatgtgtccataattaaacttcacatccttttccttccgcgtcagctatctcaaacagatgattcttgcttaacccttttcctatgtatcaggataagtcagggttcttggcctcggcagtactggcattttgagctggacaggttattctttgttgttgggctctagcctgagctttgaaggaggcttcaaagcagcgctggcatctacctgctagacgctagtaacactctcctctctcaacgtctccagactttcccgggtgccccccagggggcaaaaccacctcctcttgaaaaccactgggctgtcgatgctgatgatttcttggtttttattcttattttttatttgctgtcaataaaaacggcatctacatgtaagttaacttgttatatagcatttgttattgcttttaactgtgtgttttactattcaactaaaatagaaaatggtgtatcgtttcacactttctggatgtacttagtcattcagttaaatgtctattttgtttccctttttagtaagtcgtgttaggagatgggaaatggtggtggtgggcttagtatcagtgcgtcctgtgtcattgtgtaactgctctgtgctagccactgtctcagatgaatggctgtcctagtttcagccactctgaaaggataaaacagctcattaaagtgtgccagatgcttcatttgtcagtatttcacttaaaagggaatactgtttggctttggaattctgtaatatacccaaagtttgcctctacaaaattaaagtggtcctattaaagatacagtaacatttttcccctcaccctccacatttaggatggtgaaaaattcactagcaaaccaatgttttagaccctatttagtgatttttttaagaaagaactcttcagataaataagaatattaagtaagagtatgcataataagtttgaataactgagatttcagcttttagccgtttggcaaaagaccatgatttgaatatgaaatctcgtaggcatactttggtcgtgttttcttacgggaccacagaagtttaaatatggttattataacacataagtaggggtctacgacaaattttgctgagctaaaacaaatcccctttgctgagccaaaacaaatcccgctggattatgaaggccaaacataaggcattgttactatgctaattgtggtttgaggaattgcagaaggaaaattagcctaccacattctttttcttcttttctttttctggtattgactgaaacgttggcctatgcatttgattcactgactgcatggcattgctttcagtaaagcttgagctagtcagtttacattggactacaagtgtacagagttgcagctcttagaggcttttaatcagaggtaccttgcgaattagggaaataaggtcctgtgcagaagtggaagggcaggttggacctggtcgtgacatcatttgactgggatttccaggcttctaacacagcctgtgagcatgcaggaacaaagaggtgtacaacctctgaaaactctgtggaactgaccctctctcagagcagccattgtttgcagcgctgttgcatcagcagatgggccacttctattcagttgctcctgctatctggggcgtgctagaggcatttcctggtttacataaactctggggctctgccaacgtccttagagttcaagcctttcccttctcatgctcaattaaaataattaactacagtacaatcgccgcttgttctccacttctcaccttgcctgctcacagcacatccattcttcttgttccagcctgtcgctacaaagtagttagatgatagagaaggcaggttgggaatattcaaagactctatagcaactggcctggatgcaaaggctttttttgttctttgtcctggtcgttttggtaaatgtgtagtcgcgtatctgagacatagattgtgctttattcggtgctgtggagagtagaaactagcagcagtacctggaaaggggccctgatctgcgggtgtggatgagtagagactcttcagttgagatttagctctagtgagggttgggtgcaaaaatgtaggaaagagtgaagagatgagcagctcatgtctgagttttttctgtttctgttactgtgtcacagaccagcctcagatcatagttcatgatgccaagatattgttggagttgaatgcggagacagacagggaggattttttagagtgtctgccagtgtgtaatgtgtcataatagcattttctgggtttgggttttttttttttttttttcccgaggctctgtcgcctaggctagagtgtggcggtgggatctcggctcactgcagccttgacctcctgggctcaaacagtcctcccatgtagctgggaccacaagtatgcactaccatacccagctaattttgtttatttttggtggaaatggggtctccctatattgcccaggctgatctcgaactcctgggctcaagcaatccttctgcctcagctttccaaattactggaattacaggtgttagccactgcacctggcctcatggtagcatttttaaacaacattcaccaccgtggcctggtcccacggttttctcgtgtaaatcacagcatttagactctgccctacagctctctccattagcctgatgactctatagcaattcattaacctgggcgtttttctacctattccagggctaacagcataaggttttcctctcaaggaacaagttgatttgttgctgtttgctcagtgaataaaagcaacctctcctttagacaatttatggcgaacaagatgataaagcaagttactctttcaacatttctggagtaaaatgatggatgaggctgtcctgggaggccacacatcatggtggaccaaatgaggttttaacactgatccggcctgccttttaccagccacaggtcattggtttgtcactttagttttctgttctcccatcagggaagggagtacagaagccaccctttgtagggtaggtacaaagaggaactgtgagcaagtctgtaaaactcctggctcagactctggcacggacggagacaccactgatggccgtggtggctgataaacagcagtcatagtcatcattatggaaagaagtggcattggagtcttttttttttttttgagacagagtttcgtgcttgtcacccaggctggagtgcaatggcgcagtctcagcttactgcaacctccgcctcccgggttcaagtgattctcctgccttagcctcccaagtagctgggattacaggtgtgcgccaccacgtccggctaatttttgtatttttagtagagacggggtttcaccatgttggccaggctggtctcgaactcctgacctcagttgatccgcccaccttggcctcccaaagtgctgaatttataggcatgagccaccatgcccggcctgacatcgggagtcttggtagagaactctggtgttcactgtgtggctctcccagcaaaaaacaggtgtgttcgtttcttctcgtgatctgtcatttgaacgtgggcaccgttgactgaactcagcagcacattgccaggtagaatttgtgaaggacgtacgttcattttggggtaggcgtggggaatatcaaattcatggaagcaatatgatcagaaccctgaaagctgttcttttaagtcgaaagatgtggtagatgttaagtaaagcaaattggatcgctgaaggaagtggatgaaatgtgttaataaggacaggtgaggagaaagctgtcactcatgaatagccttctgtctgctgcttcttggatttaggagcatatactcctttgttttctttctttctttttttttttgcatcccttttatttttaacattgtgcttaatctgtggaagagtcttcaacttaaaactctttcatacgaattctcaggcactcctatcttagagaaagcgtcaggctgcccctgaagccagcctggcatgtcacacattggaccctttcctgctggtagcaggagggaggcacttaacaattaagcagttcgagtcacccagctcagaagcctggactccctgcctggacgtggatgctgcgatgccgagccgtcaactcgtggcgccccctgcccagagtccagcctggagagtcctgaagaggcccggggatgggaataacctggcctttgagtgctgcctgacctcccgtttcctagcaactcccaactgctcaatgggatattttgtggtgtttctaatttatacttaacagatattggctgtgatctaaggctggctaatttcccattatgactttcaggcaaccactttaatacatgaataagcaagaaaaggactcctaggatgcgcagctcaccaataccctcttcccaccaggccttccttccttctggaaagcagaatttaccgaggacttgccaataaattaccatttatctcagagcagacggcactgagcaattttcaaggaaaattctccatgtgactttttttttcttctggtatctcagtatatattcatgaatatttataaatcagctatatctattatcaaagaagtaactcttttcttagctatgtttttaatgaaatgaaaagggctgacttgatctcagtttcttcctgtagaaatgggatgatggggtggggtgatttctcaagccccttccagcactccactaatataaatctgatgaccttgtggtctttttaatatttggcatctgtttggtgactggatgtttagctcagatttttctgagtgtgtgtatttttgttgttgttgttgtttgtttgttttgttttttctgagatggcgtcttgctctgtcacccaggctggagtgcaatggcacgatctcagctcactgcaacctccacttcccgggttcaagtgattctcctgcctcagcctcctgagtagctgggattacaggcacccgctaccatgcctggctaatttttgtacttttagtagagatggggttttgccatgttggccaggctggtcccaaactcctgacctcaagtgatctgcgcacctcggcctcccaaagtgctaggattacaggcatgagccaccgcgctcagctcttacaataccgttaatgcagcattataaaaaatattcagccaagcattccaaatctcagtttgaccactttcccggctttggatattgaggaacttgtggctgctggatgcattttcctcttatttccctcctcatctcctcccttctttttcttgctcagtcctcactgcgtggacataaccttagtgatcgtgtaagtgctttagtgagtttcacagctattttagcattttaatgaccgatttgggcctccttggcaacatctacaaagagagacagctgccctcctaatttgtatttctcagcatgatttttcagaacacgtctgaataaaggagctgatgacctgttcaatatggtggacagagaagtagaaatagaacacagatgaatagagtgagatggaggtttagtttagccagataaaaaggtttcgttaggttcactagataaaagggcaacagattatacccaagggggaggctaccctgtgaggatttccagatgggatttgtgcaaagggttgaaccttctgttgtcttcaccagggctttgggtctgatttggaacaaatctgtagtccctctctccatccctccttccttccctcctgccctccttccttcctttgtttctttgggtttttctgaaagtctctttcagcatactttaattgatttgcagtatccattttcttatatgttgaattattaaacccctaattttaagtttatatgatctactcaaaatatgaaatgttccccttcagctttatctctcacccttccaggagagcacggacctgctcctattcctcacacagaccccctcagtccctccttgctcttggtatctccatgaacccccttcagaatttcctcattttctttccttgcttggtttatcactcagccttccatttttttctgatggcagcatagcatgcatactaaaaaatgagttctcaagtcatgtgtccagccgtgaatgatcccagagtgaacacagcacgtgacaacactcccaggccaggcaggagatggggagccgccctatcccaagctggtggcctccgtcacctcctggggcttcatgccctccacgctgtccagattgccagccttgtcttgggtaatgtccacgctttcctctctgtctccaattccacagggttgctggacaatatcaagaagcatgttttggcctggcgtggtggctcacgcctgtaatcccagcactttgggaggccaaggtgggcgaattgcttgaggtcaggagttagagaccagcctggccaacatggtgaaaccctgttcttactcaaaatacaaaaaattagccaggcatggtggcacacacctgtagtcctaactactcactcaggaggctgaggcaggagaatcgcttgaacctgggaggcagaggttgcagtgagccgagatctcatgactgcactcctgcctgggtgacaagagtgagactccatcttaaaaacaaaacaaaacaaaactgggcgtggtggctcatgcctgtaatcccagcactttgggaggctgaggtgggtggctcatgaggtcaggagttcaagaccagcctggccaagatggtgaactcccatctctactaaaaatacaaaaattagccaggtatggtggcgggcacctgtaatcccagctactcaggaggctgtggcagagaattgcttgaacccagggggtggaggttgcagtgagccaagatcgtgccactgcactccagcctgggcgacagagcgagactcagtctccaaaaaaaaaaaaaaaaaagtgtgttttgatcaatgctagtacatacttgtgccagccttggaggtggcctccctgctcttcaccaactccccccataccttcccacatccctgaacctgatttcaaccttcccatgacagcccacgacctcaccttgtaattcatcaaaggactgagagcatctaacatcagccaccccaccttccatcctccgcagcgtgctgcatccctgtctttctgcctttgtcagatcctctctatattttgaatatatttgagttcctaagtctctcccatctcaggttgtctaggcatttagctgcttcagatgtggcccccacctagtaattctcacaggggccagggaacctgggtctctgtattctgtctttgtttctggcttctctggctgggcttgaacttgacactgccccgtgatgtccctctggttttggcatcccgtaccagctgatgctgcccctgttgacctctgctccatactgatttgtcttctggttatttttgaggctcacagtgttaaccactgaagagttttaaactatatacaagccttgcaatatctccatgcaccttaatccactgaggactaagccccttccccataagcctccctccttcccagggataatccttcccttccaccacagcacctcttccatctaccaacagactgtaccggtatgtcacatacccttctctctctccaggcagagtccaacttttcagcactaagacagagtaattctgccaataatgacctacacggttaatatgtaaaaaccccacatttaataagaagcgtttgtttagaggctccacagggtcaggacttggatccatgtgcctgtagttctcttggtccttcctcaaggttacaaaatggttgccatagctacagccatcacctcctcacaaaacattgtcattccatttttttcaatgagcatctgttatgccattgtgatacatctctgagtaaagcaaataaagacctcaccctcttagagtaaacattaatcctggaaagaatcagggttgggaccaaagagactcccctcggtgcccctcttcctttaattaggaaggaaaatcttccccaggagcccctcagtagttttgcgtgacatcttcctcgtttctctgcttggttctttggccaggactgggcctggttgctgagcctcactccacaggaagctgagaaagtgagtggatgagttcgtagggttggctggggtacagttggagttcttttagcaaagcgttgctgttgggccacactagaaaataaaactttaggctgggtgcggtggctcacgcctgtgatcccagcactttgggaggccgaggcgggtggatcacaaggtcaggagatcgagaccattctggctaacacggtgaaaccccatctctactaaaaatacaaaaaattagccgggtgtggtgcctgtagtcccagctacccgggaggctgaggcaggagaatggtgtgaacccgggaggcagaacttgcagtgagccaagatcgcgccactgcactccagcctgggtgacacagtgagactccgtctcaaaaaaaaaaaaaaaatagaaaatacaactttagatgaagagtggaaggggtgaaggtagagagaaatacaaaaatatttggattttatcgttgtacaatttaggtaacttttaatagatgtaatatcagattttctgaatccacgttttagacttgtggtagttttgaagaagaatttaaataaggacactttcttatccattgagtctgacttgatgttaaactataggaagagaaagtttagtacgtcatgcaaaattacagaataatattgtaataacagtggatttttatatacaccaatacaaataaatatcttaggagctttaactcaaaattgaccttagtaccttctagaacaatgcatctcaaagagtcaaaagagcagtgttttgtttttcattgccaattcattgaggactggtgcatttgaaaaatacagtaaaaatcggcaacccactcgggtccccttccacgctgtgcttaaaagaaaagaaaagggtccccttcttgctgctgcttaaaagaaaagaaaagaaaaatacagtaaaaaaatacagtaaaaacgatgcagccacatcagatcgctgtaagagttcctaaatgcttattctcacctttggtggccatcttgccatggacaggcagccgtcccaggccacacttggagtcacgctcttctggttttcccacgaggacgaagggcacagaactagacacaggtcctagtgcacagtagtcgtgtgaccttgagcaagccactccacttggatcagggtctccaggtatataatggaataatagtcttgtcttgcccactggctcttggatattcaattagactcatggaaagccttggtacatggtaattcatatttaaatattaggtgtcattatatgccgtttaacttttaattcaggaaggagactatatgtagcttttttttttttcagtgttgaaaattaaaaagctctagttttggcgatccaggggttccctttttgcagcaaaaggcagttctgctttctatcttcccaaagagctggaggggtgggagccaaaagaaagtccccaggtacctcatccccaaggagttggtgtgcaagctggtgtgtggcctgaagtttgggatctgcctacagggtttccccagagggcagcccgcagaaggaggcagagttgagaaatctgtccagtgtgcaggagaggagacaagcgaccctggccgtgtgcagtagtccatgcacacgcagggccattgagagagaggaagttggagcggcaggtgcagggctgtgaaaggcaggaagccaggaggcagaaaccagaatggaaggaagaagccatggcggagggcggcctatgttcctagagctcaaggaagcattcaatcacacgctcaacacgtgattttcaggccacttgtgtgttttggaaacaagtatgtgaccaggcacagaggcagccaagattcaaatgagtgaatgtcccatggacataattaaagagaaagggcttgtactaaacactggagagctgttaggcatagcttttccaggcatttctttgctagtttttttttttttttttttgggctggggggaaggatcggagtgtatgtgccccagttttatcttgtttaatccagctttattacagctctgtcctcagcgctggctctgtttcagcatccccataggcaaggaagatgctggcttcaacagtttgttttaaaaaacaaaaatcaaagttaatgtcctaggaatcttttgggggatccctgaaaactaaatataaatttgttagggaaagtagttagttatatgttgtttgagaatcattgtcttgatcttgaaagattatttgacactttatttgatgttaatggaaattcttcgtgtttgatttatttgttcagagtcattagcctcgtgagaacccttcatggggcctttatttcacagtatttgcatgagcattgttttttatctttgaaaaatgggtaatgttatgaaaaggaatatgtgttagtctctaaacatgcaagccttatatcaaaatagtctgacagtgtatttatacaaaacatgctgcaggtatcaaacaaaattgtaatcaaattagaattttaagccttgttgttttactctccaagtccttataaaccagaagccctaactttttagaataacactgttcaataggaatagaatgtgagcaccatgtctaatttaggttttctagtagccacatttagaagtgtaaaaaaaaattgttttttttgtgaaagcagttttaacaacatattttttttactatatccaaaatgttatcctttcaacatgtaataaatttcaaaatgattaatgagatactttattttttcatactaagtttttgaaatctggtgtgtaattatctctagagcacaactcaatttgcaccagttgagcaccctgtttgtctagcttttattctctaactcaagagattagtaaacttctgtaactggcaagatagtaagtattttaggctttgctattgtattgtggaagtggtcacagacaatgtgtggctgtgttccaataaaactttatttacaagaacaggtggcaggccggatatggctggcaggctgtggtttacaagccctcactctaactaaatgtatcatctcgtgggttttaatgctcagaagttgatttctattttgggctgctaccaagatagctattgtgataaatttcattcagaaatattcaggaaatatgtaccaggaagtatactccattgttaaataatgaatacgttggaactacaggaactccccctttcctgaatttgcacctttcaggaagagccgcatagctagtggtgcttagtgctggcttggctgtcacgatgcctggatttgaagctcagctgtgttaattaagcatgagccttgtgaccctagacagttaattaaccaccctgcacttcaggttatgcatctgtagaatggggatgacaataatatctacctcatagagttgctaaaattaaatgaaagctgacacagtaagcccttggtacatgatagcttttgttattcctctgccactaatgttgctgctggaagtactacttgtactgttactactagtggtgttagtactgctgttaccaccatcaccaccaccaccatagagatccatacatacaaaccaacctatgtgccagaatggaaccatgctgacttgatgatcgtccacagatgaccatagtggccactaatatggtatcactttggacgtaaacttgtcagtcagcagatgtgctactgcactctaggggagatctggcatgatctgcaaggatttaatgttaaaagacttgagtgggctgggcacggtggcttacacctgtaatcccagcactttgggaggctgaggcgggtggatcaccttgaggtcagaagtttgagaccagcctggccaacatggtcatctgtctctactgaaaatacaaaaattagcctggcgtggcagcgtgcgcctataatcctagctacttgggaggctgaggcaggagattcgcttgaacccaggaagtggaggctgcagtgagccaagatcacgccactgcactccagcatgggtgacagagctagactccgcctcacaaaaaaaaaaaaaaaagggggtacctgttgcttctctggcctggtaattgctgtatgatatgactcaggtcacacaacattctttgaccctatttaatgaaaatgctaattaatggctgccctacccacctcacagggtgatagagcaaattgtaggtaaagtactttggaaattgtagagtgttgtggaaatattagctgagagcatttcccacacgattgcttttttaaaaatgtatatcacacacttaattttatcatcatggactgatttaattcatagagtagttgtaaagattaagtgggcacatgtaaagtgctcagttcaatggtagaaacatagctcctgttcaagggctgggtagttgctatttttattactcgattttcaatttaagatgtagtattttggctgggcacagtggctcgcccctataatcccagcattttgggagggcgaggcaggcagatcacaaggtcaggagttcgaaaccagcctggccaacatggtgaaaccccgtctctactagaaatacaaaaattagcaaaattagctaggcatggtgatgcatgtctgtaatcctagctactcaggagactaaggcaggagaatcgcttgaacccgggaggctgaggttgcagtgagctgagatcatgccgctgcactccagcctggatgacagaggaagactctgtctcaaaaaaaaaaaaaaaaaaaaaaaaaagaagaagaaggtgagagaactgtatatcctgacaggttaactgtctctaagattctgttaggtaagagaagcaaaatgtggaacacttttatttgcatttttaaaaaagcagtgtgtgtatttatctgcacacacgtgagcgtgcatatacacacacatgcatactgtgtttatacatgcattgactgtgcctgaaggagacacaggaaactagtacgaatggtcttcctcaggagagctgtggggtttttatggcagatgcttttttgtatatgtatgtatgtgtatgtattatatatgcatatatacacccagatcctttgcgtgtattattttttcatttaacaacaacaaattagttagtggggaaaaagagatggctgtaatctcccaatttcttttgcatccctcctcattaaacactatactgaagagttacttcatgacgtcttgcagtggaacccccatagaaacacattccagtcgtgtcatgtgagtcattaaaaaaaaataactgggtatcgagctgcgttttgggcatgttctctagaaacacattgtgagggctacttggaccttatgctggcttcctttagagtcatatttgaactagtgtcaggaccctgagattttctgtgctgttttcatgacagtaaatcaaatccagttggacagaatgggttttgtttaggttttcttgcaaaattctcgctccaacagtaagaaacctggctcccatcatctgccattcatttttttgtttaattccagtgtacatgtacagtagtatccagagttgtgactccatacccctggggaaaacaactttatcaactatagtacagagctgaaatgcagttctttatgcttttagtcttatagactctatatgtttccagcgttatttaagtcagcgtcttttccctcaccctgtttagtgaggtcgattcatttagattctcttgtgacaatctacattatttcttggtttccccaaaggtttattctagtgctctaaagttccacgagttttgacaaatgcatgatgtcatgtatccaccattacagtatcacacagaatagtgtcacttccctaaaattcctctgtgctttagttcttcatccttcccccgacccctggcaaccactgattgttctactgtctctgaagttttgtctctttctggatgtcatataattggagtcaaatagtatatagccatttcagactgacatctttcacctagcactatgtatgcacttgaggttcctccgcatctttttgtggcttgatagcttttgaataatatttcattgtatggatataccgtagtttctttgtccattcacgtgttgaaggatgtcttgattgcttccagtttttggcagttacgaacaaagatcctataaacattgatgtgcagatttttgtgtggacgtaagtttttgcctaaatgggaaaatacctcagcgggcagtcgctggatcatgtgttaagactgtgttcagcttttaagaaactgtcttccaaattgactgcaccattttgcattcctgccaattctgggtgagagttcttgttgctccacatttttgctagcatttgatattgtcaattttctggattttaagcattctaataagtatgtagtggtacttcattatcgttttaattttttttctttttttttgagacagagtcttgctctgtcacccaggctggagtgcagtggcgcaaccttggctcactgcaagctccgcctcccaggttcacgccattctcctgcctcagcctccccagtagctggaactacaggtgcccaccaccacgcccagctaattttttttttgtatttttagtagagacggggtttcactgtgttagccaggatggtctcgatctcctgacctcatgacctcgtgatccgcctgcctcggcctcccaaagtgctgggattacaggcgtgagccaccacgcctggcctgttttaatttgtaattccccaacgacaggtgatatcttttcatatgcttattagcctatcttctttggtgaagtgtctcttcagatcttttgcttattttaaaaattggattttcatattgtttagttttaagtgttctttgtaaatttttgatacagtctttcttagtgtgtattttccaaatatttttcagtctgttacttgtctttcattgccttaacagcatctttctcagaagaaggtttttaattttaatgaaatcctacacatctattttttccttaagggaacattcttttgttgttgtatcaaagttatccccaaagccacctagattatttcctatgttatcatctaggagttttatagttttgtgatttacattacatacataggtctatgatttacttaattcttgtgaaagttgtaatgtccacatctagattatatctttgcatattgctgtccaattattctagcaccatttgttagaaagactatcctttctctaattgcctttgcacattgctcaaaaatcatttgattatagttgtgtagattgacatactttttaaaaagcaaaaaacgttttcatttctccaaaatctgtaagagaggcaaaacctatttaatgctaattaaacaaatatattagaaacagctgtaaacagaagcacaattttgttcatgcaaatataccagcgtaagtgagagtgtatctgatacgtagggtgacacaccaggcaatgtagtgaactcagacattcatagaattcagctgctccgctgcaagaatgtgtaatttaatggggagttcacatggacatgcttaagatgaaaaagagtgtgaccaggggtcacatcctcatgcaagtacagcgtgtgctgggaacctaggggtgagagcatcacggatggcacctgtgggatgcatcgggacagttttacgcaggagggagcatttgagagacacctaaaagatccatcaggctcaacagatggtacatttcaggtggagaggccagtttcagctgaggtgaagacaggaagtgagcattttagtcaagaaacaagtagaatgatctatggttggactaaaaggtaggatttgtataagggcgtattgactgggaaggtaaattggagccatactgtgaggacctcgaatgggaaatcgaagcctttgtcttaaactggcatgtgctggctctgtgtgaacagggctgtgatacaaccagagctatcccttagaaagattgacatgtatgtgtgcatgttatttatgttccagtgttttctttcccattaggtagttgaggtttgtgtgggtccgaggtaagcgcctgcagctgtaacagagtgtgagtgtccttgctcagggtgacagctgtacttagtctcagcgggtatgtgggttgaaggttgtacttggtgagtgagaaatttccagaccctacaatctgacctccaggactgactgacagcttgctcgccagtcaggccctgcttactaccttcctgttcctcacctgcgggggttgcctcttctctaggggaaattagtttctgcctcttttctaaaaatgtgaaaattagcaagtagcaaccactgtgtaaagtgtttaacagccccggagtgaaatgactgatgtaagtacaaaggacttttgtcgccagttgaagtgacttttatttaccttctgttcaaggtcaggaaagttatattgctgctttagttacgatgcttttgaacattgttcaaagcatgataaacttcttatctgagaatatttattcaccactcttgagagtttattgtagcaaagaaagcaaatagactgagattccttgcagagttctttgtgaatcagcaagaggaggggatgggagtcctgtggtgaggctttcttagtagttacaggactgggaatgatattttgttatgtagcgtaattgtctttgggtaattcttatggagtctttaacttcttaaagttgaagaggggttatcagaagataaggttgtttatttttaaagttaaatggggtagaggtatatccgataatggaaatgcaaatacaaatatacctaatattttaaatcctctctgtagcagtgccccctgccccacacatacagtattcatgtaatgaattatgtaatggcttttcttattacataattcacatattttatgtttcttaagatagtggcatactaatctccacaatatgaactgtgcgatgagtccctcagttgcagacccaatatgaatgtaaagtttaaagtatttcatttaaagtaggtcaggtgccattaaagaatacaatgtggaggctgggcgcggtggctcacgcctgtaatcccagcaatttgggaggccaaggcgggtggatcacaagatcaggaggtggagaccatcctggctaacacggtgaaatcccgtctttactaaaaatacaaaaaattagccgggtgtggtggcacgtgcctatattcccatcccagctacccgggaggctgaggcaggagaattgcttgaacctgggaggcagaggttgcagtgacctgagatcgcaccactgcactccagcctgggcggcagagcgagactccgtctcaaaaattaaattaaaataaaaaaaaataaataaaataaaataaaaataaaatagtggaaaagtagaactctaaattttgaatgcagtaccactcactttgagaaatagtctagcaatgtggaggttggtcttataagacataaagtcttcaaaaaattcttttaataagctcccaagttaaggcagtaaaggcaattgacttactgtcggtgtgatgctcagctcctttgtttggctttctggggctgtttgtcagggctctgaggatctcctgtgttgccagatctcgggctctctaccattttgcatcctaagcagatctaatctgggaagggcctgcatttgtcagggcagagcagggactgggtttgctcttggacatcccacaccattagttatttgtgtgggtgcttagtctatgggaggcttctaatacatacatacatatacacacacacacacacacacacacacacacacacgcacgcacacacatttatttctttagggaccgagtttcactcttattgcctaggctggagtgcaatggtacaatctcggcccactacaacctccgcctcctgggttcaagtgattgtcctgcctcagcctcctgagtagctgggattataggcatgtaccaccacgcctggctaatttttatatttttagtagagatggggtttctccatgttggtcaggctggtctcgaactcctgacctctggtgatccacccacctcagcctcccaaagtgctgggattataggcgtgagccaccgtgcctggcccaaataaatatttttagttgattaaaataattgtttacttttacataatcttcaagacattgtgatcacatgaaagttttagaccttgagtaaattctctccaaaaatgataggaaaggatccactctagaaataaattataacatgtattcagaagcacccaaggagttgtcacactgtatttgatatttgttattaaagcagaagcagtcgttattatatacgttgtcacatgcagggcatcatccttgggatacagtgccacatgttaccagtgtgtcccttgtccactgtggtgtgtcatctcatgctcagacacctgcccttagcaggcacccaaggagggggtattgtgtccggaattggtgggttcttggtgtcactgacttcaagaatgaggccgcggaccctcgcggtgagtgttacagctcttaaggtggcgcgtctagagtctgtcccttctgatgttcagatgtgttcggagtttcttccttctggtgggctcgtggtctcgctgggctcaggagtgaagctgcagatcttcgtggtgagtgttacagctcataaaagcagcgtggacccaaagagtgagcagtagcaagatttattgcaaagagcaaaagaacaaagcttccacagtgtggaaggggacccgagcgggttgctaatgctggcaacctgcttttattctcttatctggccccacccacatcctgctgattggtagagccgagtggcctgttttgtcagggcgctgattggcgcgtttacaatccctgagctagatacaaaggttctccacgtccccatcagattagttagatacagagtttggacacacaggttctccaaggccccaccagagcagctagatacagagtgttgattggtgtactcacaaaccttgagctaaacacagggtgccgattggtgtatttacaatccttgagctagacataaaggttctccacgtcctcaccagagcagctagatacagagtgtcgattggtgcactcacaaaccttgagctaaacacagggtgctgattggtgtgtttacaaaccttgagctagatacagagtgccgattggtgtgtttacagtccctgagctagacataaaggttctccacgtcctcaccagagcagctagatacagagtgtcgattggtgcactcacaaaccttgagctaaacacagggtgctgattggtgtatttacaatccctgagctagatataaatactctccacgtccccaccagactcaggagcccagctggcttcacctagtggatcccgcaccagggctgcaggtggagctgcctgccagtcctgcgccgtgcgctcgcattccttagcccttaggtggtcgatgggactgggcgccgtggagcagggggcggtgctcgtcagggaggctccggccgcacaggagcccatggagtgggtgggaggctcaggcatggcgggctgcaggtcccgagccttgctccacgggaaggcagctaaggcccagcgagaaacagagcacagcgccggtgggctggcactgcctggggacccagtacaccctccgcagccactggcccaggtgctaagtcccccattgcccggggccagcagggctggctgtttgctccgagtgcggggcccaccaagcccacgcccacccggaactccagctggcccgcaagcgctgcacgcagccccggttcccgctcgtgcctctccctccacacctccctgcaagctgagggagtgggctccagccttggccagaccagaaaggggcttccacagtgcagtgagggggctgaagggctcctcaaatgccaccaaagtgggagcccaggcaggggaggtgccgagagcaagtgagggctctgaggactgccagcgtgctgtcacctctcagtatgagatgcaaatggagttaaatcccccgtgggtcaaagaacagttgaattgtttgtcagtgatcagaggttgatatgcgaagtaaggatatggtccgctgatgattgtccgtgtttatgggagtagccagagttggatttgctcagtttgcaatttgattttctaaaagctcttctttattctctagttgcttccatatgcagatgtttggctgaactcacaatgtagcaaactgatttcttatcgatgtggtcgtggcccttaaaattgtgatctttaagtcgcctgtattagaccaagtcagtacctgacaagttgatctctaggaatgttccttgtgcttaaatctccagagaatgtctgtgtttccagaagacggattgccactgggaatgataccttatagaccacattctctgcctaggttccacttaatcttttccctaaagaagttttcattcctttcagagttatatcccatggtaatatttcccagttttataatgtgtcagtaggaaaataggtttgatgcatacgagtttgatttacatgctagttttcaggaacgcaaagctctttgagacttactttttaacttcttgatttaagcaaatgttaaaaccagtttaaggccgcgcgtggtggcccaagcctgtaatcccagcattttggaagggtgaggtgggtggatcacctgaggtcaggagttcaagaccagtctggccaacatgggaaaaccccatctctactaaaaatacaaaattagccaggtgtggtgacacatgcctgtaatcccaactacccatttgggaggctcaggcaggagaattgcttgagcctgggaggcagaggttacagtaagccaagatcacaccactgcactccagcctgggtgacaagagtgagacttcatctcaaaaaaataaaaaaaataaccggtttgaacaagtcattttgccttcctaatttccagtctcgttatctacaaaatggcttttccctaaaatcttggccggctctggaaaaacccatggctcctgtgtgacaagctggattcctaccacccccagccacgtcttcctgggctcttctcaggatgccttggttggtttttgcgagtttctcaaatgctgaaaaacattataactttaatggtccatggataataaactcactgtattttctttcattaaataagcacagattgaatgtccccttaccataggcaaatggctgtttccaaatccactgtcatacttctttttttttttttttttttgagacggagtttcgctctgtcgcccaggctggagtgcagtggcgcgatctcggctcactgcaagctccgcctcccgggttcacgccattctcctgcctcagcctcccaagtagctgggactacaggcgcgcgccaccatgcccggctaatttttgtattttttgtagagacggggtttcaccgtgttagccaggatggtctcgatctcctgacctcgtgatccgcccgtcttggcctcccaaagtgctgggattacaggcgtgagccaccgcgcccggcctgtcatacttcttattgtcatgcactgttcatgaaattatggaaggctcggtaatgttcagggcaattggattcattgatacataaataaatgcatttctgtcttcattgggaagcaccctccctgctcttggtgtccctgtttgtcagcacctctgttgtcctttatctaaataagctgcaggaggtaaggattgcctgtaagtgatttttgtagagggtttagtgtgccctgttattaatcattattaatcatctaggcattctgaaatagtatttttcagattgtgtggaaataagtatttctacttatttttggtaggattaaattatccaaagtatacattaaaactacatagatttcgtcctgtctccaggatgcaaactttctcttccatccatttcttgtccattttaaatgcctcagtgttagactggtacttaatgtgctttttttttttttcgagacggagtgtcactctgttgcccaggctggggtgcagtggtgcgatctcagctcactgcaacctctgcctcctgggttcaagcaattttcctgcctcaacttcccaagtagctgggactacaggcacatgccaccacactcggctgatttttgtatttttagtagagacaaggtttcaccatattggtcaggctggtctcgaactgctgacctcaggtgatccacctgcctcgccctcccaaagtgctgggattacaggcgtgagccaccgcgcctggccttaatgtacttaaaaaatttttttaacagcttttttgagatatggttcttatgtcatgtaattgccttatttaaaatctgcaattcagtgagttttaaaattttttacagatatgtgcagccgtcaccagagtcaattttagaacattttcgtcacctcaaaaagaaacccccaggctgggtgaggtttctttttttgggaggcggaggcaggcagattacttgaagttgggagttcaagaccagcctcaccaacatggagaaaccccatctctactaaaaatacaaaattagccaggtgtggtgacaaatgcctgtaatcccagcgagaccctgttctcaaaaaaaaaaaaaaaaaaaaaaaaaaaatttcaatcttacggcaccatcgccatatctgtagtctgtcgttgactgaaacatcattatgtggtacatgactacatttatacgcatatatgtagctagagcagggatttttggagaggagtgatcatctttatttttttttaagtaagattctttctagcttgtttttctcactcaataatacctcatgaaaggccctagagtcaataggtatgtcttcaatttgatctttttttttttttttttgtccaattgccctatgttgttcttttaaaaaaaatttttttaatttatttttgttgtgtattgatgggatgtatgaggtattttgacacaggcatatgacgtgtaataatcatatcaggtaaatggggtatccatcctctcaagcatttatcctttgtgtcacaaacaatccagctatacttttagttatttttaaatatgcaactaaattatcattggctatagtcaccctgttgtgctatcagatactaaatattcattctttctattttttgtacccagtaaccatcgccactccctgctacaatttgtttttgttgttgttgttgttttctcgctctgtcgcccaggctggagtgcagtggcacaatcttggctcactgcaagctctgcctcctgggttgacgccattctcccgtctcagcctcctgagtagctgggactgcaggcgcccgccaccacgcccggctaattttgtttttgtatttttagtagagacggggtttcaccctgttagccaggatggtctcaatctcctgcatttggtcttattggctgcatgacatttttatgacgtgcgtggtatcagaatatacccagctgctgcccatttggggatgctcttgttcctagtgttgttgctgccaccgaggggatccttacccagcacagatctgaccccgttggtctctactgtgagcctccagtgactccttgtgactccttcttatcttgaatacaagaaccatgcgtccatcttccacccaggtccttccccctctgttccatcccatcctgttgactgaacctgccaggttcctcttggcttttcttcctgttttttttttcctgtggggaatgccccttccctccagcattttaagagtccgagctctagttcaaatctgtgcacttcccatgccccctcagtatttttctctctccaaggaacttaattttaatctttaattatagtttaatattaggctttccgctatctaagtactgatgtacctgtccaccctcctaaattgcagggtccttggaaacaaaacacagcttccacctttttgaaaaaaatcttccctgatcatgaattacaaaaccttgcacatagtaggtgttcagtaaatattcagtaaatggatcaagtgactgtaattgccctggttagaggctgtttcttccaaactccaacctatttgtcgccatcgagacttccctgtcggtacactgcaggcagtctttgttggagtgagctcaggttctggaaaactagttagttaccagtggaggcagcgcagtagcagagttttgaaaggcgaaatgcctttaagttgtgccttgtccagcctccagctgtgtcatctttgaacattcaattcaccagaaaaggaaattgcagccgaaaagaaaaccaccaatggaaatccagatctaccccctcgtgattgtgatcgcagggtgggttgcccggggcgacaatcagcctatagatccccctcccctggttaagttactgggaaggggcagggacacaatcgcaatgggagcctggatctcgaggccgctccttgctccctccctcccctcccctggctgtgtcaaatcctacaaccacaccacactaattagcccgagaatggaaggggttgtcatggcgaccgggcactttttaaagcacaggaatggtgttcattattgttccatgtctttagctgtggggaaaaggtcagtgtggcagttgttttccatatgaattttggcccaagagccaaactgaaggtgaaatgccccttggagagacaggaagatggtgagtgtggctgaactttttggatggggaggcccttttggtgtaatatctttagttttaataactcgagcttcggactggggaattgtacagactttgttctatagagactgggagaaaagaggggatcaggaacagggaaagcctgagagatagagatattttggatgaaagtctttgcgcatcaagtgattaaatattaagtttagaaggcttctctggtagtataaatttaacaaagttaagtaagtctgatactttattcagtgttccttttatatttgctctatacagtgctgcttagattatattcccaaataaatctcacagaagcattgtaaccaaatgccttcagaacagtcagccaccccccaacccgcatttttaaatccagagatacggcataagagtcaccaaagctaattttgttttcatatttttatgcttttcttacttttctgaggataatttaatcaagactaaaaacagagaaccacagttctttggatgtttgccctaatttgctggctgcacttgtttggaatactgctaaataaagacaatttgaccacagtgtttgtagaagaaattaaatatgagagaagtcagcccactagggctgatggcagctattccatcaaaagctgtgagggacagttgcaaagcattctttaaatttatttttttgccaattttgaaagcttgcagaataacacggctttatgcctaattctgtgttaatgactgcatttttaagggtcacaaattaagccactttgcattcttgtatttttttaacagttaggtcctatggcactatttttttgtcattgtattcacagttgtgtgggataacaacatgcagcttaattaaagggaacacgggtgggtggactgaaaaaacaaaccactgtccccagagttcctaaatggcccacttttttgctttcctctgaaaacctattgtcctggccccagtgccagtttgtttggcagctgaacaaataaaagaacacatttcagagcattaagtcttggttctgatttcctctgtctttaatttgtgtgttctcaggcttatttagtgatcagagtatggagctctcaataaataagtatttgactagaatttgagcaaagtcaaactctttttcgcctctatgtcttccaaaccggctagcgtggtcatctccccttccccatccccacccccacccccacctcacctgccacagtgtgggtatccacccatcaccaagtcactgtgttcttaggtaaaaaatgactttaaattcaaatttaaaaagtaaaataaagtgacatttgtatgacactttaaagtctttgcagaaaaaatagattttaaagtggtggtacatttatgatatttgtgatacagccagaaatgtgaacatggatattaatataaaggaattattgttatcttttaagatatgatactagtgttatattaacacatgacatatagtagaatctttgcaaatgaggtgatgcgatgtttgggattttccttttttttttctttttttctttttgttttttgagactgctctgtcaccaggctgtagtgcagtggcgccatcactgcaacctctgcctcccgggttcaagcaattctcctgcctcagcctcccgagtagctgggactacaggcgtgcgccaccacgcctggctaatttttgtatttttagtagagacggggtttcaccatattggccaggctggtctcaaactcctgaccttgtgatccacccgcctcggcctcccgaagtgctgggattacaggcgcgagccaccgtgcccggctgggattttcttaaacataaggggagggaggaagtagcttgtggatggggcaggattggcaggggttgacggttgttaaggcgaggtgatggttccactggggttcctgtgctagtctctatttctgtgtaggttcaagattctcgtatgtgttttgaagaggggtaaaccaatgatggaggtggctttattaagcctcccttatcgaattccattttttctaatggtatcccatctttttttttgcatggtttagatgccagaccagtttgaccaggcggttgtgctgaaccagctgcggtactcagggatgctggagactgtgagaatccgcaaagctgggtatgcggtccgaagaccctttcaggacttttacaaaaggcaagagggagctgaattggattctctttcttttcaaaggggttggagaaaacagggaaccatcgcagaaggtgaccctgtgtgtcttcacgttgcaggtataaagtgctgatgaggaatctggctctgcctgaggacgtccgagggaagtgcacgagcctgctgcagctctatgatgcctccaacagcgagtggcagctggggaagaccaaggtacgatgcggagaaagagcaactcccaccgaatccctgacagatctcggggtgatgctcacagggtttagggctctatgacaccgctatacaattgttctttcacattgggaagatactcctgttgccatgcctaccataaccttttgtctcccaaacagttactattttatttgaagtgaagtccttgacttgtcagggactctgtttcattagagaacacattgaaacatctcatcctaattgtttgtgtgtgggtatttgttcaggcagtaacaaatgttggcagacgaataacagtactttggaagtaggaggcagcccccagtgtctacaaagcgataccccaagacccttctaactttctctaattcaaatactggcttttatccctgcaaccagagcagcgactgagcgagagatcagtagccggtctgaaatccttctggttgtcaaaaactcagtccagaaagcaaaaaggaaaatctacgtttgaagatgctgttggggcagaggctccttaacccccttttccagataggagcagagtatgggcagtcgggcctgaacataaaaaattagtcacaaaatttgttgtatgacttcttctttctggatcagggaactgccaagaacctcgtttggcttccactctcattccccacccaccttcaatgacttgtcacatgggaaagacagcaatgtgacttgacacagaaatgcaggcagctgaggacacatgtgtcctcgaagagtgaatcctcattcccgctccttctgcccttacacacagcagtgcaatgtcagagaagtattttaaagcttccactcataatatgctgtttttaatctagaagtttcttgctttataaaaagaggaaaggaaagagggagaaagcgggggaagagagagacgtatgtcttgcagtttgaccaatgtgagattgatgaaaagtacttaggcttcacctcctggacattcagcaagggaaagtcatgatggacctactacctccctgctctagggaaattttttactgctgacggatttgagatataaacacaaaacagggtagagatagcatgcagagataatcacatgagctagctattgctttgtaatacattactgcaaacttcatggctttaacaacacacattgattatctcatagtatctaagggtcagagctggggcacagctgagctgggtcctctgatcagggtcccccaagcctgcagtccctgtatcttggggctttgttcttttctggacctcagggtatcttccaggctcacttggtcattggcaaaattcatttccctgtgtttttgaggactgaagtccctgttttctttctagttgttggctgggaaccactcgcagctcctagaagccctcaaaattccttgacacatggcagctcacttctttcaggccagcaggataaccacatgctccagcgtagggttgtagcgttctcacagaagtgatatcccgtcacctttgctgcagtctaatggctagaagcaagtcccagattgcacccccactcaggaagattaaagagggttgtaacccactgggggccacctgagggtgtgccccccgcaggtgataggtctctctgcctggaatcttactctccactcctgtagccaactcatctttaggtcttggcttagaggtagactttgaaaggactccttttttgacattcctcagtgcaccctatagctggggtaagccccctcctctgttgtcccaggtcatcctcttcttagccctgatgtagacttcatatgctgtcctgttgtcttgctgttggcttctctacgatcacccagtagagcatgtagagctgattgttcattctacacagtgctgagcttaatcagtgtctatgaggtgctgaaaaactataagaggtgacacaggatgtcatacatttattaggaaaactttctgaagaaaatggctcaagtggagctcttggcagtgcaatacaatctgctctgattttgtttaatcaaaaagaaattgcaagccaggcacagtggctcacatttgtaattccagcactttgggaggctgaggcagaaggatcgcttgagcccaggagtctgagaccagcctggaaaacatagtgagaccttttctctactgaaattcagaaaaattagccaggcgtggtggcatgtgcctatagtcccagctactcgcgtggctagagtgggaggattgctcgaacccaggaggtcaagactgcagtgagccctgatcatgccactgcactccaacctgggcgacagagtgaaaccttgtctcaaaaacaaaaagaaattgcattctctataaacgagtcacctcactgccttctacagtggagtaacattagagatcattaaaactcaacccagccattaacagtcttttctgggctccaagtactaatccagcttcacttagaatttacattatggaaatcaggcccaaggcaggcttgggacgtagtgtagcataggggacacagagacatgggcgttgtcctcagtttactgtgttggaagataagatattcacacacagtggatgaattaaatcatgcagtacaatctttttaaaggagtaaggaaacagcttcttcaggagagagatccctatggattgaaatgatcaaggaagtattcaagatgaagaagtttttaaagaggagttcagttttaattggtgaaaagttgggagtagaagttggatggaagtttatttttccacagacatgttaggaagtaaatgcaaacatcaaagcatttgaattgtggcttcttgatagctttgatcttgaccagtgtttgagttacatgttggatagcaggtgttttggtgtgttgccaccagaaggtctttctgtttaaagcctcaaacctctaatgaacttctggtcttctggtaaaggaatgtctgccgtacacaacaggcaagtttagccagtgtcgaaggcagcgaattagacatggctccaggtctgaactggctgacttatccaaaacatatttgttcttgtaaggcaagcattcttacctagaggactggagaagcattactaggaattgaagcggcctgtcggatgcttcacggcacagcccgtggggaggagattgcaatgtatttccctgctgaacagctgcgtttacggtgactgaggtgggcagctggtccctctccttcctggttttggcttttcccactgcctcaaggattcctgaagactcaagacttttacttttctgaccctctggacttcagtgtcagacttttcttcctcagttctgtggcaatgaagcatgcaggaggtatttttataaagacagtgtactagaataacccacaggatcttaagctacctaagaagataaaagtgaaaaagaaccacgtgaaatggttcctgttggatattgagtcaagttcagccaagcagcgcctgagtgggtaccaccctttgctcagctgctttggtgcctgctttgatgccacattcccagtcactaggttgtgccaacttggtcttggctgagtcctgggaacatggcaaagtgacacaagggctcacagaaacactttctgtattagtctgttctcacactgctaataaagacatacccgagactgggtaatttataaaagaaagaggtttaatggactcacagttccacatggctggggaggcctcatgatcatggcagaagatgaaggaagagtaaaggcacatcctacatggcaacaggcaagagagcatgtgcagggcaactcccctttttaaaactatcagatcccatgagacttattcactgtcgtgagaacagcatgggaaagacctgcgcccatgatccaattacctcctaccaggtccctcccatgacacataggaattatgggagctacaattcaagatgagatttgagtggggacacagccaaacctatcactttccttctgtcattgtctaattcagggttcgtgttcttaatgaaactgacaggtccctaaaagcattttctctatttgtttgccctttaggttggtgaaggagaatgtaaataaagatgtggaagaatgctttttaaaaacatatttatttatttattttgagagctgtctttttaatggactgaaaactaaagcaagtatttgtctgattctgattctaaccaagacattcttttgacttccaatggtggagaagacctttgctccttcacaaaggtttccacttgttcacgtcatcgctgtgtcactcatgagagttgacacttttgtctctttcgtcaccaccacccccttccccaagatttggctgttatttttccttttaagcactcataagagcaaaagcattagagtaagatatgtaataccaaacaaaaatctcagagaagttgaaatgcttccttaaaagtccagtcttgatgaaaactgcttttgctacatgattttgatatgtacagggaattctgtatttctgaacatctttaatgatgattacatccaacaaactttacacttgtagcttctgcaccaacagagtgtgtgtgtgtgtatatatatattctcatgtatatgtatatgtgaatatatatgtgtatatatgagtatatgtgtatatatatgagtgtgtatatatatgagtatgtacgtgtgtgtatatatatgtatatatgttgctttgagacagaatctcactctgttgcccaggctggagtgcagcagcatgatcttggctcactgcaacctctgcctcccaggttcaagcgattcttctgcctcagcctcccaagtatctgggattacaggcacccccaccatgcctggctaattttttgtatttttagtaaaggcaggatttccccatgttggccaggctggtctcccaactcctgacctcaggtgatccacctgcctcggcctcccagagtgctgggattactggcatgagccactgcgcccggccaacagaatatatattgtatatataatacaataataattgtattataaggagaggattgtatgaagagctttcctaggagaatgatttgtgatggagttttacccagagcaggaataggtacggctgtgagtcacaaggtggtaggactctttatttgcttttttgcccaaatgtcatggaggacacagagcagagaacctggaaaaatgtgccattgggagaacgtgatgcaccattttaggccagaatgacgcatggaagcgtaaagtaaaaaattgcggagacaccaaaatgcatctgtgtggattgttaacaaaaaagcatgaaaatgtttgatactggttgttatagggaatcattcaaaatttcttatgcgtgtattaaatctgaaatggcaaaattaaaagccactttatcaagagaaggtcctggtattttcatatcttttcaaaaactaggaattctaatacaaagtgccaattacctgacacacttatttgataagcagaggatggacgtgtccattctcagacataggcaagcaaacagctacaatttatttagtcctgattccactgtgcttgtgctagtcaaactgagatgtagctgaaataattcagttctcattttaaactcagttttcagaataatgttcttaacgtcaatattttgagtgcatttaagtttttgaagccaagatactctgattgtaatcacatagcaggcacaaagagaggatttccacataaaggcaaaataacgttttagaaatttcttggcttcccttccttcctcctttccttcctctgctttctgtatctctgaatcatattacgtagactcaatgtagtgaccaatgctggtccatgaactattcgtcccagcccatgatgtgttaagtgttgagaagcttagatagcaatttggtagtcatcttatgcctgttgaattcagtaacaataaccataaaaggcacttgtatttgtatgcagcatttttgtttttccttgtaatatatctttattggattttgcaactgttttagcccatgacaggtggaacctttaaaaagcactattctagaaagcatggccatgtggtggatcaaactaagagaaaaaagccttaactccagaagatatctttgactcagaaatgccttccttctgctggccatgttctttgcttctgacatgtgactccgtcctgagcaggtctttcttcgagaatccttggaacagaaactggagaagcggagggaagaggaagtgagccacgcggccatggtgattcgggcccatgtcttgggcttcttagcacggtaagaaccccacgctgaggggataaggcaggaagctccatgagggggtccttccttcccagtgtgttccagtggagtggcctgaggtttttgaattgaggggagcctcaggtcaggcctcctaagcagccactcccgaaacctagctagcctgactgggcagcaggtaggaaagggagctctgcactttttgacttctcaggtagaaagaacagtgacagcagggaactctactgagatctatttatttatttgaggcagggtcttactctgtctctgaggctagagtgtggtggcacgatcatggcttattgcagccttgacctcctgggctcaagcaattctctcacctcagactcccaagtagttgggactacagacacacaccaccatgcctggctaattaaaaaaaaattttttttttagagatgggtcacttcatgttgcccaggagggtctcaaactcctgggctcatgggatcctcccggctgacaaagtgctgggattacaggtgtgagccaccgtacccagccttctcctgatatttaaattatttgcttacttcctctgcgtcaggtcttgaagccacagcggcctggctgttcaccttggtgttatcattttggctatagagacccatcctccagctgtttgaggaatgaggtgacttcttttttttttttttttttttttttttgagacagagtctcgctcgctcgtctggctggagtgcaatggtgcgatctcagcccactgcaacctccgcctcccgggttcaagtgattctcctgcctcagcctcccaagtagctgagactataggtgcatgccaccacacctggctaatttttgtatttttagtagagacagggtttcaccatgttggccaggatggtctcgatctcttgaccttcgtgatccatccgcctgcctcggcttcccaaaattctgggattacaggcatgagccaccgcacctggcctgaggcaacttctcctcatgtgcgttttagttgcatccactatgcccgtgaaacactacgtgttacattttctgaagcacaaagctgtcctgctgtgatgatttttttcatatgaacaggagaatatatcagatctctttgggaactatttacccaactttctgccaagactacttaaagccaacatgaggggttatgtgtttatttagccaagatagtgataggcttcttactttagttttgtttgttattatttctttgtttttctcctgttttgttttgaccaaaggggcctccttgttctctccagtttccataatgagagtctcattctaaaactgggtcctcttttgtcttgtagccttgatgtgagctcatttgaatagctcaaagcctcattacttcaatgccgattctcttgttttctttcattttcagaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaaggtacagtacctttcttgctgggatgaaacaaatggatacattttgagtgctgtgctcggtatctgtctgtgcagccagaaatcccagcagatgccccagaacctacaatttgaaacagtaactctaggtggctagaatataaaattccttggcagcattaaagacccagttctgtgaatatttttattcatacagaataaatccatggccagaggaaggggctctgtctttcatgctttctgtctttggcaaagctgttttaaaaacgtagatctctctgaaaagtggttccagggttattgttgttgattttcacttttcctttactatttttagagaaagagagagagagcgaagagaagccgagctccgcgcccagcaggtaatgagtgcagtgacaacttagcctcttgtgtttctacttccttcccacttctaatgcttggactctaggattcaaaactgaattaaagtagaaagataacaggaagaacaatttaagaggatgtgtttatgatccaatttctgacctattacaattgggtaaagcgtagtgaatggctgaggttttagtgtgcatcacaagagtataatttctctaaatcggtataaccagcgtgttagtttgctaggcccaccacagccaaataccacagactggtggattgaacagtggaaactgattttctcccagctctggaggccggaactgcaagatcaagttatccttaagtttgatgtcttctgaggcccctccccttggcttgcaggtggccgtctgtccagtgtgtcctcacgcagccttttttctctgtgtgacctagtctcctgttcccaaaaggacaccagtcatcttggattggggcccaccctagtgaactcattttaacttagtctcccctttaaaagctgtatctccaaatgcagtcacattctgcagtattggggttaggacttcaacctatagactttatggggacacagtccaactcataatgaccatatttcatcctggttgcaaagcgggagctatgcttggacttttgtactgaagccttctgaaatctcccttctgcttctgtccaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcggtaagtacctgcctggcgtgtcccagtgaaatgggtggccggtcacacccacccctgttgcatcctcaagttgaatgaagatacccgtaggatatctgtgcaaagattgcagagtcgtggtcttagagatcatcttaaaccttttgcttattccataagccaattgcattcataagtagaactttgatgtgcctgtttcagttttagcacaaagcctagagctgagctgtgcccaagacttcagaaaactggctatttatttatttattgttgttgttgttgtttttgaggtggagtcttctctgtcatccaggctggagtgcattggcaggattttgcctcactgcagtccccacctctcgggtccaagctatcctgctgcctcagcttcctgaatagctgggattacagatgcccgccagcacaccggtctaatttttgtatttttagtagagatggggttttaccatgttggccaggctggtcttgaactcctgacctcaggtgatccacctgcctcggacccccaaagtgctgggattacaggcgtgagccaccatgcccggcttaaaactggctttttaaatggaacttttgtttattttattttatttcttccttccctttttttacaatttgaatggaacttttagctttgccgtgctgcgttaggaaatgaagacacatcctgaactggaacaagacttgccaggggtgaactggcaaactttccttgtactaacttcacaatccaaaccacacgatgttatttcttatagtggctgtaaaggaagaagctgcagggcttaaatgtactcttttccagtttctggatttatctgtagtttacttttattttgtcgctttggtcgtgcattgaatgttctcttgactttcaaagatttgaaaatatatttaatatagtaattcagagggggtgaactcttgcatggtttgattaaaattatagccttaaaaagcattgttagttttagggcagatagcctttggattcaagtatatcttgtctttcatgtatcaattcaactgaccatttgaccttaaaagttggtatttttaattccgaattatttgtgtgctaccgtaaatcaggcgtattgcttgtcagttgttttttttctttttccttttccctttttttttttttttttttttgagactgaggcttgctctgttgcccaggctggagtgcagtggcacgatctctgctcagtgcagtcactgcctcctgggttcgagtgattctgctgcctcagcctcttgagtagctgtatttttgtattttttcaatgatgatacatgctgggtatcttcgtggcttgctttgtggccttttccctcaccgttggcttctctctctcggtccagtttgaagatagtgaagaggactttgattccaggtttgatacagatgatgagctttcataccggcgtgactctgtgtacagctgtgtcactctgccgtatttccacagctttctgtacatgaaaggtatgactgcagccgccatggagtctgggttagggggagagcgaggcgttattttatccgggctgatggatggcggtgggaaataacggaggtgttattgtatctgggctgatggatggggactgggaaagtcgttctacctacccttacctcagtgttgggccacttagatgaatgaagggacaccttgtcatgttggtgtgacatgggtgctgtggtcctaccagcatgaacacagtcgtgactcccctggtttggtgcagagtggcaggacgaagcatttgcaaccactgcctccagtatcagtccttctcccctgtctctccctgtctcgttttcctttcttagctctttcttcatccttctattttctctccctctctctcccactttctctttcactgtctccctctctgtctcagtctcattgctctctctcatatatacagacatacaaaccaatgtgtgtgttgctgctgctgctggaattggtcgagacccattctcatgataaactgcatgttctcggccggctgcgtggtggctcacgcctgtaatcccagcactttgggaggccgaggcgggtggatcatgaggtcaggagatcgagaccatcctggctaacacagtgaaacgccgtctctactaaaaatacaaaaaattagccgggagcggtggcgggctcctgtagtgccagctacctgagaggctgaggcaggagaatggcgtgaacccaggaggcggagcttgcagtgagccgagatcgcgccactgcaccccagcctgggcgacagagccagacgctgtctcaaaaaaaaaaaaaaaaaactgcatgttctctcctgccagggatattagagagcctaaaaggatgtgctagacatgggggaaagtgaagatctcactgaggcccactgctggcttgaactgctcaccatacctacttcatgatgagcatttgcattgtatgctttgattgttactaacatttgagtatactttgctgaaccttaacacttaggggccttgaggcacactccttttggaaaattatttactatttatttatctatttatttaggtatttatttaagacagggtcttgctctgttacccaagctagagggcagtggtgtggtcatggctcactgcagccttgaactcaggttcaagccatcttcctgccgcagccttcataggagctaggactgcaggcgcacaccatcatgccaggctaattttttatagagatggaatctcactatgttgcccaggctggtctccaactcttggcctcaagcagtcctcccaccttggcctcccaaagtgcaggaattgcaggcatgagccaccatgcctagccagaaaattatttaattatttaattgggacctcatatttatgctttgttcctgttcttgactctgactcgtaactcagtgacagggataataagaaaccataatcatcaccaattttgggcaggagttttacgtggatggttaaaaagaagggaccgtcctgtttctcgcatggacctagactggagaggggagagagtcgagaaggtggagatgggcagggatatgagaaccttcctccccaggtctcctcttcctgctttctcccatatttgatttttaaatttgtcttcttcctttttcttcactttcctttttattgccgtctttcttcatttacatttacattttcttttttttgtcttcaccaccatgaaaacctttttttttttttgagacaggatcttgctctgttgcccaggctggagtgcaatggcacagtcgtggctcactgcagcctccgcccccggggttcaagtgattctcctgccttagcctcctgagtagctgggattacaggcacacgccaatgcccagctaatttttgtatttttagtagagacagggtttcaccatgtcggccaggctggtctcgaactcctgaccttgtgatctgcccgccttggcctcccaaagtgctgggattacaggagtgagccaccgcgcccagccatgaaaacccttttattccattttcccttctttctttctgtgcttctcttttctgttagcttctttacgtttttttccatgtcttttcttttgttatcttcaatattttttttctgttttcttcacttgtggctttgtttgctggattccttttttgcttcacctgctcctcttagaaaacatgggtctagtgacgactgtcagtcatttgcctttcagagttctgccatcctcagctttggagccccacagtgctcatgaaacccctagaaggtttggtttaggggagacttttagtaggactgttggaatgaaaaacatcaagggtgaggtagccagcactggaacacctgacaaaggaaaaaatgtcattgcaaatcagaacctttgatccaataagtatttaatcatagcatcttaagattttctcagttagaaatcatcttaactgtttttactaatatataattcccattcctcaatttttaattccctaagttaatttgaaaattctcttcaatattcctcttaatgtatgacattgatttttttttttttttttttgagacagagtctcgctctgtcacccaggctggagtgcagtggtgcgaactcggctcaccacaactgccgcctcccaagtttgagctattcttctggctcagcctcctgagtagctgggattacaggcgtgcgccaccacgcctgactaatttttgtattttgagtagagacggggtttcaccatgttggccaggctggtcttgaactcttgaccttgtgatccacccgcctcagcctcccaaagtgctgggattacaggcgtgagacaccacgcccggcagcattgatttattatacagttactggattaaaaccagtaagagtaggaaaaaagtaaagacacattcaaagtattaaaatcagggtcaaagaagttaaatgggtgagttttcggcatctcttaaagctattgtgtaaatgcagcctcatttaatacttaataaaactttaattaaagcagagccaaaaagtttcagagcaacgaatgaatgaaaaagaaaatctaatcaccaatttatattttatgggcataaataaatttttacaaccaaataacctactaaagatgtttgcaattaggaaattatagcattaagtgattctctaaatgatgaattatcaagagagggcctgaaattgcaaagggagggccaagagtgagtgctatcaataaataaataaataaatctaattaatcaattagattaaataaactaatggtgagagctgtcgtgatgactcttctaatctttgaaacaactgtgaataagctttatcatttaacaacaacaagataatagaataattttgcacagttttcctccaggcttgttttgagaaacccagattaaagtcacaaatcaaaacactaataatgtttcattctggtagccgttggcaagtttgccatatgttaggacacggctctgcagcttggcacaattaccaaagatgtctcagctagatgagcaggggcctcttggacaaaaggagggagaggagtctagaaagttcagtgaagcaagtgcactgtctggttttcacacagtgaacgcataaaaggataggattatacttactttaaatatcccatgtttaaatgacccttattttcattactggttggtcaaaagaaaataatgtgtggacagtcttataataacagatgtgtgtaagatgttgatcttgagcaggttggggaatctggaatacaaaattatcctccctgaagagcatagcaagatttttttatcctatgaaagataacatctgtatatttaagttcaaatcttagtgtagtttgtactcttgctttctttttttttttttcatagtctcagtcttatacctgtaaaccattttcagatgatgcttttctttgaaaagatgtttttctccaaaaagccatattgtctttacctgtgtaagttagactttatcagtcaaccctggaatcactgataattcttgttcgcacattgaccaaatatggaaggaaatgggtaaactttgtttattttttgagacggagtctcactctgtcacccaggctggagtctagtggtacaatctctgctcactgcaacctcctcctcccggattcaagcgattgtcctaccccagcctcccaagtagctgggattacaggcacgcaccaccatacccggctaatttttgtatttttagtagagacagggttttaccgtgttggccaggctggtctcgaactcctgacctcaagtgatccacccgcctcggcctcccaaagtgctgggattacaggcatgagccaccgctcctggcccaaaaaacgggtaaagaaactggtaaactttgacaccatgttaaaataattttccctctctggtgcattttgggataagcctgatccatacatagggacatggttctcacccttggcttttgactcattcctgggttagagtgtcagttcattacttgcttttctattggctcctttcaaagctttctcagctaagtgagcaggaactcctttggatagaaggattcttgtataatccagcctggctggtgtgacatctgtgtggtgcccccagacatgagctagcagtgccactcctcactgaggggtctctgcggtgctgcggctggggcagagtctaagctcggctagaccttaacacctgctatgcatgttgttgtcatccaacttgactgacttttctttcacccctctctacccaatctcacggggaacaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaagtaggttgctaagcctggctgtggcccgatgggttgctcatggtttatgctggtggtcatagagccatgctgtgcaagttccttgcagcggcagtagcctgtagcaggtgtcctgatagttcagttcagtaggttaaattactaggaaactgggaagcaagacttaatccatgagtactttgctttttgtgattacactcagacatgtggctgtcatttggaagatggccagccaattggatctggaagttgcctggtggaaacggaattgaatgtgtggaggaagaatggtgtgaatttggaacaagtggctgagtctttttatgggttaatgtatcactttcaattccttactccagctgttgccagcagataaattagctaaattaaaagcagacagactggaggagttttccgaaataaatcacttctcttctgttataccagtgttggttatactagccatccccattcccagcagtgagaggaacagggctggtcttcaaatccaacatgcccccttttctgccacacccttatagaaccaaagctttggactattgagggcctattatttttgttaaaagactaagtaatgtttccagaaaattgttgggagttacaagcagctggttttctggggtaactagatactaagcctgaaaacatgtttggggataacctgtagccgtactccactcaaaactgagtgacctcaaatatttagaaaagtagtaaaataatctttgagggatcaaattaatgcctgaagtcaggagccttaaaagtaaaatgtttctaatcagccagcatccgcaacttcagaaaagtattcattgtaaagtggaaagttaaatgaggagaagaaagtcttttatgtatttgattgtaagggaaaactcatgtctctgcagacggcagaatattggacatttccaggctgtccctttggagttcatgaggtgcgggagtgcgcttgtgagaatcctgggtctgaatcctgcaagggttcacagcaaggcatggctctgttgcctctgccatcttctctcagcctcacataccgtgatgttcctcatctgtctatagatcaattgattgactgacagggtctcactcccattgcccaggctggagtgcagtgacacgatctcggctcactgcagcctcaacttcctgggctcaggtgatcctcccacctcagcctcccgagttgttgggactataggtgtgtgccaccacgccaggctaattttttgtattattggtagagacggggtttcgccatgttgcccaggctggtctcaaactcgtgggttcaaagccatccgcctgccttggtctcccaagtgctgggattacggccatgatgtttctctttaattatcccatagaaggggccacaagcaccaagaagctgtgagagagggaggcatagtattgaatttcaccagagtacattgatgtatgtttcttttgcaactcactttgtatgctgcttaataaaagctctattcttaggtgcttcatcagaattatactgagttatggaaatgttagctcttattcagccatttctgtcacctcctatagaacaggaacagtgagttattatggaaaacttcaatcatgggcaagagtgggtggaagaatataataaaccacggacttattccagagctttcggtggctatccacccatggccaagagtgtttcatccacagttctatccagtccgctcccccagcaaaccacctccttttatagcaagtccctatcatataatttcttctgtaaatatttagtaggtatttaaacattctaatacataatcacaataccattatgacattaaaaaaataatgttagctcctaatattatccaaactcccagtcattgttcagatttctgcagtggccttatttttttatttttatttttatttttttgagaccaagtctcactctgttgcctaggctggagtgtagtggcacaaccttggctcactgcaacctctgcctccctggttcaagcgattctcctgcctcagcctcctgagtagctgggattacaggtgcctaccaccatgcctggctaatttttgtatttttagtagagacagggtttcacatattggccaggctggtctcaaactcctaacctcaggtgatccgcacacctcagcctcccaaagtgctgggattacaggcgtgagccactgtgcctggcctgcagtttccttataagtggaggtggtagtgttcttgttggtttgggttggttttatagttattttcttcaagtcagaatccaaatgaggtctagatgttgtcactggtttttagatcactcaagtctcttttaatgtatagatgcccctctgcctttctttcacttgctgtttgtaatggaacatgttagctcgcttatcccatggtttctagatttcaccaaccctatatgggcatgtgtttgaacgtgtttctctttctcatttgtttcttgtgaattggtcattagacctagagagtgatcgagttcaggttttctttctgtttaagagtgcttcacttgtgttggtattgatttctgttaagaaggcttagagtagctggttgtcctcttgtgatgtcagcagtagttctgatcttgatttttttttttttttttgatacagagtctcgctctgtcaccgaggctggagtgcagtggcaccatgtcggctcactgcaacctctgcctccagggttcaagtgattctcctgcctcagcctcccgagtagctgggactacaggtgtgcactaccaagcttggctaatttttgtatttttagtagagacgggatttcaccatgttggccaggctggtctcaaactcctgacctgaagtgatccgcctgcctcatcctcccaaagtgctgggattataggcatgagccgccacgcccggccctgatcttgatttttttttaaatatttcatctcagtgattctagctatgaggtcagataatacttattttctaaccagactattttagttttgttgctgtaaaatacatgttttattgtgaacatttgtacttttttttttttttttgagacggagtctcactctttcgcccaggttggagtgcagtggcgcgatctcagctcactgcaagctccacctcctgggttcacgccattctcctgcctcatcctcccgagtagctggaagtacaggtacctgccacctcacccagctaatttttttgtatttttagtagagatggggtttcaccgtgttagccaggatggtctcgatctcctgacctcatgatccgcccgcctcagcctcccaaagtgctgggattacaggcgtgagccaccacgcccggccgaacatttgcacttctttagttatcagagcaagctggctttatgccccaaacccttcttcatcaaacgtattactatctctggtctgatcctaacatctgctgctgttttaccctgattttgttaacctggttcaccaattttatttctctagtgttgtttagggagggttgcagatgagatcaagatggtattgagaccaaacaccccaaatcctgcgcctcactcccagcacccctgatggaaataatgtgcacatctcaagcagaattcagacgcagatgccctggccttaagctgggagagagctgtgatgaattagggaaagagctcacgccgggccgaggttggcttttgtagatttgagaaagggtccaaaggaagttgcaggcaggagtgggggctgctgcccctggcctgtctgggtcctgagcaggggtgggcattgggcagaccagtgtgaggggagagagcctctcccctagagaagtcaggggaaccctgctatccctggccacaccagcagcctcctccctgggcagcagagatgagactggctccccctagagggtgtcttcatcattgctaaaagaaaaaccattgtaggtccctccatgtcttttggtgacgggttccagaaccaccaccccactccccaccccactgcagccatcaaaatccccagatgctcgagttcctgctataaaaggatgtagtcattgcatgtaacctatgcatattctcccacatgcttcaaatcgtctctagattacttacaatagctagtatgttgcaaatgcattgtaaatagtagttacactgtattgttttttaatttgtagtattattattttttaaattggatttttatttttgatctgctgctggttgaatccacaggtgcagaacccacaaatcctgaactcgcagatatggagagccaactgtgtaccgtttcgtcagtaacagacagttcccaactctagtcattggcttcattagttgctttcctcagttattcagaatttggtgttcctgatgtgcgtttgttgcttttgcttctttgcagagagatcatagataacaccaccaaggagaatgggatcgacatcattatggccgataggactttccacctgattgcagagtccccagaagatgccaggtgagtctgcgctgttgactttgtgttacccacatcctgctccctcatgcacaggtgtgagcatcacacagagcactgtttactgtactggccttgaaaaattttaattgactttttttgaagaaccaagagtcatacgagattgatgcacttgtcccttggggaatctttccctgggcaaatgtgttcaagtacagcacagagttcaggatttccagcctccagtgccactagacagatccattgtcacctgtctctcaggctgttactgtcaccggtagcgtgtgtaaattatacagctgcatgaagctgaaaatctaccctctggaagcttctgagctttgaaagtgaatcatttgtgtttgcataaggacgaaaaagggcagggagcagtaactaatggctgtttaagtaactgatagtgctatggcactggggggttttaaagatcttaatattgaagaattcaatggaagaggtactaacttacacagaacttactattagcttggtgcaaaagtaatcacaattatatttcaggctaatattctaaatgtttcatacctaagtatttcaggaagtattctaaatgcttcataaatattaactcttttgattctcttggatcctgcaaggtagacattaattattaccatcatccatactttgcagaataagagactagggtacagagaacggttagtatcatttgtaatgcagtgcaacctcaattctgttgaatggagacattgaacttcttaaaaacatttgctcctaaggagctttaacttttgactgagattagaagagggtggaggccttcattggctggggcaagttgtctgtagcttcctggacttcaggtttccatgctggagtgctgaggagacatagcacaaaattaaggagacttagcatttgctcttcagtgtgatggatcacagggtcaccttgtggatctgacaccgtggaacgtctgtcctgtctattcctgcagcttgtgagtttgtgagtctgcagggttatgctggaggtgtctgagcaatgccagagaacatcttttttttttttttctttttttttgagacagagtttctctcttgttgcccaggctggagtgcactggtgcaatcttggctcaccgcagcctccaccttccaggttcaagcaattctcctgcctcagcctcccaagtggctgggattacaggcatgcaccaccacgcctggcaaatgttgtattttttatagagatggggtttctccatgttggtcaggctggtctcgaactcccgatctcagatgatctgcccatctcagcctcccaaagtgctgggattacaggcgtgagcctcttcctggctgagaacgtcttttaatttacgagggtaacatccaatagccgaattcttcaattctcagccccaagatcattaggaccttctagtatgttctcaggacccctcactaccccttgccctttgaatctttctgagttgatacagtaccatgatagcaacattaagggtaaagacaccagaaaataattcttcccatgggaacaaactaaaacacctgcttagacccataaattctaacacaaactggaaaaacaagcaaacctggaattatagcccatcattctgtctgggactcctggagaccacatgtggttgtttgtggcccagggaatgcctgcagcttttcagctgaattataggcccagcgtttggcagctgccctgtctgttttatgccacgatgaacctgctaaatttaacctttggaatattttagccaaggactttttctcctgaccagtggaacactattttaaaaaaattccttttcagattccaagttatacttgattcaagagaagaaatttataaatttaagagtctaatctagacagaattgaaagtgcaacaaatttgatgcctttgtgtatgtgattcctacaacttgaatgtatgtctttttcaatgtttaatttgggatatttttgagatgagcaaagcaatgaagtcttgctgtttggttaaccagaatggatagtgcaaatttatattaaagtgttttccttgttgtatacaagagatatgcatatctcttgtatatgttgaatattttcaagcttgtagtcacatttttctcccttaggaagcacgcgagatagattttagtgctttgctgtaaatcgtttgcacagcctacctttacatatggtgtcatttttttaacttaaacatgccattggataccaagtacttcccctctgccttaaacagtaggagtatatatatattttgtgtcttataagcccccagcaggagaaggataccctagcgtctctttcatatttgatagcgctcacattttgtagttggtcagtaaatgctagatggatgcatgtctgttcatagtcattttcctgatgctttgttctgcttgatttttcttaagttgacatgttttgtttcgttttgtatttgttttttttgtgaggcagagttttgctctgtcacccaggctggagtgcagtggaataatcgtggctcattgcagccttggccttctgggctcaggtgatcctcctgcctcagcctcccgagtagctgggactataagcatgtaccactacacccagctaattttttatttttcgtagagactgggcctcagtaaatttcccaggctggtctcaaattcctgggctcaagccatcctcccaccttggcctcccaaagtgctggaatcacaggtgtgagccaccatgcccagacacgttttcctttattttctgattgtgatgaggttggatgtgagagtactcatttgaaataaagatggaagagttctctggtcaaaatagttttctactttaaaacagttatttttcatttccaactctcctgtggttttattgacttgagtagaaatgctgttagatggttgaaaaccccatcctgggaatacataacaaaaatagacatctaggccaggcacaatggctcatgcctgtaatcccagcactttgggaggccgaggtaggtgaatcacctgaggtcaggagttcaagaccagcctggccaacatagtgaaaccccatctctactgaaaataccaaaaattagccgggcatggtggtgtgtcccagctactcgagaggctgaggcaggagaatcacttgaacccgggaggcggaggttgcagtgagccgagattgtgccattgtactccagcttgggcaagaagacacattccatctcataaaaaaaaaaaatagacatctagtggccattccaatatgatactctccattacatgttgagtatcccttacccaaaatgcttgggactggaagtggtgcagattttggagtttggaatatttgcattagacttaccggttaagcatccctaatctgaaaatttgaaatgttccagtgagcatttcctttgagcatcatgtcggtgctcaaaaagttttgaattttgaagcatttcagatttcagatttgttttggattatggatgctcaacctatattgatcttctcaccttaaaatttatgttttaaaacagaaaaagcacctgaatgttccctagtttataagtaatatcttaagtaaggatccttgatataagtattttgggtagaactgaggatttattatttgctgttaatttctcaaggaactcattcatcatcgtcaaatgtctgtaaaggtctatgggacctggagaaaaggccgtccattgacctaaagttagaacataatatagcactaaaaggcatttacacgtactttatctgcttcttctcactttattctttggtaatgaaactgacatttacccctaagaagtaatcaaattaaaagcaaaggtgcttagagatgtcattttcacagagcacgtgcagtagggcactattgctttgccagtacgaggttggcctctccttgacagttgctctctcttccccacagccagtggttcagcgtgctgagtcaggtccacgcgtccacggaccaggagatccaggagatgcatgatgagcaggcaaacccacagaatgctgtggtacgggagcactgtgtgggatgggggtggggcgtctaggggcagggacggggagggcgtcaggatggtaaaaaagggaaagattgggaatttccagacagtctttttttaaaaggtaaatatagaataattaaggagaaaaacaggaccatttgagtttagaatcaatacaataataaatataataagtggtacaatataatacaataataaatacagtaaattaagttggacactgtggctcatgcctgtagtcccagcactttgggaggctgaggtgggaggatcatttgaggccaggagttcaagaccaacctgagaaacatagcaagacactgcctctatgaaaaaaattaaaaattatccaggcatggtattatgggcctgtagtcccagctacttggcaggctgaggcaggaggattgcttgagcctgagaattcgaggctacagtgagctatgattgcgccactgaactccagcagcctgaccctgtctcctaaaaaaacaaacaacaaaaacgaataaattacagaaggttgtaagtagtaatacattccagttctctcacctcaaacctttaaaagaacaaaagaaataatcctactttttatgaagtcacggaagtacacatcacacttactcttcagaggacttggtgaaatctaaattgtattcttattttttttttttgagatggagtctcactctgtcacccaggctgaagtgcagtggcgagatctcagttcactgcaacctccgcctccaggttcaagcaattctcctgcctcagcctcccaagtagctgggactacaggcgcttgccgccacacccggctaattttttgtattttagtagaaacagggtttcactatgttgcccagtctggtctggaactcctgagctcaggcaatccacatgcctcagcctcccaaagtggtgatacaggcgtgaaccactgtgctgggccgaaatccaaattgtattctttgtcttccctctatcccagacacaaagttacaaaaccctgctttggaaatcaagttttatttcctcatcagaaaatcttgaaataaagtttcttaggagaagaagtgtaagatttaattaaaggacacaatataatcaggaaatttgtactattgaaagaaggtcataaacactgttcactgaacatattttaagaataagaggggccaggtgcggaagctcagacctgtaatcccaatactttgggaggccaaggcggatggatcacttgaggccgccaggaatttgagaccagcctggccaacatggcgagaccccatctctactaaaacacaaaattatccaggtgtggtggcccacacctgtagtcctagctacttaggaggctgaggcacgagaatcacttgaacctggaaggcagaggttgcgttgagctgagatcacaccattgcgcagcctgggcaacagagtgaaactctgtttcaaaaacaaacaaattaaattaaaatagaggtacttgtagaaaacttagttaaaatatttttaaaaacaaagaaataaattattgaaaggttaagaggtaatgattaacttgtaattttaaaaaataaatggcctatagattctgctccgtgtagaggctatttgtactcacacaacagaggagtcgtctcatagataactattattttgaagttaaaaagaaaagagccttttctgtctgattgggagttgtgggctagaggtattactgtagtgtgcaccctactttagtgcttctctcattctgtttactttttgttcttttccagggcaccttggatgtggggctgattgattctgtgtgtgcctctgacagccctgataggtaagctcagatgtggctcttaacaaaaacagctcatcacctgtgtgtgtccacaggtgtctgtgctgctgggtcacgaccctcttcacagggctgtgaaatcacgcaaggctgtgtgttcccaccttgtcaaccccagcaatccagtcttccttcttggtacccaattttacatcacctggaagtctccttctctgggtatctttggagtcctggggaaaaccgtgggaacctggacaattttaaaaagcatgaggaatatttttaatgtgtatacagggacaaacttgggatttatacaggaagaaaatgcctgtttaggaaaatgatattccagcaaaggggaagggagtcattctcctttctgaacttaacgataaacttgaaaaggattttgatgataatgtatatgtagagtattaataaaccacaaacattgattttccttgacatttcttctttcttggcaccctttttggttttgatttttgaaggcaaatcatctttggagatgatcttacgcgtctttgtgcccagtgaacttcatctttattgtctctgtttttctgtattatcttgtaagttctacttctggcctgcagcagaatttaagaaaagtttctctaggacggaccagagaaagaatcaaaattgtcttctgccctcagtaagatgctggaaagtgaatacgagtgtgttaaaattgacaacaaaatatagtgcctccttggcagagttagagtgctggggtctctgtcagtcaccctcccgttgacaagagcccttctgaaccatgggtcctttgtttttagtagtcagcttgcaccccttataactggctcaggaatctttaacacgtatgtgtcatatccgtaatcaaagccctggtgcttcttattctggtatgtgagtttctaccttaccttctccacatctttactctcccaagcccttcactcctccaggctgggcatgtgatgatccatccttagaattttgcatcctcattcagggttttctctcttcctcaactggccacttttctcccttgccaactatagaaaaaggctttttttattttttatttttaaggggcacctcaagtttagcctgtttgcatagcttttcctgtgtcctgcagtccagttactctttttcttaaatttttgtgtcacctaactacagtgaacatttgaagacttgcaagaaagagttcacattctctagcttaagccgttagatagaggagttagtatttatattagcaagggcctatgagagaggttcagggcatttccagacaaaaagaggtgagggagaaagtaaatttccattatcacgttatccgtgactaggaaatgcacccttgttagatcactttggaaacccggacccaggtggctttttgtataaagcgtaatcaagcatttaagatgctccacctacacctatttactgatcctcttttattgctggtgtctgacatttcattaccaacccacagaaatattacccaaggcaggaagaaattgactttggagaggcatcaaaaaaaaattttccctcatggtcaccttgtttagccttcccggaactgagtttcatctggaaagttttgcatgaagaaatgttttcccttccaggaccttcagaatgaatgtgttgctccaagtttaaaggttaatgatgcgtaaaagaaattctgcagaaatgagcaacgtttgccttaataaaagcacagatagcctagcagtgtatatcccgtgacccagaagccaggaagaaggcactgagtctcggttcacacagaggtgatgctgacggtagggctaaggggctttgtttccttctcatcttgtggctcagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggtgactgcctgccctgcttcctcggtctgcttaacagactcccctttccatttgcatatagacatctgcagcattttcatttcgagctgcttttcccagtcattttaactgttggagattttgtaagtgatttttaatttgtgatattataaagtgtttctagagggtcatgttttttgttgctagttgtgattttgggcttttctttcatgtagtcgttccatttacatcgggttggggtgttcgtggtctttttctggcaaacagctagaaaccccacccatgtgttagcattatgcagatgattgtgtggtctttggggtttctcctcacagattttaatttacactttaatctttttttccaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggtaaccaggctggctgcccgaaccctgagcatcaaatcttaaagtctgggcttgctccgggcaaaggaataagattccttcctagtgtgtactttatttccccccaaagaagttgtcctcttggtttatcttctaagcctgtctggggttagctatgtgaccacttagtgtttaagccgtactagaggtcgattcatggagtggtaggaagattctcgcaaggacaagaaaatgtcaacagatgcagggcatcgtacgggaagcttggttttcatatactgttttcatccttttaattttcattcttctcatttttgagacagggtctcacactgttgcccaggccggagtgcaatggtgcaatcttggttcactacagccttccagggctcaagcaatcctcccacctcagcctcccgaggagtagctaggactacaggcacgcaccatcacaccgggctaatttttatactttttggtggagaccaggttttgccatgtgggccaggctgttttccatcattgtacgatgagcgtcctatgcaacctgtaaaagataaatcctgactgtccatgaacttagcctagtagcatagaaagtacacaggtaacttagagggtttcttgtaatttttgtagtattatgaaagtgtttccagaagatggcttattttgatttttgttgctggttgtgatcttgtgcttctgtgtaacacagttgttccattcgcgtcaggtttgggtgacggttcggacagcttgcctctgaactcacacactgccaggccaagtgctgtcttctgaagggagaggctaaagaaaggaaaggaagaaataggaagtaagaaggaaagtcagaaatcagagagagttttcactcctgttccagagcccaaaaagagacattaacttacccttttcccttccagagccagttatcatttatctttatatatttaatgatgggtttattgttctaatactcatctccccatctcagctgtaaatgtcacagtgcaagagacactttttttcttcatcactagatacctagtgcagggcaggacaggacacatgtaggaattaagccagtgtctattgaattgaataattaaagggactgaggtcagagaggacacaggcattgcctcagtccccgaggttggcgttgacgtgcgtgtgctgggcacccctgccattgcaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggtaagccaagacaagcccatcaaggtgggtgattacagctcagagattctacccttagagcaccaagacctcagcattagtgaagctcaattttttttctgtaatcaaaactagtgcttggttggccggcacggtggctcacgcctgtaattccagcactttggaaggctgaggcaggtggatcacttgaggtcaggagttcaagaccaacctggccaacatgatgaaaccgtatctctactaaaaatacaaaaattagccgggtgtagtgacgcattcctgtaatcccagctacacaggaggctgaggcagaagacttgcttgaacctccgaggcagaggttgcagtgagcagagatcattccactgcaccccagcctaggtgacagagtgagacttcgtctcaaaaaaaaaaaaaaaaacacccaaaaaactagcgcttggttaaatttgtgtttgagtaccctgctttcgggaatctaaatgagaaactttagaccaaaaatgttttgtctctagggaagtgttagacattttcgctgagtcacccgatcccacctgttgggttctgtgggcagaaggatgaggtctgcagcttgcactgtggggctccctgctcatggggatgtggtgacctgcgtgggggaccacctgctttgcgtcaggttctccctcagcctcagttggagaccttctaggagtaaccggctagttccactgtcactgtacagtttccagaccacacgagtgaattcccaaggagcccagggtggtctagaagaacacttggcatccctctcaggcacgtgcaaacttccagaagctcctgagtctctctattaacaccgagcatgttacattacaaattgctgtttataagtacgtgtagtcgctcagtaaatctatgtgagatgaaggaatgaatggttgcatggcagccctgagcggggattcttaccctcactttccggaaatggaacggtgacgggggatgttctggttgcactgcccacgtagccggtcagtcccgggtgcagaaccaagtcaagggagactgctggccctccaagcagtcctgcaggcagattcccagggcaagggacagagctggggctgtgacagagaaggtgctagaatgatggtgaggcaggtattttactgatggacggcaaaggaaattagctaaccagatccaagagggaactcagtttttgtggaggtgggagaggatctaatccatcagtggtggataattttccatcaaaatcaaattggcctcctgattccaaagtggtatgttctctgggtgtttaggtgtttagaaccagattctggcaagccagttgttttttgtttgttttgagacggaggacggagtcttgcttgtcacccaggctggagtgcggtagtgcgatctcagctcactgcaacctccgcctcccgggttcaagcaattctcctgcctcagcctcctgagtagctgagattacaagcacccaccaccacgcccagctaatttttgtatttttagtagagatggggtttcaccatgttggccaggctagactccaactcctgacctcaggtgatctgcctacctcagcctcccagagtgctgagataacaggcatgagccactgggactggccttgagccaccacacccagcccagttggaaccagattcaggttgttttccatgcaacccagggcactggctacacataatttcatttttagccttaaaaaatttattttttgaagatttcttctgaaaggagtaaaactatcatgtatcagccacactcagtcttcggtgctggaacttacctgtttttgtattcttcagtttgaattcagacattaaaagagtacataggatttttcagctgggcatggtggctcatgcctgtaatctgagcactttgggaggctgaggtgggtggatcacctgaggtcaggagtttgagaccagcctggccaacatgatgaaaccctgtctcttgtgaaaatacaaaagttagctgggcatggtggcaggtgcctgtagtcccagctacttgggaggctgaggcagaagactcgcttgaacccaggatgcagaggttgcagtgagccgagatcacgccattgcactccagcctgggcaaccagagcgaaactctgtctgcaaaaaaaaaaagagtaaatatgatttttcaaatatgaagccatgcttcttaagaaataagttggccgggtgcgatggctcacgcctgtaatcccagcactttgggaggccaaggcaggcgggtcacgaaatcaggagattgagaccatcctggctaacacggtgaaaccccatctctactaaaaatgcaaaaaattagctgggtgtggtggcaggcgcctgtagtcccagctactcgggaggctgaggcaggagaatggtgtgaacccgggaggcggagcttgcactgagccaagatagcgccactgcactccggcctgggcgaaagagcaagactccgtctcaaaaaaaaaaaaaaaaaggtcaagttaccctaaataagtccataaaattgtttgaatcaatttgaatttagacattaaaagagtaaatataatttttcaaatacaaagccatgcttcttaagaaatgagtcaacttaccctaaatcagtccatataaattatttaagtaattaaaaaatttttatggccttcaattggatattactgaaaaagttttatagtggaaatgaaattaccacgatagaatgattcattacctctcctccaacttttctgtttatttaaggttctaaaagtaactttgtttttttcatatccagatgaccattttaggagcataggtacatgatgaagaaattccgtgaaagactttcttaggtttcaagggtggcacgtggaaggacagtctccccaagaatatattaatgtgtgtagttttcaggtatagagagaatagaaaacagcaattcaagaactagcaaaatgtgtttatgaaatgaactatagataaaaataacatgatttagctactgatggctaaatcaataacagaagatcagattaattttttttattttgctctcttattttttatagagacagggcctcactatgttgcccaggctggtctcaaactcctgggcccaagtgatcctcctgcctttggctctcaaaatgcacaggcatgagccactgtgcccagcctaaatttttttttgagacggagtctcgctctgtcagccaggctggagtgccgtggcatgatcttggctcactgcaacctccgcctcccgggttcaagcaattatcctgcctcagcctcatgagtagctgagattacagctactcagccaccacacccggctaattttcatatttttagtggagacagggtttcaccatgttggtcaggctggtctcgaactgctgacctcacgatccacctgcgtcagcctcccaaaatgcggggattacaggtgtgagccaccgtgctctgctgagatgaaattttttaaatgtatgtaatctccaggggagaaaatttaaaatcacatggggaagtacacgcacgagaaaataagaaatgagctgtaagaatgtatttttgtgatttgtcttcaaacacagattatgggtatcttcgtccatgaaaccacctaacactggatttccaccatctttgccccactaggtttatggatatttgagagtcttgaaaaatatttatatgtaggaaaatacaggtttcttacaataagcttgcttgctttatttttaggagaactgcctgaactcggatgtggtggaacagatttacaagcggaacccgatccttcgatacacccatcaccccttgcactccccgctcctgccccttccgtatggggacataaatctcaactgtaagtccagagctccaccccgactcctcagagaccatgattccacttgccctgctaactctttagcttaacacagaagcatttgtttttatctcaaagactctcttattcgtcgtgaattggaaggaaaagatgaaatatacttagattcattattaaagcaagacttctagagtgtggttgtagtaatgctaagattgattgctgtagtaaaagaagagatttaaaggagtcagaaaatgccagctctccccatgaactgagagtagccttttgttttgtttttgttttttgagacagagtcttactctgtcactcaggctggggtgcagtggtgcaatcttggttcactgcaacatctgcctcccaggttaaggtcgttctcatgcctcagcctcctaagtagccgggattacaagcacccgccaccacatccagctaatttttgaatttttaatagagacagggtttcgccatattgcccaggctggtcttgaactcctggcctgaagtgacccacctgcctcggcctcccaaagtgctgagattacaggtgtgagccattgcacctggccgagtagccagacaaccagatcctaagtaattttgcattccaaaaaaggattttgttcagcaacagattaccttttaagtaagcattttatgtggtaagaagttcaattagataacaaaacagtgtcaacttacccacctctgtgcttttagatctgtgttcaactgattgagatgtatagggagtgtggtgggcattgcatccgtcctcctcatttattcctttgtcttgactactgctccgattatgctcatgccctattctgaacccctcagatgagttccgtgtttgttttgcttgtcctagtgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggtaaagcatgggggcacgggagatgagctgggcagagctgcttacacaggtggggcactgggtcctcgttcagataaagaggcttttgaacagaagacacctctagtaggacagggacctctgggtcagacttgtgggttgcctgagcaagcttagagaatgctgccatcctttttaagtcacacaaggttatttcagggaccaagtcaccgttggtgtaatgtcctaatgtataggacattggatcaattaattaccactgctctatatttaaaaaaaaaaaaaaaaacttggatatttgttccagatcaaagagatagaaacaatctaattgagattttgattagctatagaaaaagaagtgtcttttcttttctttttttgagacagagttttgctcttgttgcccaggctagagtgcaatggcatgatctcggctcattgcaacatctgcctcctgggttcaagcgattctcctgccttagcctcctgagtagctgagattacaggcgcccgccacaacgcctggctaattttttgtacttttagtagagatggggtttcaccgtgttggccaggctggtctcgaacttctgacctcaggtgatccacccgcctcggcctcccaaagtgctgggattacaggcgttagccacggcgcccggccaagaattttcatatgataggatgaggcatgactctttcaagtattaacaacgctgcagaggtgagttggcagcacagttgctcccagtgagacattggctctttaggggttttttgtatttaaattgaactgcacaaaatgaagcgggcccttgccaagaagtcactggtgcttgctccattcaccagtgggggaccattcactgctttggtctacagaaccttggcacagcctagttcctcccagcagccagcccccatcagtctaaaaattaacagttagtgtttgcctcctaggatacgggaacagtttccaggaaccgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtgaggagaggcagctgctgcttgttctgttagatgcctttgctgcagatacacctgcgtcaggaacattgtgcagcattagagtggctgtcctgcacagttgcagtttgcttagtacagctctcaatactaaggaaatgcatgtaacccagaagcaaccacacgaatatagagataaaaatatatatattgagtggaaacacagagataaagtacctgagacataatcttgctaatctgagaagcagctgagtgtctagcagagctgcagacctggctcaggtccagccactttgatgagggtttattgcagtgcttctgcaacaaagtgtttgtttgcacgtgactagctagatgaatatcagatgaacacattttctttttaaaatttgaacttactattataaaaccagttggccaaaagggtggtaatccaataaccaccaccccgacccccaccccccaaggcttcttatggaaaaaaaaaaaacgtcatctggagtctctgttgttccttggagttcataaatttatcagccaaaagacaggactgaagcttttcacccgcttttcctgttaatataggtttgcaagaaatcagcccagcatctgcctctaccgatgggcaaaataccctgagttattttcagcaagaaagagataaacctaatctcaagagaacaaagggaaaatagtacttttgaaattctgggatgaccacacgggtaacatttttaggaggctggagacgcccttgtgccagcagctccctctgggatcaggtgatggcacgttctgggaacacgtgttggggccgcagcctgtggaactgaagtccccctggtgtgtcttccaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagtaggttccttttccctactgtgtcagaagagcaaataagagaaattgcagagcagggttcagggtttgagcttcccattccatttgtggcttcacgctgtattggagttagttttattttacctgtgttgatgcctgtttaactttgcatatccgctatttttctcgattcctagataaagctacggtcttacgtgatgtaacttgtcagtggttttttaccccattccttttctcagttccatgttggacccgtctgggtatttcttgattttttaggtttccagttgtcattagctttgaaattgggctgattgactgaagccagcttataaactctttaaactatgtgttatgtctacaatgtaaaatggacctacttttttttttttttttttttgagatggagtcttgctctgttgcccaggctgaagtgcagtggcgcaaccttggctcactgcaacttctgccttctgggttcaagcagttctcctgcctcagactcccgagtagctgggattacaggcatgtactaccacgcccagctaatttttgtatttttagtacagatggggtttggccatgttggtcaggctagtcccaaactcctgacctcaggtgatccgcccacctgggcctcccaaagtgctgggattacaggcgtgagccactgcacctggcctgtagacctacgctatttgatctgtgacttcatatcctcgaagtagcgcgaaggtattcctgcttagtataaacacagccctcatacaagagtattcacatcaatttttataaatgttatcataatgtatctgaggcttggtaaaggtaataaagaaacaggcttttgtttcttttcttcccgtggactcagcataatgcttagctggtactaattcgaatgcggctctctgaaaacacttgttagctggttaaactaggggctgcctgtttgttttcttaaagcaaaatcaggatgaaagtacgttttttcactctgtttattcctctatccccatctctatccactgttttctgggcccggacagaatgtctgtgtccttagaatacaccatgtaaagtcaggtccctgcgggtcactgaaggcccttctcgttcatattctgagcctctcttgactcctctctgtaggctggctgccacatccgaggttggggacctgccatggaaattctacttcaaactttactgcttcctggacacagacaacgtgccaaaagacagtgtggagtttgcatttatgtttgaacaggtaaaaggaatagttagaaacagatttctttgccggcaagcaagggtgaaacctgttaatacttagccttgtaagttaactggtacttagaaatgaggcacacctgtggatttcccagcaaagacaagaccagctgctctttcattcgtttgtagaatgaaacctgctacacattttatttgaacctccgttccagggactgttctagttgacaggagagagagcacaaggaataaaatatgtgacgtgtgttagatggtatctgtgctagggagaaaattaaatttaaagcagtgagccaggggtgagggtacagttttagccagggcagtcagggaaggtgagtttgagagaaaccctcatgaagtgagggagcaagcgacgtgggcatcccatggcatggcagtgcgttgaccggaaagctgttgactgtctcctttcaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggaggtgagaactggctgccatgtgttggggtgggctgggtgctggcatctgagaacatggatcacggccaagttcatgtggagagaagacaagatggagcattttgctctctcaacctctttttttcgagcccccaaaattgtaccattaacgcctcccttctcctcacagtttctcttctcctgtgtagtaaatgcatctgtaatattaggaatgaatgcaaaattaagatgtcatctattcttctacccttccttagggaagctatagatctaattttttaaacactgataaaaatctacatttaaaaaaatgttatagctgtatatacaaattagaaactttggatatacttgcattttactttgttttttctttacagccatctgtttgaaaggaagaatgtctatctcgtaatggaatttagccattggcatcaacccagtactgatttttgttttgttttaagtagaccgcttattgaaaagaaatcttactaattgtctagatgagagtttggcaaactggtctgtgggtcagatcttgcctgcctccttttttctaaacaaagttttattggaacacagccaagctcattcctttagatatattccctggctgtttttgtacagagttgagtagttgtgacagagaccatgtgatccacaaagtctaaaaatctttactatgcagcccttaacagataagtgtgccagctcatcgtctagattagcttccattttttatgatcacagtaattcagcgtatatctgatgactttatattgaggctgtataaaattctaaatattataaattctagaatccgtgggtggcttttcattaggtgatgtttttgattggtttggttggttcaattatgcctgtttttaagtataaaaaaatcaggtgctttgtacaaagccataattccatttctccctgacaaggaatagataatagcagttaaactcttggcttcctgcaaaacgtgagctgtgaattagcatagaaagctactggcttggccgggcgcggtggctcatgcctgtaatcccagcgctttgggaggccaaggcgggcggatcatgaggtcaggagatcgagaccatcctggctaacacggtgaaaccccatctctgcaaaaaattagctgggcgtggtggcatgcacctgtaatcccagctactcgagaggctgagacaggagaatcgcttgaactcaggaggtggaggttgcagtgagccaggatcacgccactgcactccagcctgggcgacagagtgagactccgtcaaaaaaaaaagaaaaaagaaagctactggcttttgcatggaggatgcagagaatgtctggttattagggatataaactagagactcttttcagcgtctccaatttatagccctcctgcttgtccaggtttggatcagccctgtgttgttagccccttcatatggggtcttattttcttccaccaatctgtacaggaaagtctacagttaaactggtaaagtccctgttcccactctgcatatggaaggccattgctgctccttgtgaagaggagccagaactgctcagcatgcgtgatttggagaattttcctctgtgatcctagattttgtatttgaagactaaccatccgcaaagaggattggaggcagaactggagatattaatacaagagtagacttggcttgggttgcagggaagctttcttaagtcccccggccaagcatgtacgtttccaggccacttccacgtagctaatccaaacagctagtagaataatgctgagaagtggagagtcaaagcaagatgttagactctgccagttagtgaggttttcccaaaagcgtgagattaactagttagaaatcaagatagccagagaggtgccatttttcatatttcaggcccctccatgcatgcatgcacatcgaatatatttaatcttctgcacagaggacttcactcaaagcctgtcttatggtttagatgctttctgttgccaaccacttcatgacttaactcttctgttgactcttgcccaccagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtaagaggcaaagcaagttcatctttttattcatggtcttgacaaaacagaaaaacaggaccccatttcctcatgcctttgaccaggtcattttctttgaatatttttcttcaaaacacgaaaatacagtgtggtggtccctttccagctgccggttccctgcaggccaaaatctgagatcaccatattttttttgtatacttttgcaacagaggaatttggttccattttgccaaggagtcttacccttggaggaaaggcagagaaagggaagtgacatagatgtccctgaaaaagtatattatttgcaacaaaaccttatgaaaattagttagcaattatagcggtgtcacagctgtgagactcggctctggtggcctcttgagaccaggagggagccgggagcatgaccatcctgggtgcagctcattctggattgtgaaaccacacacactaaaaggcctctaaatatatgtgctaccagcctccaagtttaaaaaatataatacaagaagcttattgaggcttccacaaagggaacagctagcaagtcaacgtggtgagtggagaggaatcacctgctgcctggtttggaatggagaggcattgaggagggcgttccagctgcttggaggatgtggcattgtaggttccctaggctgatggggagtcgtgcagtgagagggaagagggtggagagcccttgactcaagggtcccaggtgccaggctgcaggatttggtgagatccagtagacaacaaggaaccactgtgggatctttgattgtgcatggcataacagtgaatttacagacagtgatctctggggtgggactggaagggaagagagcaaacagggatatggaagccggttatgatgcctgcacagggatccaggccagctgtgagaaggggtggcaatgacggggacatcatgggagggagctaatggagatcccagctggaggaggtggctggtgtggagcagaagctggcctggcgtctggggagctggccgctctcccagcccctggggcctcagttatcttgtttcttcagctgcttcctaaggagttgactagaattagatgatccagtctttaaaggctgtaattgtggactctgtcatttcacatttattttaagcggggatagtaatcccagcactgttgacaccgagtaacttcagcgtcctcggttagttctggattttaatgtgcaaagtctgacagtttccatcaagccaagttggcacgtttgtgccaccaggtggtgcacattgtatttggaaaagctgagattccacctttccctgatgagcaaggtgaaagtggttaaacttctggcttcctgcaaaatgggatccgtcgattagcatggaaagctacgggagggtgcccagggaatgtctggattattaggcagggccctttgcctgggggagacttgtgacgctgtgtcggttctgcttccccctgggcaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagctaacacgctgtgtgtttcctttatcagaggaggctctaaaaaccatggaggggaggcttatttttgttttggctttttggtggttttttttttttttctttagagacagagtctcactctgttacccaggctggagtacagtggcgtgatctcggctcactgcagcctctgcctcctgggttctagcgattctcctgcctcagcctcccaaggagttgggagtacaggcatgcatcaccacgcctggctaggttttgtatttttagtagagatggggtttcaccatgttggccaggctggtctcgatccacctgcctcagcctcccaaagtgctgggattacaggtgtgagctaccgcacccggccggctttttggtgttaatgctatggtttcagtgtctgggctttgtgtttgtttcatggacttgctcatcaggtctaaacacagatctgcagctgtctccactgctcttgtagacactgagtgtgacttcaagaaagcaaaagaagggactggtaaatgaagtcacacacagctgaggacttgaaatgtgtttatgtcagacagtcccctatgtcagccccaaagtgtgcctgatcttgcaaccctggatcctagaacctgcctgcacctccctgtggactagaacacacaggtaggcagtttggttgccaatgtacccaaaccaccaggccaggcgtctagcatgagcaagcgccacttctcttgcagaccactgactcccaccctctgctcatgctcacggatggcttcttcccattctgcagggattgggatggaacctgaagccaggtgctgcctgaagcctgtggccccgccaggcacccaaggaaagccggcaaagacttggatgtgtgttgtctttgtttttattttaggctcagaaagaatttgacagaagtcttctttctactgctcacctctcaggattccctctgtgacttaatttactctggaaggctgtcgcccgccctcaattatagatggggaaataggcaaggaaaggcatgactcagattgggggggttagagcagcaccatagttagaacatagatttacatgtgagcctttacatggcatagttgtggttttgttttagccttttatttagaaataattacagactcagagaaagttgcaacagaacgtacagggaggcctgcgtgcccttcagtttccccagtggtagcatcccccatcactgtagagcagcatcacagctgacaaagtaccgttgagcttcccctagccacagaacctattccaattttactgcttttacatgcactcattggtgtgtgtgatgtcagttgctttcaacaaggtcagtgaagtgcagtcgtcccttggtatccaagggagattggttccaggaccccctccccccacccctgaggatacaaaattcacagatgctcaagtccctgctatacagtggtataatatttgcatagaacctgcacacatctttccttaccctttaaatcatctccaggttacagatacctagcacaacataaatgctgcataaatagctgttataccgtgtgtgtctgtgttttaaacattgtttatttgagacagggtctcactctgtcaccaggctacagtgcagaggcacagtcacagctcattgcagcctcaacctcctgggctcaagcagtcctccacctcagcctcccaaagtgctaggatgacaggtgtgagccactgtgccccaccaaaaaaagttttttcaaatattttctatctgtggttggattcagaccacatgaacactgagggctgactgtagttttgaatgtctgttactgaggaggcaccagcataaagtattttatcacttcagacgctgacaatctagtatttttaatttttaaatcttttgaaagctaatacatataggtgatttgtaaaaaaaaaaaaaaaaaaacaactagaagtaaaatgttacttttttccagctgtagccctaatt
